United States Patent 10,407,724 (METHODS AND COMPOSITIONS FOR SCREENING AND TREATING DEVELOPMENTAL DISORDERS) - sequence listing, part 44

SEQ ID NO: 742 - DNA, 166646 bp, Homo sapiens
cggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatgtctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtaactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggcctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccagtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactcttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcatggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccatataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatatgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctgactatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctctgtcacacaggccggagtgcagtagtgtgaacatggctgactgcagcctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaatacaaaaaaaaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttttttttttttgagatagggtatcactttgtcacccagtctggaatgcagtggcgtgatcagggctccctgtagccttgacctcctgggctcaaacctctcacctcagccccctgaataacggggattactgatttgtgccaccaagccaggctaatttattttctttctttctctctttctttctttctttctttctctctctctctctctttctttctttctttctttctttcctttctttccttctttctttcttttctctctttctctctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacatcctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatactttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattacttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccaagtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgcctgtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaagtgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacattcatgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagccttttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatataagtttaacttatttctaccccatcacttctagtcacatgtgacttcagaattttaacagaaattattattataggaatatgtagcacagagggattccataggcctgaagattagtactgatggcctttcttgcattattctaggctagtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatgggggctggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcctggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtccttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctctttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagccgttaaaggcttttgtatcagatgctatcactgtaactttgttctggaatttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagccagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccatttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccagcctggctaacacggtgaaaccctgtctctgatgaaaatacaaaaaaattagccaggcgtggtggtgggtacctgtagtcccagctacttgggaggctgaggcaggagaatggcgtgaacccgggaggcggagcttgcagtaagccgatatcgcaccagggcagtccagcctgggtgacagagtgagactctgtctcaaacaaattaaaataaataaataaatagataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtaaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgttttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgattcatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagggatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagatcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttatcagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttatgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactacctttacccagctttaccaattgtcatattttctttatcattctggctccctgtcttcctctctgggtctctgtctctctctgtacacacacacacacacacacacacacacacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagaagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctgatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactacagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccatctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccactgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggattttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcgcccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggctgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttacgagagctgctactgtatccttaaggggccattggtaaattttaggacaagtatcttcagggaacctaaagggaaaataaatgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttatgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgacttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcagcctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttactttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgtttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagtagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccgttgcagcctcgcactcctgggctcaagtagtcctcccacctccacctgccaagtagctgggactacacccagctaatttgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagaaccaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttatttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccaaaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacatcaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggctggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggtgtgagccaccgtgcctggccttttgtatttttagtagagacgaggtttcaccatgttgcccaggctggtctcgaactcctgaggtcaggtgatccacccgcctcagcctcccaaagtgttgggattacaggcatgagccaccgtgcctggccttttgtatttttagtagagatgaggtttcaccacgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctacagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctagtttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcctgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaactccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttgcctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagcggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagctcgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcaaagttcaagtgacaattctggtagataaagttttaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagacgatgtcaggtttgattttcttttttttttttttttaagaaatctttaccttgcaaaactaaaactaaaacaacccaatgacagcactgctctccagtttaaagaaaacaaatgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtctctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagtttctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagcctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccacaacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatggggtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacatacacgaacattctattggttctgtttgtctgttctgattaattatcctaatactaacatatttttttcattgacagtttaagaacaatgccatgagatttctggttctagcaatgcagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtgagatacgggctgcagcttttggtttcataatgtatgggtttgggttttagtacccactagggaacagaacatgagtccttgaatccatttacagtgtggactaggaactggtaccttcaaaggggttgtgtctatgaaaagagtggactagaaaatatctgctgccaccacagggaaattaacaaaaaatatttaactgcctgggttctggaatggaagctgggaaatctcctatgggaattcttcttcttttttttttttttttgagatggagttttgctcttgttgcccatggtggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccagcctcaggtgatctgcccgccttggcctcccaaagtgctgagattataggcgtgacccaccatgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaagaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacccatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaaagaagctaataatgttagttaacattaagtcaaatgtgcatgtgaaagttgtacattgtgcccaaacttttccaaagcatagggaggagctgggaaagaaacagtggaaattcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgcaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctatctcaaaaaaataaaatgaataatagatttacatagatcgacatgaataacactcagaaatataacatctcgtcttcaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaattctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtcgaatgattgtaatgggattgctgggtcaaatggtatttctggttctggatccttcaggaatcaccacactgttgaaacagcatggtactgttaccaaaacagatacatagaccaaaggaacagaacagaggcctcagaaataatgccacacatctacaaccatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaaccacatggctgcataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacataataaagaaaaacatcacttctgtaattttggacagtccacactgacggagatgaacacttgcatataggtcaaactagttaaatatagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccgtgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatactccttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcacgcctgtaatcctagcactttgggaagccaaggtgggaggatcacttaagtctaggagttcaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaatatcataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaaaaaatatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtattttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaatttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaactcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcgggggtcctcagaggtgctttcagggtcagtgagggccagggagtgcgtttcagatcctacatcactattataacttcctcttttagctgttttatgtactgaggtgcttctgaagatgacttctgggggaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctggcactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccgactgcaaagaagtaaagtacctaccattaagctgccctcagtctaaccctccacgtgcagtaacagaaagtacatgcaaggcaagagagtgaactcgtgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccagatagatctaaataatgagcacatggtaggtgtccagtaaattatttttctttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatgggttttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccaggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaaaaaaaaaaaaacaaaaaacagaaaaccataaaatttaccgtgtaaccattttaaatgtacaattcagtggcattaaatacattattaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtattttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatatatttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaagaactattaaaactattccatacatcaggtaatcaaaagttgaattttgagggatgtgatgatctttaaaaaattgaaattctcaagatacatgatctttacatgtacatgatctttacatgtagtaggttatgttttcctatttattctgttaacctcatgaaaatccagttcaattgtaaatactaaagttattgactacttttggcagctgttttgatgggaggtataacctttgagattaaaagttgacaatgaagaagggtgcaatttaagctccaatatgtagtgaacacaaatagaattattatctgaaataattgcttttatatccttcttattacagctcctcatttctatctcatcctaaatcttatatttacacatataaacttaacattggtgccatttaactatgtcccctaccacaaagttgatgtgaacatgatcttctcattaccatttcgtattctcatgttaatccatagcacctgcagtcagtgttaaggtagcatatttgtctattgcgctgtttctaagtccataatctcttttttcctttgttcttaacagaacagcctcaaactgcatactgttgataaaaataagcacattggaacatattctttctctcaggaattatgagggtttgagtctggtggaatctcagcctagaatccattgtttttattccattaagtcacccaaagcagctttttttttcctattgggaaaaaagttaaatgagaaattatacaagttgttttgctttccaggctttttatattaatatgggatagtgatcaatacctttagcatgtacgaattataactcgtcttttatactgttagtttttaacactaaggctcaaaatgctttagactcctttttcttaataggcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggtgagaatgaatgaggagatggcattaaaagttaaaggaaaaaaagcagcattttttaaaagcccgtaagcacattctagaaaagtgaattctttttcgtttttaaccttgttcttgatctgaaaatagtaatccaatctatgtaccaatattgtgtacaaattaaaattttcttggggtagaatgttagtgaggaaagatagcaactagttttcttgtaggattatatctgtatttctgtggcacttaatacactgaatgatgccacttagcctcaattcaattaaataaatacttactgagtacttgtattttagtcattgaactagttgctggggatacaaagacattcaagtgttcattcagtctggtcatgaacaaagacagtgtaaagaaattcctgactacggtgtatgtgtgtaaaggtgtgtgtgaatacaagtcatttagcataggggtggtcagggaaaactagagatgctatttaatctaggccttgaaagaccagttaggattttattgagtagacagacaaaaggggaaggacattccattcacaaataattaatttacagttataattagtatgacggcagaaaagttcagtgaggccccatgacaagggaacctaactacctctaaaggtctgggggatgagagctccctgggagaaacatattaagccatgacttgaccaatgaggagactctggccagccaaagtcactggggaggatgtttgaggcagagcatgtgaaaaagtcctgggcaggaaggagcttgaaagagaaagggagattatcctgacatgagactgtagaagcagatagaagccagttcatataaaaccctgtaggccatattaaagatttaaactatcttaggggcaatgggaagccatttgtaggattttaagcagtgaagccacatcatcatcactgctttatgatggagaatggattggaggggcaaaaagatacagaagagactaatggttagaagcagttggattagtcttaatgagagtcgattgtggtttgaagtatgtggagtagtgtagatggagataagtagactaattagaaatatttagaagatagaataaaaatgacctcattattattgtcaatcataattatgctagcagtttttgagcccttgctatttgccagtcactctactagcactgtgcacatattatctatttaaaccccacttcagtcctccaagggtagatgctgctgttgtctctattttgtaggtggggaagctgaagcctagaaatatttgttagattggatgtgggcagaggtatcaaacatgaccccctgggttctggcatacatagcccgataaatggtgctgtttactaagattgggaacactaatggaaagcagatttctggaagaaagatgatgagttcagttttgaacatgttaaattcaagggtcatataggagaagtaaatcggaaatgttgagcagcctgttggatatgtgggtctggctagcagtagactcatgagttgccagtatatagactgtggttgaagccatgggagtgaacgaaatcacttacagtgagggtgtgggttgagacgaaaaggaggcctagaacttgtctctgaagcatgttaacacgtaaggactaaacagagcagaaaaattgacaaaagagactgagcaagagtaaccagagaggaaaggggaaagagagaatgtgtgttacagaagccaagaaaagaaacatattttaagaaagaggggaattatgaattgtatcaaatgctcctaagaggctgaaaaagataccaaaatgtttgttgggtttgatgacatggagatcatttgtgaccttgatgggagcctgttcagtgtaatggggatgggagccgtaagatttagtgaggatgggtgggaggtgaagaacaaaagcagccagtgtaaataattacataggcaagttccattttgaagggagaagaaggtgcagttttgaggggtatgatgttcagaaagagttttttgttgttatgtattaaactgtcagatagactagaacatgctaaaacacttttggaaaggcttcagggaagaggaagaagtcgaacatatgggagaaaggaacaatcagtaatgtcatgttcctgagaagatggaaaggaagatttgattggtttatggttgaacgagggacacagcttccaaaacagggaagggaaggcagggatgtctaaatgtaggtaagttcgtagatttgcttgcctttatgagaaggcctgagtctttagaattctaactttttacatcacatttgcttctaataaggcagttttcccctgcccccaatatcagctcttaagattgtctttttttgttagacaaatgatttgatagaactaacaacataagtactaatatgcatttgaatgcgttcttttaagaagcaaaacccttacactctgtatattttgccaaaagtttgaaagattaaggatatgtgagaatgtcaggaggcatgtatttcaccatacttttgagaaatgctaattagttcattaagtttagttgctaataaataagagaaaacatgtctgctgtgaaattgtgtcaggaaatgttaatgagcaactagtcgagacctcagtatgttctggataaaagtttaaacttgttttatttccctttgcttaggttggcttttttcccctgacttgctcatatctttatgcaggccctcctcacagtgggaagactgctttagctgcaaaaattgcagaggaatccaacttcccgttcatcaagatctgttctcctgataaaatgattggcttttctgaaacagccaaatgtcaggccatgaagaaggtatcaagattttactttcattttaatttcctatctcttaaatgtgtgtgtgtgtgcacatatatatgcctttgtacatgtatacatataaacccatagcaactatgttcttctcaagtggaaccaaattatcagcagaatatgggggaagcagtgactgttttagattttctaactttgtaatgtattttattgagtacctttaccttctaaattatgctttgtttaatacatattaagtttcattgcctagttttgtatcaatttgattaaaagagttatagttgaaagtgtttgaataaagtggacaaattcatttaggattttttaaagttctttcattattgtacaaagttgaactctttggggtcaattaagttgaggaagacagagatgtatcaatgggaaaatagtcccaggaatccctacaaaaggatagttttatattaggtaataatcagaatctgcttggtaacttaatgcagttctcatacatcttcctttctccaagtgccactcgtcaccttcttaattaacatggccactttctaccatcagtgaagttagaacagcatagaatagaatcctagagctgaaaagactgtaagaccatttggtccatctctcttacattcaagcaagtgccatgcaacaacaacaacaaaaatcaatgatgaagactctaaatggctgttccatcttacttgttagatcatgtttccattgctattctaattttgcatactgccagtcaagaaattattttttgtatccagctgaagtatttcttttatttaaattctttttttcatgcttgatcttttatagatatgaactgaccgtaagtccaagagatgtgggaaaatcagaatgaggtgaaagaatcttgagaattgaagtgctccctagtaaagacagctcagggttttcttttacattgctcttaggcattcgctttataaagatgtattgtagaattcttcggtgtttctttgggaaagagactgaagaagagaaatagatttaaaagatgactcccaaaaaatgtaagcttgagaagctagtctcttgtttgtgcaggtggcagaaaattgcacagggtacttcagatggatggaggaagccgaacttgtagcaggattccaggcatacacattgaagagtccagagaaatacataaaaatgtttgaaattgagtgtgaaaaggaaatattgccagatgcaaaaagaacttataatatcatagtttattctgtctctgaggtgaaaccaatagtatctgtccttcccaggaaaatctgaatagaataactgggaccagtgatttccctagagtaggtagggctgtttttctttgtttttcgttttccctctgatgggaacccttaacccacttcttctggtaaaaatttaaataacagcccttgaaatctgtagctgttgaatgtcccatttatttattgaatagctaattctatttgcattctcctaaatcatctattcctgtgctttttcaaaagtagtagtcatctttgcagatggtaaattactccattgctttccaccagctgccagcttctacctcagatgtactctgagatgtgggtggatggtcctagtttttctataaagtttttaaaaagtacttcaggcttctgcagatcaaagctactttgtaagtgtgagatattatcatttttattattttaatctcttgcaaattgacttgaagggggaaggtaatatgtgctgattttagaggcttaaatggttaaattaatggtttaataacttattatttaatcttcaaattgttgaagcctttcaaggtagagtttcagatgagtagaaagctagggagtataaaaataagtgtccatacaagcttattcaaaattgttttaattcatgattcactgtccggatcatccgtgcactcttaaaattataaaaattatttctgcttcagcagtataacaaatttatattagaatttttggttttccttgggggaaaaatattattctttgtcattaaagttcagaaaagagaaaggaatgaagcataggtttcttagaaatatattagaaatattacaaaatatttccctgcaaatagttttcacattgttacctaatgataggttgacaaaagcctgaggggtcaaaccagtctaaagatgctaagtcttccaggttgtttttgaaaatgaaatgtaaatgtcattctttagtataagttctagtctacctcccactactgttcttgcccctccttttttttttttttgagatggagtcttgctctgtcgcccaggctggagtacagtggcgtgatctcagctcactgcaagctccacctcccgggttcatgccattctcctgcctcagcctcccaagtagctgggactacaggcacccgccaccatgcctggctaatttttttgtatttttagtagagatggggtttcaccgtgttagccaggatggtcttgatctcctgacctcatgatccgcacgcctcagcctcccgaagtgctggaattacaggcatgagccaccgcgcccggcctgcacctccatttttagtgtgaggatggaaagaagatgttttaattttttttcagagcacaaataatttatagagttttataattctggagaaaacctttcttttgttgttgtaagtgcaaaaattaaggtagctttttctaattacagaaataatttagaaaatacaagaaagaacagaagaaaataacaataaattcatatttgtccttcaattctcttttctactcagacacatgtgtacacatgaacacatataccccctcccttatatattggggattacattgaaacatactgatgtaaacttgcttttttcacttaaaatattatgaacttttttcagtgtaactaaagctaatctgaacattattttaaattaatagctgtctaatatctgaacaatccctttttgttggacaattaggttgtttccaggtttttttcacaattataaataatatatatcaaagagttatctatactcccaagttcattgcagcagtattcacagtagtggaatggaatcaacctgaatgtccctcagtggatgaatggataaagaaaatgtgacacatatacactgtggactgtaacacagccatttaaaaagaatgaaatccttgtcatttgcaacaacatggatgaaggacctggaagacctcatgttaagtgaaagaagccaggcacagaaagtcaaatatcacatgtcctcattcatatatgggaactaaacaattgaactcagggaggtagagttagaatgatggttatcagaggctgggaagggtagtggtaacaaaaataccattaaatagaagtaataagatctagtgttggacagcacaataaattaactatacttaaaaatcatgggccaggcacagtggttcacgcctgtaatcccagcactttgggaggctgaggtggggggatcatgaggtcaggagttcgagaccagcctgactaacatggtgaaaccccgtctctactaaaaatacaaaaattagccaggcatgatggcatgtgccctgtaatgccagctactcaggaggctgaggcaggagaatcgcttgaacccgggaggcagaggttgcagtgagctgagagcacaccactgcactccagcctgggcgacagagcaagactccatctaaaaaataaaataaaataatgtgtcgttcggggagtgggcctggtggcagtggcggtggcagggaaagagttggagcagtgccagcggcaagcgaacaaggtgacggaaatcacgcttaacaactttgacaaggtcctggagcatgatggaaagctgaccgaactggagcagcgttcagaccaactcctggatatgagctcagccttcagcaagacaacaaagaccctggcccagaagaagtgctgggagaacatccattgccagatctacttggggctagtggtgggtggtagcctgctcatcatcctgattgagcagctggccatctttctccctcagagtgacaccagtaatgccccacagacctaggatgcaggcaccacctcagggcctggggactgacagctggtcctgagggagaagccaaatggctgcactggctggttccggtctccagagaaccttggtgtttgctctcccctgacccaccccagtgagtgccaaagggcagccccaacacgtgcacccctgcatttcttgtcatgccacagactggccctcgagggcaccctgccatactggccatgccgggccagccccacctgaagctcagtgaaagctgattaaaaaaaaaaaattatgtatagatcaaaataactacaagagtggaaattgaatattcctaacaaaaagaaatgatacatgcttaatgagtttcacaactacccttatttgatcgttacatgttttatacttgtatcaaaatggtgcatgtactccataaatatgtataactattatgtagccataactaaaaatttaaaatttatataaaaacagtattccataggactaccaaactagggaaattactgcccccattttctcattagatttttcttcactagagtagtataacatgaccgagaatttgggcttgctcagctctccacactgaccggccgaatgaccttggatatgtcatttaacctataagccactgttttctcatctgtcaaatgaagataatattaatagctgcattatagggttatgagaattagatggtaatttctgtaaagtgtcacagtgcctgggatataatatgaaatcaatgaagtgtagtggttatttttacttattattatacatacattttttattatttccttatgacaaattctcagaagtgggattgctaaggtaaaaatattagtattgtaaagatttttgatacatagtgctatcaaaactcttaggtaaaaaatgctcttggttttataaagcctacgccttcagaatgttgtactaatttacacttgtagcttcaccatataagagtatgagtttcttgggattctcacccgtacttgatattattaaaatattttttgccagttggataagcagaaggttggcatttagttatttctttagctacatttcaatgactaaatgctcaaatttaagatttttcaaaatgttttgcaatgacaatagtctgtgaaactgaaaaatatgtaacacattaatttttgttaaagatgtgtggtctgaattagttaattcatagagcatctttacctaccactttattacttaaaccaacaggtaagagttttagtagagagggctgttaggcttgctttaatgagtacatgagattttattataattatactattgcctctttttcacaaatggatggtgctaaaatacgtgaaagtagtttattctcaattaatttaaaattcaccttgtacttctcttaatttgcttattagtgaatcctttctccatggataaactcctcaaaactgctgaagtatgtatgaggtattgtcctcacgttctggggggtataccatatgttccattaagatgtttgaagtattcacagaccttccccttctcccctattttacgtttgcttcccaaacttcattctatttttaaattttaattcctttatccatttttgcatcaatacttgtttaaaaatctattttactagttctattcgtgccattaaatgaacaaaagaagaaagcagaatttgattttaactaattacctaatcttgatgctttctgagtatacaatcagtagagatgaagtagaacaatcagatagaactaaattgtttgaacaaaattaagtaaaactaccagtgatttataaaactgtacccattaataacatgatatagtcttattttcaaaggattgaaaattaatggaagaaattttcctttccactagctttgcacgaaagaaataatcttctttgaatatcctcctgtaaatcccactgcaaattgtagtctgcacagaacagaatcgtgatgcctaatcctcctcttttcatggtttagtctatacaaagagcagagctggaaattggatcttttgacagcagttactaagcaacagaatttggatgtttttggttaacatcctaatatataatgtagctgatttgttgaagtttttgcatatattagctgagagaagtgggcactccggaagtgactacaggtccctgtatggctggggaggtgggcatttgttgttgttttgttcaatacactgtgtcttttggcatttgtatctctttggcgtagaaaggaggctggtgcagaactttcagaccttgtgactttttatattattaagaatacccttctctgtggctcacgatatgagaaaatgtaagattttttcctgaaaagcagggagaacaaataaaggattttaaggtcattccaggaagctttagagctttgccaaaagtttaggtccacttcctgaggcagtttcattagcagacagctaatgtttgcttggtctactcccaagttatttttagaaacgagattattactgatagcacccatttgaatttgctcatttacgtttttatatgctaccaaatatgattagagtatgcttttaactaatcgctgacagatttactgcattagggattttctaagctatgagattcctacagtcatcagatttctactaactaggtacttcacgccaagtacttcagaactgagatgaactctttcagctcccagaagaaccagagtgtttggctttgcttacctaagggcactaaggaggtcccagaggatggagggctgaatctcctgagagcatgcttgttgtggcttgtgatcccgaaaggctgggattaatggaactaatgctggtgtgctcccatttgcacttgtgtagactctggagcccgtagctgctgcccctgtcccacacacaggtggctccccagttgtctgaagatcccaggagtgggctctgggacttaagagcttgccgtgtccttgagcaccacattcagacctgcccctaatccctgcgtggcagagccccgcttctcctgtccctcagtgctcacggagtgcatgtggcacactcttgccttaagcccaggctccccacactctgggttgtctctcatacccctccagcctgtgtcgtacctccacctttgcatgcaagagaggttacagtttaatatgacaatctcattatgtgcacaggtggacataacgggcttctgtgttttctagagctgctcttccttcctttagagtagacttcccgttatttcatgagacacaggctgactgatgccactctttcccacattgtttccttcttcagttcttcctgttttttctttagccttctctttcagacttccctcctaactttaagaccctatatatgtatgttgataattttacctgttctacaggaaacttcataatagaactgggctgactatacattctttttctgtgtgtgtgtgaatatatactttttatttagccatttttgtttacaattgaaactctgggaattcaaaattaacatccttgcccgtgagcttcttatagacaccagaaaaagtttcaaccttgtgttccacattgttctgctgtgctttgtccaaatgaacctttatgagccggctgctatctagtttgacggggattctcttgcccacaatttcgcttgggaagaccaagtcctcaaggaaggcatcgtgcacagctgtcagagtacggctcctgggacacttttgcttattttttgtacggcttttttgagttggcttaggcagaattctcctctgagcgataaagacgacatgcttcccactgaactttttctccaattcgcgtactagccggacttggattttctggaaagatttcagttgaggaacgggaacaaagattatgatagctttccgaccaccaccaacttcagtttccttggctgccgtaatattcagctccctgagctgagccttgaggtccgagttcatctccagctccagaagagcctgggagatggccggactcgaactcgtccggcttctcgccattgggcttcacgatcttggcgctcgaactgaacatggctttctcctgggagaacttgcagcgcctgcttaggaagagacccaaatctcgcgagagcacgtcaaaatccctacattcttaagattaattttggggggagtctgtaagatacggttcttaccttcttacctccagcctcagtcctcctggcatcttctgtgttggggcatctttggatctagagcaagcactgtgtgacctgctgtgtgctataactcacggtgagtttggcacttcagttgtactagtctggctagggcagtttgtacaattttacttttctcgcatctttctttccagtacctctcctcctgctgggatttatctacctaaagttgtggtgcagcttcccggcttagtatgtaaatatctcacttggattttcctgtggcagctaacctcacgtacttgccagccaactctgagtatcttcttagtgagaattctgctggggcctgggccagaaagggtgaaagggactaagggactgaggagactaggcagaaatcgtggatcctgggaagagttatgagcacaggttacactagtgactagataaggaagaaaatgtacatgtgagaagagaaagggatgtgtgtgtatgtatgtatttaaattagagcagagtagctacccggaggagtttcagttgactggttacctgaaactagtcaagttacaactggaattgcacagccttcgtcatggtcggtgtgttaatagagcttgctgtgagtgcacctctccctctgatagtaattagcacagagaccgactgcaaaaaacaagaacgtcactacttgatattaagtgactgctgcaggtatttttcctctcaaatgttatgtgtaggccatgcagtcaactgtgaagtgatttggaatgctttgtgaattacagtgtctgagataagttggtgagactacataccatgtagcaagtcatcattagtttagacctaagcaatgtcctgagtaaggtccttgcagccatataagctgtacattgttttgagaaggaaaaacatagaactactgcaaccagccaggctgtggtgttccaggtccctgtggctctaatccatgatctcacagcctgatggtcagagttatatgctggcatcagagcttttagtagaattctgaaaaatgttttgaaaagcaaagcattattttcagtgattccttaaaattacctgagtttataagataccacattggctgcggttccatcttcaaaaaaagtagcaaagaaccgctgtagaactgcttctgagcttttcagttgtctcgaatgtaccaactcaaagccaaaaggaaccatcattgtgtatcaagagactgaaataaatatcctattctcattttctctttttctgtgtttggggaggagaagataaaaggcccttcccttcttgctctttaaatgtactcatgatccattttcaaaccagcttcacctctgtgttttatttcagttgccaaatcaggacagatccttgactccagttttctctttcatcaccacacccattcattcaccaagttctttcagttcctcctcctaaacatctctagattctgtccacttaccagcacacccactccctggccaccatcatttctcacctagaactccacaatctcaattaactattattcccctctaatgcttttctatacaatcaggaaaatgtttctaaaacataagcctgacatgtcagtccattgcttataaccctttagtggcttgttattgcctttacagtaaaattttaactcatgaaatttgtaagactctttacgtccaagttccttcatcacctcttctaattcatctcacctaccactccactgcattgacaccaacaccactttattttaattcttattgaccgttcctgcagtgttcctgaatgttcacatctctgtgtctcctaattttcagtatattctgcttagaacactttcttccaccctttccactggttaactgttgttcatgcttcaagtctcaggttaagtgtcacttcctaaatttaggaaactgtcctgactccctaagtccatttaagagtcaagataggctgagttatgctgcatgaaaggacaacccgaaaatctcagtggcttaacacaacaaagtttattttttatttacactactatatctccgtcatggctcagacagtgagttctgttcattatattttctcagagactcaagctaatagataatagaggccccgccttacatctgattccatgatagccaaggcagggaaaggagtatggtgaatcatgcagtgactcctaaggcttctttcagaaaggggtgtatttcccctcatatttcattaaccaaagcaagccccatagttatgcctaacttccaaggcactggggaaatactgcctaccctgtgcccccgtatcatcttgtatttcccctagcctaataatgtcatgctttgttataattacatgtgacttgcttccccaactctaacttttgtgaaagtaggattatttttgtcttatttattatcctctgcagtgccttcattaatgcttgatacataataagaattcaaaaatatttgttgagtgagtgaatgaataaggcagcactccaagactcaatccttaggcctttttttcttcttcttctgccatttcttcttgaagatggcttcctctgtcatggtttcagcagtcactgccctgagagtgatttccattccctgacttcaatcagatatctccaacttctcacttaatatttctacttgaatttaaaatgtgtaaatttattcttttagtaaatacttcttaattactctctaataaggcattatattaaatgatatgaggatacagaggtaattaagacagcacttgccatctgagggcttgcaatctagtataatacaaaaatagtacaatgaatcaataatatatatacgtaatatacaaaatcctgtgccaaaggagaagacaagtgatttatggcaagatggaattggaacttgtgttgtttcaaccattgaacctacagagcagacatcattactgaattctgttctgtgctgggcactacacataacatgaacagaataaagcttttatccacctcacagtccagtggggagacagatagcttaggacgaaaggatagatggggtttagacagagtgtgggagggtaattagggggtaaagggatggtgcataggaaaacgttttcaccagaggggttgacctgattaaatatctggagaaattgtcagtatttatgccaggaaagaggtaaggaaggaactgaatcaagatggtcacagtgagactctattatggtaacttaattgttaggaatactttaaaaaccaagtatacacaggttgtttttaaacctaacatgaaaaatggttaatatcatgagtttgactttatttctgtacctaattataagtcttcaatggttaaaagatacccaggaaggaatatatgccattccaagcaagatgttggtgcgggtggggatcgggtttactatcttggtgtactgaggttggttaccaaccagagagagtgggctgggatgcagaaactaattcttactcatgacactgatgagatttcctgagccccacctgtagtctctggaatagtaccttcatttccaaaaaggctagtctcaaggccttgagtacttctattcaacttgcagataagctaattcttctatctgatttgaaattactacatccttgccaggctaaaaccgttccttcactgcttaatttcattctcattttcttgaccatcttaagacagtgcattcatatcttttgtctggttttatacgtacatctatctgatccttcatactcaacctttaattcttttgtaagctcttttaccattatggtctgatttgagttgacagaattctgatctttcagtgttacttttgcttaacagagccacaattcttatagataataaaatggcatctagttttattttacacatctcttgtggctccatctagctcttgagtcattacactaaagtcctgctcctgacacagataccagagaccagtgtgatagaagtgatgggatgtgtcagttgattaatgatcagctagtccccagcctgcccaggtgtgacacacacagctgttagtgctgaaaacagccttagcctgctctctgttcagcggtgatccagtgtgtcaattctaatttattgtagtccaaagtgttggtgttttcctgtgctttgtttagtattgctcaagaagtaactaaacttcttggaaattgtcgtaactgtggaggacagtgagataataaatgactttgttttctttcagatctttgatgatgcgtacaaatcccagctcagttgtgtggttgtggatgacattgagagattgcttggtgagtcctaacttctgctgttgtattatctttgccacattacagctaatatctcaaaagttacaagagaaaattaacaagtatttataaactgtaaagcaatagaaatacctttctttgtcttacaaggaaatataatgttctctcttaaatagctgacatcaatgatagtattcattttaatatgccctgtgactataacaccattataaactgctttcttgtaagggcccatgtctcattttgtatcttccagtgtgcccttgccatagtaaatgattagtaattttcattgatgagtatatctgttatttaggacctctgagctcagaaattcacttgtgaactttgacagaactaatgaaagaagggtttaggatcacagagaaatctgcaaattcactaaaacactaagggcagaagttgtaagctctctgcacctcagtttctgctcttacaaaacagagactataatccctctcttgcttatcccacagagtaattgtgaagacaaaaatgggataataaatcttgaaaaaattttgtaagttaaaagtgcagtatagtaatttttaaaatatgtattaaatatctcctgtgttgaagtgcactcctacagaatacaaacatgaagaagacttggtcctggcacttaactcataagaaataaactgcaaggaagggccagaaagttgttaattttatttcactgtaaaattaaatcagtctgacataaattcattacaacaatggctcaggaaggggtaatacactctattgaaatggaaacccacctggtgacttaataacatctgaaaatactacccagtgtctgaataatcccttcttctttaagctgtccataatggtgtagtcgtgatttcaagctaactgttcttactgcatttttcccatgattttcagacctgcttttggtcctctgttatttatttttttaagttttggcagtgtctgttataaagcaaagcaggtatatctgtgaggtctccataaattgatagtgggttttgggtctgctaggtttgatacatctcagcccagtttatgggatgatttctttaaaagcttttaggcacaaactcatagctctgtgtaaattcctttatcttaacacaattgaggtgtgtggtcatagcaacactaccatgtcaggaatgtgtgccctctgagtacatttcactggtatgaatagttatcatctgtgcatgcttgctcatttattcaataagcacttgctgagcccttcctcctctggtagaagtattagagtctcagaaaaagacgctgctgcctgtctttataacatatgttggcaaatgttaatgcaaagtagaatgtgccatgtattttggatattctgtttttttttttatttttattttccctcccactgttctcatcaggtggatagtctgaaaatggagggatcagttttgacctcagggggcctgcgagtagctctaagcccagggcagaggtgcatatgcagtatgcagagaaagctaagcaggtggcatttacgctgaatcttgaattattggtaaatgtttaacaggtcagatgttctcttagaaagttatctgttccttaccatctgagggccaatcttagtggttctgccattgtttccgttttattgaaattccttattttcccctttgcccattttctaacatcatgttttaatatcagtgtactgaatggccatggtttgcagtaacttcttagaaatgcttggtaaatacacctggaatttttttttccttccaaaataatcccagaaaaaacatctacatgaactcaaagtgaatatttagaagctttttcaaaaaatttatagagccgagtacagtgggattatggcaacctataatcccagctacctgggaggcttaggcaggagggttgcttgagcccaggagttcaagacaagcctgggcaacatagcaagaccctgtctcaaaaaaaaagttacagataagagttcttatattttaagcatttaggttattagagatattttttcttattataaatagttttatgactgttatttaagactgtttactctttaaattttttttttcttattctatacatattctgcttatgtagggactgtgtttacttttgatgcaaaaaaaaaaaacaaaaactgaatgtttggaatatgtacatgtgtatcaaatccctaaacataataatgtttcttttccagattacgtccctattggccctcgattttcaaatcttgtattacaggctcttctcgttttactgaaaaaggcacctcctcaggtaaaataatactactaataaggaatattttaacaaagagtttttcagtaaatcgcatataatgatacaatctttaaataagcaggttatcataaacataaaattctgttgttgaaaggattttgaaaggtcgtccagtcttgacttctgtttaaggtaaattattttatcaacagaatttttccattccttttctgaagaaatcaaaatcccacagtttctgtgtggaatacaacaattagcattgtattttgttgttttgtaagttttccaccatattacatatccctactacctccaactgccaagggagattatgatattaatagagaaggcattgaatatgttcccatatgtttcatttataatttcatgggttttcctaaaaatttgtttatggggatatttaagtttattttctttgggcagttaaaaaactatttttaacagatgatcttgagttatttttcttgggtcatgtggcacttttgaggagtgaatttatagccaggatcttgattcctgtgtttgcatttttactgatgtggctattagagacttgtgattttggtaggttaacaaatttaaaaccaacctatgaaggttggttaaatatgttaattatgtagaggctgccagagcatgtttggctgtgtcacaagacatgagttctcttgattgattctgcatgctgtaaccttgaaaaatgccaatcaaaggcaggtacaaagcagttaagcactgacttgaaaagcatcttaatgtctgtatgagaatctcatatttaaagttagagatagaaactaatctgtaaggaaaatatttactcttaaactggtgaatctaatttttaatttaacagttatatatgtgcgtgtattttgcacttaaaagtaaatgacttgtcttggtttttctggagtttttttttaacttctaaaataatgaaaagaaacataacctataatagtcttgaagatttgcaacatatgtgtactgtggaaggatttttaaatcagcttttcataaaccatcattcctagtaattggagtcttagcttatactaagggtgaagttagagaggtgagtgtattttccctttctctgattcctgcaatattttcttaagtaagtaaacgtatatatctaaagttgctgaaacagaaataattatctacatatatcatgattcctccaatgttttcataaataagtaaacgtatatatctaaagttgctgaaacagaaataattacccccaacatctacatatattatgcacacaaaaaaactttatgtcagcatattaattataaaaactattagaatgtgagactttttctaggcatttaaatttatctcttaaaatagttcttcttttttagctgaaaataatttatgctaaaagtcacttgggagaaggaagattaacttcagtgctatcttatacttcttgttctttacattgttaaatactatacacattgatttaaacagaggtacacccccttggctgagaagcatttgtgatccaaagtagatactaacagaaataaacagaaactattaacgaatgatctgccacactaagatttaagaataattgtttctgtgttgtaaaacttattgtaagatttttgagggaaggaacattatcttatgcttttaaatctcacagccaatggcatagaggcttatacgtacatgcttcacaaataccttatcaacaaaaaaaaatttttcagtgtcttttcattttagtgggctcaagtgttttcatattgctggagtttatatttagacaggatatgataagagtgaaaacattcaaaaataagtaaagttcaaatggccaacaagtataagaagaggtactcaacatcattagtcatcagagaaatgcaagtcagaaccaatagtgagataccactcattgcatacctgctagaatggctatcatcaaaaagtcaggtaatgacaagcgctggtgcagatgtggagaaattggaacctgtatgcactgctggtaagaatgttcctcaaagaggttaagcatagagttaccatataacccagctattccaccaagtatacacctacaagcaatgaaaaacatatgtccacatgaaagcttgtatgtgagtattcatagcagcattattcataactaaacatttatctgataaaatctagtatatccatataatggaatattactcagcaataaaaaaaagtagtaccattacatactacaacatgaatgaactttgaaaacatgctaagcaaaaggagccagtcaaaaagaccacatattggatgattccagttacatgaaatgtccaggactggcagatctataaagacagaaaatatatttgggatggcctagggctgggaggggagaatgagaagagtgagagggtcactgctaatgggtatggggtttctttttggggtgatagaaatgctctaaaattgattttggtggtgttgtgtatatctgtgaatatactaaaatactgaattgtacactttaaatgggtaaactgtgtgctctgtgaaccatatctcaagcgattacattttttagaagtggtttaggagctacttaaatgatgaaaggagacatagagttagaagtgaggggtgagcatccaaggtacgtggcccagcttgggagaaagaggaattggatcatttaaaaagaacatggagtgaatttatctaaggactgaagaggaagaatatagaaatatgtaagaagtaagagatgtggttgccttagtgattggaaatggcaggggttctctctgaagggaataccatctggtcattaatctgaatttggtgactctgacctggactgccagattacctgcagtatacatgaatcagtgacaggataaattaatatttgtagtatttctagttggcatgtatttaacaaaataaaaatgtgctttgtcataccaccttgctttttaaaatgtttatattctctcaagaaaataaggggaaattttcaggctgatccaagtgttaagaatattagtcattgtaaaatggaagcattcactttgtcaaaccattagcatatagttttttcagatgtttttaattaaatattaaaggtatattcagctaaatattgtagaaatgcatagagtgatagaaaaatatttattactggtaagaaaacaaaagttgtgagcatttttctttaaaaggaggaactatacttatatacactacagtaatcatatcagtcacagaatcctcaattttgcatttgttgtatttccagctttcacacagaaaaattgtgtgtgcatgtgtgcacgtgctcaaataaaagaatcccttcaggggcactatgttgttatgtatccagatattctcttttctccttccacccctcccccaccaccccctcccttcttgtaaattggcttattaaaactggttcccaagccctccttttttccctttgtgattgccttggtcttggattttcagtgtagaactaaaaattcaagtcagatttcagttactaggataattttctttgaattttaaatttttctaagtaaatgcatagatttttaatgaacctggtattcagtggatttgctttaaatttagctgcagagttaatttcatgattgatttattagccctttgaaagtataaaaagtggtatctgcagttcgtgaagagtgaaaaacatcatcacattttgtttagcatctttttaaaaccaattaaaagcttttctaaaatggattgaacaggagaaaataaaacatgttccctaggtctttatttcaatcaagtttccctgtgttctgcaggagaagagatcgagaggggatagaaaaattgaaaagggctgtcccagcagggagccaagccggaaaaaagggcttctctgagaactcagcagcagcagctaagaaagctcccagcctgcttcatctacatgcagagtcacacaaggcatgggggtgctcactgtcacacagaggtttcacatgtgcttccctgctgattcctgtgaaaagctaacaattggcttggagggtaaaagaccactgcagttcaccctccctgagctggacgtacaatttgtccagtgttaggaaatgtccggcttagcagtgagaggcttgaagacacccctccttccagtgagattcctaacgccgtctcttttacttgatgacactggggctcttttcaagttttgcagatttatggaagttgaggggaatgtgcttttcaagatcaggaggatgaaagccttggtcttaatgtcaaggaggaagcggtagtgagtggtaaggccaggtaactcttcctgcagcctgcaggaccagtggcttgatttttcctcatagatctcttctgccaccttcttttttttttctttttgggagacagagtgtctgaaaaggaactccttgggctgtaaaatgacatgattccccagtttcctcaacaagtgtgagagtagttaagcctattaacctcactgtttaatgctgggtttgacacttttgtgcatcaaattggaaaacctcatctgtatgtaacagggtagcctcgtaatttatggaggagcaatccttcctcagttcagtgcttcccaacctttttagattatggtgcatacaaaatgataacatctgatgatacacttgggtaagtggatgaggccactcacaactggccagggctctagccttcccaacagctggcaggaattgatatcttagtccaggtataactcatttgaagctcaacgattggaaaactctttggaaactttaaacttttacaaaagaagaattaccactccaacgtcatagcagtattactgaagtagaactcagacctaacagttattagtgttctggctaaattttatgatgttgttgagaatagtaacttcctcgctgctctgacacctaggaatattacctaataagagagaaatacagcttaaagcttggaggacctaaggtgtggaccaataagaaactgtcagcattctcaggatggggacttgggtagacacacttgtttctgcatgagttttgtttttaacatcagcagtctctagacaacattgctttcatgtagtccttacatgacatcttagcagtcttacttcagatatggttataggacatcttggtatcttgataatattaagcaactctttaggctttgggttgctttagtgaaataagcagataatggaagagactccaaatcatgcaggcctaaacatgagtatctctccatctatttgttcaaaattaactctggctaatgactatgatatgactcaataagatatataaccactttaggaaagaggcttagtcattttgccagacacattaattttaatccactgatgtggtgacttttgcattgggcttcatttcttttatctaaaaaaaaaaatgatgcttgacagtttagtggcctgcttagtaagtcagtgacattagatacctactatatttataatattctctttaggtatactttgcttagtatagtagattttcttggaaagtcctttgtagattgaacatgtgtgtgtgtatatatacatatctctgaggacaaaggaaatttccagagatctgtgttcttgttttctggacagaaagataatgtatagtgaatgtatagtgatcaactaagataatgcctagtgaagccctttgtaaacctgtggactacatagatagacagtattaaagaacatatatatatagtacatatatatgtagattaatttcaaatgtatcaaaaacagtgaaataggccagacattgtggctcacgcctgtaatcctagcactttgagaggccaaggcaggaagattgcttaaggccaggagttcgagaccagcctaggcaacatagtaagaccagtctttacaaaaaaaagttagtcgaatgtggtggtgagcatccgtagacccagctattcaggaggctgaggcaggaggatcgcttgagcccatgagttcaagaccgcaggaagctgattcttaccaccgcactctagcctgagtgatagagcaagactctgtctctaaaaacaaaaccaacaaaaaacagtgaagtaaattattttataaaacattgctacagatatctgctgaataaaatcaaattttcaaaatagggttttgttttggttttggtagagcacatctatagtagatattaataccagaataaattataagatatatatgccattttctgataactcaaaattaaatatctaaattttaatcatcagagaaatgctaatagtgttgagacgaaatattttttcattgctagaatgtattcttccagatccattgccttaaataagttactgtggcattacattagcttttgaaaggtggggattataacgtcgtagtagtccatgggtgccatgactctagttaagagcaccctttctgtagaacttactctttgtattgaacttgaggtttaaaaaaaaaaaaaagaaacctatgtcttagctcagatatcatctggcattatagccttgaacgtcccttaatttcttggtgtctatttcttcatctgtaaaatagagataattcctcatgtgttacctactctgttgagggtcagctaagataatgtgtagtgaagccctttgtaaactggtggactacatgagctgtccaggcgcagtggctcatgcctgtaatcccagcactttgggaggctgagacaggtggatcatttgaggtcaggagttcaaaaccagcatggccaacatagtgaaacccgatctctactaaaaatacaaaaattagctcaacgtggtggtgtgcacctgtaatcccagcgactcgggaagctgaggcaggagaattgcttgaacccaggaggcggagtttgcagtgagctgagattgtaccactgcactccatcctgggtggatggagtgagactctgtctcaaaaaaagaattgcctttggatagtccacagaaccttttcagcttgtaagataggaaaactgaagaacgtataataactgctatatagaggaagtttccataggaagtgagttcagagctcccactttggaatgcctgaacccaacttccctcatttgcagtactgggaaaagaaacctgcttccccatctctcattcactgaaatttagaagcttcctacatcctaagacaaatactcttgtctggggattagggattcctgttgtagaaagaagtaggaagtggagacaggaattgccaagatcagtaggccaccaccaggtcacacttgtcttcagcctccagggactggcccacctgcttcctttccctgccaccacctgttgcttgtggctgaagttccccttttctcctaactcatggtgcaacaaagtggtgcttcacagtttctttcctacctttctgtcccagaaacaagaatgcagatctttggagatttcctgtgtccttggggatctcacaatggccagaagccctggccctccctctactccttaccctgttaatcttggatggtaggattataggtgatttcttttttattttgctttattgtttcctgtactttatagattttctacaataagcatatgttactttgataatcaggaaaaaataaaaaatgtgtatacaattatttttaacttagcagtataactgtcaaaaattccttaattccattgctttggtactaatttgctgctaaccactagggttaaatgagactacctttgtatctaagcttgtctatgtataatatatttttaaccttgttctttttatgacttaagatttaattgaatatctgaaatatgctgtgggttttggagtaaaagtgtgcaagtgcctcctaactctcacagttgtcctgggaaacccacctggcacttggctcagtgccatgctccccatctaaacttaccatggttgaatgccagtgtgactaaagttgaccaaggtagatggtaacgattgtcttaagcttcattgaaaggagatcggaagtttctttttcaccaaaaatatttcttttgacatagaagtttaaaacatttctttaaggaacatctgcttttattagatgtacatttaagaaatccttctcagtatagagataaaaagatgaataagacattgtacctgccctcagatggctcatagtccaagaacactgttcaattgtgaagtttgtgcacaaggtgggcacaggtcaagtagcaaatgaaggttaacatccagcccacatgctgcccaccaaggagtccaccctggtttgggactgaatctgccctgagtaaggttaccagatttagcagataggaatataggatacttagttaaatttaaatttcagaaaaacatcacataattttttagcatcagcatatcccatattttggtcagacttatactcaggtatttctctagcaaccctaacgctgaacaagaggaagagggtgccttttagctcatacgaggtgctggggcttggggaaggaagcaagggtggccgcactcacccagatgattgcttttttctaatttgttcacctagggtgtgtgtgcgtgtgtgtgtgtgtgtgtgtgtgtgtgtgttttctgatccatgcagaagctaactggtgtccctgtcacaatccagggtgggagaaagatgtgaaaacatgatgcatagagttaggttttatatgttacgtggttccagtggaacataaaggaaagtgtggtccattttacctgagaagatgtgcaaatcattcacaaatagtagtttcggatcctggtcttgaaagatgagtaaaagggagatttagtcagggccattgtgccatgctaaggaattcaagcgctgcagcaatggagagagaaggtgaaggatttatgtatgctaaaattagcatattattattattattattattattagagataggatcttgctgtgttgcccagggtggagtgcagtgacgcagtctcaatcactgcagcctttacctcctgggctcaattgatcctcccgcctcagcccctggagtagctgggacaacaggtgcacaccaccacacctgactaatctttatattttttgtatagacagggttttgccatgttacccaggctggtctcaaactcctgggctcaagcagtccacccacctcagcttcccagagtgctgggattacaggtgtgagccattacacccagcctaaatttttttaattaacgtacaatatgatacttgagaatttgaggatatgttctgtgtacttatcttaggcttcatatggcatagtttcactggagggaagaatagaaattcataagaaattataggcttcattttttctaagtgactgaagcttaacctctttaaatatcaattattatactttagccttttttaagaggaaaaaaattgctacatacattcttagtgtctgaagcaaagtataataaactctatgttaatgaataaggaccatcataacaaaccataattgatgggtcagtattttcatgggtgggactcagcaggaactgttggaatatacaggattccgtcctggtgcctgttaggtagatacggtgtgccctgtttgttgagttttttgtaccttttctttttttagtggttttgctatcagctgttacttgcagaatccaagtgagttgtgtcagctggcctgcctctgatgactcctttttccagtgtgctgctttcatctgctataaattaaggcaggcaaccaccaggattcatgagctgttcatacagtaagagaactaaactgtggttgggcgcagtggcttacgcctataatcccagcactttgggaggccaaggcaggaggatcacttgagtccaggacttctagaccagcctgggcaatatggcaaaaccccatctctactaaaaatacaaaaaagtccaggcacggtggctcacacccgtaatcccagcactttgggaggccaaggcaggaggatcgcttgagtccaggacttctagaccagcctgggcaatatggcaaaaccccatctctactaaaaatacaaaaaagtccaggcacggtggctcacacccgtaatcccagcactttgggaggccaaggtaggtggatcattcaaggtcaggagttcgagaccagcctggccagtatggtgaaacccccgcctctactaaaaatacaaaaattagccaggcatggtgacaggcgtctgtagtcccagctactcaggaggctgaggcaggagaatcgcttgaacccaggaggtggaggttgcagcgagccgagatcgcgccactgcactccagcctgggcaacagagcgagactctgtctcaaaaaaaaaaaaaaaaaaaaaaagccaagcatggtggtgcacacctgtaattccagctactcgggaggctgaagtgggagaatcacctgagcccaggaggtcgaggctgcagtgagtggagatcatgcaactgcactccagcctgggcaaccagagtgagaccttgtctcgaaaaaaacacaaaaacataaaactgggctgcagtgagagctggagaggccttccagagagcaaggccccattttgactcctgtgggccccttcctctactaaaaaaaaaaataaattttccacctgttggtacaaagctgaatatattactatattaatattttcttccaccaaaaagttctttttttctgatttttttttttccaggagtgcagtggcgcgatctcaactcactgcaacctctgcctcccgggttcaagcaattctcatgcctcagcctcccaagtagctgggactacaggcgcacaccaccacacccagataattttttgtatttttagcagagatgaggtttcaccatattggccagactggtctcaaactcctggcctcaagtgatccgccctcctcagcctcccaaagtgctgggattacaggcctggcctgattttaaaagaaattagaataatactttcatgggttcctcaaagtttcataggccctgggcactgtgtctagtgggtaagttgtccttgcctgtcagttttaaagttacttgaacctcacattgttttttcagtactaggagtgagaggatttttgcttatttctggttcttggctgtgctctggatagttgaaattgtttagcagattggcctccagataagtaaggcattattattggatatagtaaattcatgttctggaagtttggggcctaaaggagcaatgtgggctctgtagggttaaatgagggcagggtatggtgagaaggcaaattttgaaacattgtgaacataagagacaattgcaaattggcagaaaactggagaaagcattttaataaacaaatgctatggataaaaatcacagaggtaaaaattaaattagaaaggagaatattgacctgattagaacacaggggtcaatttagggtatatcaagctaaaagctgagataggtagggaaaatctactgtggatataagagtggggagtttggatttgctgattaatgtgtggtcatcttagttaagtttctaatgagagagcatgcacagaacccttcctttaaggtattaagaatactatggcatggtcagtacaactttatctttttctttttttttttttttggacaccaagttttgctcttgttgcctgggctggagtacaatggcacgatttcggctcactgcaacctccgcctcctgggtaagagtgattctcctacctcagccccacaagtagctgggattacaggcatgcaccaccacgtccagctaatttttgtatttttagtagagatggggttttaccatgttggccaggctggtcttgaaatcctgaccgttggtgatctgcccgtctcaatatcttcttaatttatttaaccttttctcctaagagcacagaggtcattatttctaggtaataaatctccctaactcaaattaagagatcagccattgctgatatggggcttgtgggggcaggggcaagagtggaccccaaatctagtttaaaattacacaaataaaaacagtagacagcaaagcatagtgaaaatagcaatgaggcctgaactgtagtttcagctccctcactggacatgagagcctcagacagatcactttacctctcaccccaggtttctcatctgcaaaatgagacagagaatgagggggtttgggggaatgaggtaatctttaagagctgctcccaatgtaaaatctgatgattcagtgtctttttcacaaattggaattagatatcctttaatatcatgaagtctgcttttgcctatagtattttaaattattaagggttcagtttctcgtttcatattcagtctgtatcatgaattcccccccttattgtcttctgtcctgcttgcagcaccatgaggatggttacaaagaagtagactaagaatttgcttcagggtaaaatctaatggagagtttaagtgtagttgcctgcctagttgtggcatgatttatttgaaacatccttcctttggtattcagcttaaacatttaactgcaaaaaaaaaagaaaagaaaaagttacaggcatttaaacaagagaaatcagaaatgcatgcaaagaggcccaattcctctcccttcacttgtctctggttgcttttaatggtagtcgatcttttcccttggtttggggaaaccaagagttgtaggagatgttaatagtacttggtttttgtttttgttgttgttgttgttttgagatgttttgctcttgttgcccaggctggagtgcagtggcgccatctcggctcactgcaacctccgcctcccaggttcaagcgttctcctgcctcagcctccttagtagctgggattacaggcatgtgccaccacgcctggctaatttagtagagacagcatttcaccatgttggtcaggctagtctccaactcctgacctcgtgatccacccgcctcggcctcccaaagtgttgagattataggtgtgagccactgcactggccaatagtacttgttatctcactagcttaggttaatgacagctaatgaatcttatctttcctctgctagagaagtctgtgttatccagtcaatagctaatcaattgattaaaagagataagccagactttggcacgaagcatacatgccgttcattctagattattttctttaaaatttgttgctatcaacacttggggctcagaggtgtagactctgaaatgatagttactttccttttggacacttaatataatgtgcatttttctaggaccagaaagtaataatgaaggagtgatctgctacccttgaaagctatactgggattatcattcattcagtgcatatttattaactttgtactttgtacaaggcagtatgctagccctggaaacatcagtaaagccaaaccgacttaagtcctgtcctgatgaaggagaactagcaagaaatacagtaaatatagtaagtatatagtatgtaaaaggcgatccaaactggaggagggaaagggcaggataagggttggggagttgcagttttaaatggaggtatgtggggattgagttggcctgtggaaaagctgacattcaggcaggtccttgacttggagggaaaggcctgtgtggctatggaagggaagagcattccaggcagaggaatcctctctgtgtgccaggcatgccatgctgagtactgcaagggcgcagatggatgatacgtggtttctaccatcggggagttgacaggctagaaacaagattcaggcttgaagataaatgcagagaagcactatggcaaggtagaatttttctaagggtctctgttgaataatacaagctaagaaaatatgaaaaattattcctatttcaagaatgaagccaggttaagtgatagaccaaaggacctctaccaggaaagcttcttactcttggctctgagccaatttcctcctcagaagttgctgcctctccctgaggccccacgctgccatgagtccttctgactccctgtgagtcaccccactgccatgactccttcggagggggtgtctgacctcttgcttcaggcctcttctgggcctcacagtaacccttgtgaagctgaagatgggagctctcatcttccctaacccagagccaaccttggcctctctgcgtcatttgctgccagtgccctgtgtttgtttttgggaagagagggattttcaggcatcccgtccctcacccacctgacctaaccgtatggattcctgacaccacaggcagaggactattcttcaggttcctctgaagcccacctgttcagatgcttgcttcttttccttcttgcctgttctgactgtgatgacagagaccccgcctcaggaatctccacctcacactctattctcataagtaggtagaattttctcatcgcatatttatggttgaggaggagatagatgctgagaagttaaataatctaccccaaatcacacagctgtgagtgatggggcctctacttctgttgcaccaagctacctgtccatcaggggacttgcctcaccattgctttctgccagccctgggcttgccttaaaaaggacatcatatgcataagacactggttaaaaggtgcagcatggtccctggagatgctcactcttacaactggcctgtccttggggcagcagctcctcacaggcccctaagaggtagacctcctgcctgtggctgccagaaccctcttctccatcacaggtcttcctcctcaagagccttctctggtttcctgttgctttttatattaaatatttcccttagtttagcatcccgagtctgccttttgctgattgttccctccctgtgtctgcagacaacttcgttttcagccttggtgctctgtctcagctgcttctaccacacacataggatttaggcgcattcaggacctgtcccttcttttcaagggccttgccagtgcctacttgttgtcattgtctttgcagtactacggataaccttcctagataacccccctccaggaaactgtccccataaaccgggtgccctccgccatgattagtttgtatttgcgagtgtgttacttggttgtgttccctgaatatttatttggttttcccagctaagttgtaacttatttgaaggcacaaaccaaatctcataattctattaagtacctaaaaggagtaaattattgttaatgctccaattggctaatgtctatttcatattttacttaccagatttacaaatgcttaatattctgaaatatttcactctcatttacaaaaacatcagattctactaagcagaaaataaagtttaatgcccccagcacatagcagttttgagttgcacttttaaactcacttcttaatccatttcagggttttcaattgttcacagttaattcttcttaccaagggtgtattacacttgctcagcattgaatgatatggaaagaatggcctttctttcctgcataactgactttacttttgttcataggttgaaatcagcccttccatttcactgcagtattatattagtggcatttttatttagggaaaaaaaaaagctttcttccacttgaacttttgttacaaatcagtttattgggtccaatcaatgggcaagacctatgaaagggtgtggattatctggttggtcctttgtgtggcaaaaggcttagatgctgcttagtactcgctcattcttcatcatgtaaagaagtgttttttttgaaggatcaacacctgactgagccctgcctttttcatggaaatgttttcacctgagttgctgcttatggtactaagaattagttaactaatacttatttaaccttggaacaatgtttatcataatccgattggcagatagtcattttacttaggctttttctttatagcatcaggactagcaaatctcagtaaagagtatgctgggagcaatttcttttttcccaaataggttatcactctgtgctttttttttgctttccgtcaaggggcatgtttgggcactgtggacattaagactggtggccacacattaggaaggtggaggtcccctcttgggttgagcaccacttttgtttttaaagctgcatccccatttcatgctgctggcagtgtttcccttcagacgaatcccatgcaatgtatcactttaatatattcggagctgtttttcatgataaagcttccttatgagcactaccactaattaatacacaaaatggcccagcacaatttaataatttggtaatgtttttcaatgttttcttaaagatgacgctttacaagtcaagacccaaacttgcctgggtcatgacctctttgcagtttttggagtcttgttaaacaagaaggaaagcaaaacataaattagcgtctccagtatggttgctctacatttcccaatctttcaacactttgaagagcatagtcactgttaatgtaagagaacatctcatgaggaaactggcagcgattttaaaagtccggctttctggaatgagtaagaagcttcttcctcagtgccactgttctagggccaacattgtcctttgtgagagaggagcaagatgaggaagtttgcattatggactatggaacattaaaaagctaaaaaagagaagtaacagttacctttaatcatactgaggatgtatcagcatgtgtggcctttggcatctgttagcctttagggctatgttcccaagtttgccattagaatttagtgttaaaaaatactttaaatataacagcaccactttttgttatagtaaaaatgtatgtctttactcgattgtaattacctcaacacccagcttttgttgttattttgcccttggacttaggtatttctgttcctctggcttagaatgtccttccccttcatcttcctaatcaacctactcattccttacgactcaactcatgtatcatctcctccagaaaaagctttctctgccacgtgtttcttccctctacctgacatccttgtgcgtaatacctccacctttccatattgtactataattatctattttgcatctgtctttctgtggaaggtctgttgcatattcatctaggaacttggtaaatgtctgatgataagcatttgattttttcctagttgattcctcaaataataataatgattaccctttaatctgaatgctcacaggtgtacttctatctcatattctatgcgcagtcatctgttaagctaatggctaattgtaccagagggtctcaactttgtttctttgatctgcattggtttatggtggtaccttgcccattcttggcacagcaggtggataaaaacaatgagtaacattgagaaaggctaatgtgtcttattgacagtagtggtataatgtttaccaaacccaaattgaaattattttggtttcttaaaatcttttcccgatagcccatttattttaatgttctgaatttccaagatctgtgtataggttcaatgattagtctttactgaagacttatctatggactgagtgtgtattataaatctagtgacataagtttaaaacttattcctttttcattttccaagtaaacttttttagtaatgtgtttttctttgtaaagacaggcagtatatgatttaggtctggatctggtttccagtcttggctccatcatgtattggttatttggccttgaacacaaatgacttgccttgaacacaaatgacttatatctgtgagattcaatagcttcatcagtaaaatggggatagtagtagtactgaattttcatgattataatgaaaattaattgagagactgatctggagaggtgccatactacaaagaggattaagtggaggtgtccctattaaatggcgagatacccagaaacattaccctgttgactccagtatgctggcaacgaggctttatagtctttgggaaggagactggaagattcttctctgggaaaaatgtacacatactgacctttgaaggacccccagtaatcagccaggtcttacctgatcatcctatagtgaagccccccgacacagtatttccattcatagtttagctcttaaatgtgaattagctatccagcaatcaccagacacttgaggaaagcctccagaaaacaaattggaaaaaggggcaagtcataggaaacagacaaaacaaggaacagaagaaaacatcatttttgcaatctataatattcacaagtttgttttttgagacagagtctcactttgtcacccaggcaggagtgcagtggtgccatctcggctcactccagcctcaaactccttggctcaagcgatctgctcacctcaggctcccaggtacctgggacgacaggcatttgccaccacacccggctaattttggtatttttgttgagatgaggtttcgccatgttacctagacaagtctcaaactcctgggctcaagtgatctgtccatctcagcctcccaaagtgctgggattacaggtgtgagccaccggcctcagagatctaaaacaagatattgtattttaattgcacaggatgcaattaaaaaagaaaacattcagaaaacaagaagagctcttagaactgaaaaataagttagtgtaaaggttggaagataaaattgatactaacctgaaaagtattagaaagagaaagaaataaaaactaagagtaaataagaaaattagaagattagtcctagagaatcagtatccaactaagaggttcccagtgggtgatacagagaaaatgaatgggaggaaatctcaaggaaatgtatttcctagaactgaatgattggaatttccagtttagaaagaaggaatctagtgccagcaaaatgagtatagaaagaaccatcttaggatatgtagttttcaaattgcagaacataggaatgaagaaaagattctgaaagttttgtattaaaaaggttagaaacaaaagatcaaagatcagatagcatttgtcttttagccttcagtgccttcaaaattgtgagaaaaaaattatttctaacctttttatttatttatttatttttttgagatggagtttcgctcttgttgcccaggctggagtgcaatggcgtgatcttggctcggctcactgcaacttctgactcttgggttcaagcattctcctacctcaacctcccaagtagctgggattacaggcacgtgtcaccatgcccagctaattttgtatttttagtagagatggggtttcgccatgttggtcaggctggtctcaaactcctgaacctcaggtgatccacctgcctcggcctcccacagcactggaattataggcatgagccaccacacctggcctctaaccttattttttacaactagccaaactattaagacaaaggatacaatagtaaggctagaataaaggtatttccagacatgcaaggtctttaaaattttacctccctcactctttctgaggaagcttttgggtacatgcagcatagacaggggaatagatgaggaaaaggaaggctgggatacagggaatctaacagaagagagaggaaagctccagaactacagctgtgccccaggcctagagagtcaccgcttcagattgaactgtgaacacacaggactcctggaggggaatttcttcaagaacacaactttaaactatgtaatgtgtttgaacatactgaaaggagacttgtgattgttttagagacaaacttgtgataagtacctggtaaactaagcaaaggggaaaaaggcaattaactccagtaaaacaaaatgttgtccaagaaaggaaattgaatagtactctgcatggcctagctgtaaaccacatttgtataaacataataaatactgaatatagatttaactaaagactgtgaaataactgtatcggaaggatgtaaaaaggggcatgtggtgggggaaggggggtagtgcaaaattaataataaatccccatcttccatggtaggaagttagtaaatcatatttaaagctgaaaacaaaaatctaaaaccagtaatgtaacattattatttgaagataaggaagtaaatataagaagaaaagccaagagaattgaaaatggttgcctttgaagaaagggaactgagaatggtagcataagcctggcatagtttttaaactttttttaaaaaaatattttggggttaaaagtaaaaatgaaaaatattaaatgtgacaattatggaaagcactttagcccatgccttttacagttcagtgttgcataaatataaactcttattaccctgctccttctaaaaagtgtactaaagccttgtaaagccagcgccacatactttctattcatttcatcttttttccccaattcccaccatacatgtgccatgttggctctgaggaaggaattacatacatacacgtcagtatctttccatttgtttgtgtatcttcttgatttactaatccattgttttattgatgtgaatgagaaggagctgttcacatgttgccactttctgaatcatgtggttggtaccttttttcaggattttcaggaaaatcctgaattgttttcttctgttttgcctaatcatttgcatcggcaagattaaataaaagtcttttgcaaattgtgttcaagcttactgtagtttcctaattagtcttattatgtacattttaacacattttctccctatgatcagggccgcaagcttcttatcattgggaccactagccgcaaagatgtccttcaggagatggaaatgcttaacgctttcagcaccaccatccacgtgcccaacattgccacaggagagcagctgttggaagctttggaggtaaaaatgagtcaatggattgcacactgtttataagaaaggaattgaggctgaaataagtagtaccacattatacctggtgtttggtttttatgctaatctggaacatgggacccggggatattacaggttgtatataccttatccaaaatgcctgggactaggccaggcacggtggcttatgcctgtaatcccagcactttgggaggacggggcaggtggatcacttgaggtcaggagttcgagaccagcctggccaacatggtgaaaccctgtctctactaaaaatacaaaaattagctgggcatggtggtgggcacctgtagttccagctactcaggaggctgaagcaggagaatctcttgaacccaggaggcggaggttgcagtgagccaagattgtgccactgcactccagtctgggtgagggagcaaaactctaacaacaacaaaaaatgcctaggaccagaagtgtttcagatttcagattttttcagattttggaatattgcattatatttaggttgagcatctctaatctggaaatctgaaatgcttcagtgagcatttcctttgaatgtcatgttggcactcagaaagtttccaattttggagcattttagatttcagacttttggattagggatactcaacctgtacctccagttgttttcaggaattagagaagaaagatgaatatacatgacagtgagttaatttcccattcctcaatgtaggcagctacaaactgccaggaattaattgctctgtatccagcatgagtgatgtatatagattacttggaccagaaacttgaatgggtggtggtgtgggggtaaggtaatcactgtatagaaaaattaaccattcatagtggcttttagcacatttccttgcatttaataagttggaacaatgattaaagccttagaaatgtcaaaaaaaaaaaagctacagaagtaaaaggaactttattaacaagtttagaaatagaaatgttttcttaattttttgaaaatgacagtcatttttaaaaaagaacgttcttcatttaacttttaatatcaatattcacaagtaacttggtgagctctattggaaaatattatctactgagttgttcagcagtggtggagtcagtaaagcttcttaaagtcctcaaggcccccaacaaaattgaaatttatctatatgataaatgttttcaggttacccatgtagacagcttttgtgcagaagctgggtaagagaattaaaggagtttgctttgacacatacagattgttcctagaaaagaatgttaaaaattttaacttatatttattatggattggagctatttttttccccagaaaatataagttacatagcggtccataagaaaacagggtttaagataccagttttcactttcatgattgcacctaatgggtttaggatggtgaaggtcagactggattttaaagtaggagagaattctatcaacttgaacagttaggtagttcttatcactcttcttttaaaggtaaatagaattaaccaatgttgatgtgttcactgtaaaagtgctttgattattgtttattgtttttgtagcttttgggcaacttcaaggataaggaacgcaccacaattgcacagcaagtcaaagggaagaaggtctggataggaatcaagaagttactaatgctgatcgagatgtccctacaggtaaggtacttcgttctccgtatgactcagacagaacaaagcttcaggacacaccaagagggttcagtatttcctttgccaaggttttaattaatttaagttttgattttcttatattatttccaaacttaatttggtattagtagcctgcttctgagattgatcacttaacaatactttttaacttcttaaaattcaaaaatggaaggaaagattataaagttagttttcatttagggagccactaggtcttagaactagaaaagacttcaaagagcagtcgttcttctgccccctcattttggagatgaggatactatgtgagccacaggctgtcagtgaattatccaagatcacatcaccaggttattgatggagaagggatggtgttgcacctcaagtcagtaagcgactgcacatataccaaacggtgtctgggagactgctttaagggacaagttaattaagttgtgcagtctagacttgggatctgtatatttgtccctggctgggctcctagaaatttcatgcaaactactgtagggttgaagcatccagaatcacatagaaaactgagccccagggtgctgcctgggcaaagacagatgaaacttctttgggactttctcatatctcctggcaacttacctttcttcattttagaactccacccttccatgtgcccatgctgtgtcttcttgtccttatctgacatactaggtagctgataaatacctccctatcaagccctatgagttcagagaccttggctcttactattgagtccacagcccctggaacagagccaacacatatgaaggtgctcagtaaacttttattattattattattattttgagacagggtctcgctctgtctcccaggccggaatgcagtgccatgatcatggcttactgcagttttgacctcgcaggctcaggcgttcctcccgtctcagcctcccaagtagctgggactaccagcgtgtgctaccacactcaactaatttttgtattttttgtagaaacatggtttcactatgttgcccaggctggtcttgaactcccgagctcaagtaatccgtctgcctcagcctcccagagtgctgggattacaggcatgcaccactatgcctggccctcggtaactttttttctttttttttcttttgagacggagtctcgctctgttgcccaggcttgagtagtggcatgatctcggctcactgcagcttccacctcccgggttcaagggattctcctgcctcggcctcctgagtagctgggattacaggcgcccacccaccatgcctggctaattttttgtatttttagtagagatggggtttcaccatgttggccaagctggtctcgatctactgacctcaggtgatctgcccgcctcggcctcccaaaatgttgggattacaggtgtgagccactgcgcccggccagtaaacttctgttggatgaataactgtaaattcattttacagttaggtaaatggacagagtggctgtattctaggcatcatgtgttactaggtgttactaggtccatctaggtggacagagtggctgtattctaggcatcatgtgttacttactgatggtcctgcattctgctagtgtgggcagtgagcggcagaggtgaagtttctgtttcacagttacatctgaaataggctcttggaccaataacaaattggaaacgtgaagtgaatgctttttaatcttttctggtaaatttatctgaaaataaaatttttttgactttcagaaatctaatttaatctactgagctttcagatggactatttttaagtcaattaatttattttccattatgagccataaattaaagtcacagactaaccactttgtttagacttattcttggtaaaagtgcaaatacaggtgtattggctctttccttgaaaaaaagataaatctgtcagattgtcagcttctttttttttaagtttcagtataattttttttcaataattgcatagaagaaactatgtggattttttccccaaccctcatccctttcccttcctttgatgcctgcaggtcagtgatcaagttaatgcttcttatgcatgtgggatagagagtgagagtggggcactcaggcctgatcttcagcgactgacatttcataggcctctgagtttgaaccccttcatgtcaaatggatttcgtgcagctgagtgaattctctttagatctgccttagagaggctgaacctaagtgaagaggcatgtagttttgcagaatataagtcgtggtacctctctgttcactacatgctattctgttaaaacttgcacagagctgaggatctgctctgactggatgtcacctgagggaataaagtcatttatctagattacttttttcctccctttctcctgacttttaattccatagctacaggcaagtcagtaagttgttgctcacacatattaaatatatttaatgggcaaagaactgcaagtaccaactacaactgcgctccagccagttcttttttttttttttttttttaagaacttgacaattgattcatatgtaattctattcccaaaaaggaaaaatgtttcttttgttagctattcacactttttcttagtcctttgtagtctgacctcttacctttgatacatttgaaacttctgttcagtgtttttctgggatagaagaaatcttaaaaaaaaaagaaagaaaagaaaaaaaaatccgtggttggagtgggagtccaattgcacatctccccacagctgcactgagcatttgaaagttattcctggagggcagggagttccctcttgggaaacagactcctgctctgaaacatattttaaaagttaggtgtgtttcttacaataaaaattcatcttcaggaactaaagatgtttttaacgattgttttctagataacttcatatctcctgtgggcctacgagaataaagtacatttaacgagttagtataaatatgaatagaaaatgaaaaccagtcgagatagctaataataacgacctgaacgaagcacctgaaacaaagttgcgccatcttttcttagactcatgacacattcgcagtcacaggagacccagattcatctggagatgatttcaggaatcagcagtactcttcatttttttagttttagcacaactttgttactacaaagaagaaactatatgacggatactgaggctaagaaaagctacatggttggttatgtagagttaataagctattttttagttgttgaattaacctcaacttggtatcttctactttgctgtgactttagtagccttttacaccttcaacaggtgaattggttgtcatttgaactctgatgaatggccctgtccagtctcacagcgatgcctcacaggcatcagcacagggcacgcctggcccaagtgcctatgatggccagcgggcttgggtcttttggaacccagtgtacatagttctggaaaaccccattcacttcctccaaatgatgtgatctgctttgttttgtgtgagaatgctggtcaaggagcaggtaacacattcagtgacctagcagagcattgatgaagtgtgaaaccgaacactgccttctcatgaagcaagtgcagagttgttagaaggtaccattaacccatcttcatttcttctgatgtatttagatggatcctgaataccgtgtgagaaaattcttggccctcttaagagaagaaggagcgtaagtacatacaacatttaatgaccatcaaccaaacttaccaccctgttaaatccctgtgcctattctaagagttgctttcctagataagtttgtttccatttatttgaattcttcgctgtgttgtaggtccgagagaccaagcaaggaagttggttgtactgttggtttgctctccctgtcctgcttcgcaaaacttccttgtcacaatgcaggaaaaacttaatggtacatatttattggaacctgcttttacatgcatggagctgtgaccattttcttttgtgaagtgctcatctaatagcaaatgcatagtgggaaatgtaggataaccattaagaagcttttagtgattttttttttttttttttgatgaatagttttttacggaccctcatctgtttttttgtgttttggtatttcttttgcagtagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcaccatcacccttgaaaactctcagtcagtgtcatgaatgttgcatgacaacagttggccgattagaaggcagactttctacatgcaaatctggcttagtaaatcgaggtgtgggccagagatcctctgacagctgtcctgagctaacactaaaagtcactgggtatttggttaaaggtctcccacaagactggtattctctttgcctgaagaaacaaggcattgaatctctaaaatgctgttctcaatcattgtcagagatgttttcaagttgcagtcagaagatctttcttaatagaaagtcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccaatacattgaacacatttcctttaccctccacacacttcttccaaaaggaagcacccgttgagtccttttgagggtgatttgtcttacaactgactgacttagcaggaatttaattaggtcatatttggtgatgagacttatggagtgtgcctctctctcccaactgctgcttaaaatgcaaggacaagcaattagaagccatcctaaggtgcttacctcacacgccacccatgaggcttgtggccacagtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtggccagtatcctggattcctctaagatcttgcctctttcctcctcatgaaagcagcacacattgtgttaacttatgtctcttgttaaatgagcttaatgtctttgtgttttgtccaaaactgtattgaaaaaatattgtttaatgcaaatgaaggaatgcaataaagagtaaatatacttgaa

SEQ ID NO: 743 - DNA, 166646 bp, Homo sapiens; identical to SEQ ID NO: 742

SEQ ID NO: 744 - DNA, 62188 bp, Homo sapiens
atcatctgtccaagagatgggatggataagaagttaagcttccaggagatgcctcatcatttgtgccagtgaccccgcataatttcttgatgaattgtgcaaactgggaagctgatagctctggaaatgagaaagcaggtgttattttctgtttctgaatatccccaacaaggttgcaatgattcttttacttatcgtgttcattgttttcctacctattcaaggatataaactgtgtttcttcacagaaatttccaaggaaactatatttcttacattgatggaaatgtatggaaagcatacagttggactgagaaactgtgagtatattctctccaaatatgacaaaaagctaactgcattgtaagatccttcttggtccagaattttgaggtcggtacctctgaggaaagatatttctcctccatgccccaaatcaaccactgttgattgcaattgtatggtcattttaaaattaaatttggtaggctctctttaaaataagaggcaatttaaatttattttttatcatacaaatagtacatggttatattcctttttgttctcttttttgttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtacttagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaacattttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattatttcaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagcgattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaaggatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccaatttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataatagaatttggtgggaagaaacccactcttcaaggggtgtgcttgagtgtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctaacactagctacctcctgtgcattttcagtttttaagttatatagacaaaatacagacaaaaacatttcacatggtaagaaaatctgagcagtgactgacacccatatgaaccttgttttataagggttcacatatcattctttttctattcagtctacaaccaatagatctaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaataatattatcaagaatattaagctaccaagagaatagactggtattaaggatttcatttcaggaattgttatattaaaacagatgtttaaaatgatggttaactgatagagctagaaatgtttacactaagaagcacatcagaaatgcccctaactcttcactaattacaaaataacgatcgccccagccctgttaccagaaagggatccctgtatttctgtctgtttagagacaagaagatactatgttcattgctatgaaagcttgattcttaccctttgtccatagaggtctgtatgtcattaatccttattaagctcattagtgatgctcttttgcaaacagattctttcaaatatagaaggcttaaggaaagtgggtgtaaagaccctcaggtggatgccaaagtgctacagagaccatgaaataataaaactacatttcctttaaaatagttattttccttctactcactcccccagctattcatttattttacaaatatttgagtttgctttatttccatgtgtcagttttaaacatggtgggcaatgcagatgagcaagacctagtccatgctttcagggagtttatgctcagaagaaatgggataaaaaataactacattaagaagaagaaatggatgtgggcactaggagggataaattgtttctcgaacatagaagaggaaaaaatgccttcaatttggacccaggaggatgttactagaacaatgccatttgaataggactttgaagggccattgtgtaacatcagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactggagatggagatatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcgatctcggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaataggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctctttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagatatgctgctaaacatccttcaaggtataagacaaacccccatggcaaagagttatatagtccaaaatgttgatggcactgaagttgtgaaatcctgttctagagaaataaagatcacttaacacaggtatttactgaacattcactgttttgtatctaatgcaccacgtgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttatgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactttgtgttaagcttccttccttgcagctaaatgttgcagacatctaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccgggaggtggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcactgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagactttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttataccactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattaggtgggcatggtgacaggcaactgtaatcctaggtactcaggaggctgaggcaggagaatcacttgaaaccaggaggcggaggttgcagagagccgagatggcaccattgcactccagcctgagggacagagtgagactctgtctcaaataataataataatataataataataatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggctccgttggagtcaaatcttcctggtaaacaaagctacactgcagtcatatttggcatatgtgacatataggcccactgcatttccttccaaaggcaagatgccaagggaaggtgccagtaattttatgaccaaaatgacaccattttgtggtgtttgtaagttgaaacaatatatttccctgcattacacaagtttataaaaaacaaacaaaaaaagaggccccagctgtggttgatcgatgatgaattgaatagagcctaaccttccaggcttctcacttgcacaggcccttccaaggtcctgggagggcccctggaaatttttgtagtcataatttttttaatgtttttactagataaggctcaggccccacaaaatcctgaaatcatccctgggttccaatagttacaacccagtaaatctcttgaatgaagcctctatgttattgacaaatactgactggccaagttagcagggttaaaaggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatattagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcatcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacatggctaataagtggcagaaccacttacaagctttgcaaataattttcaatgcagctcttagttcccctgtaataggagctgaatgatgacaatttggctttgtgtgcattgtgtcttactttctaacttgaataggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatagtgggtgagggtctaggtcatctgcttatttctttgactaccttcttccatggaaccagttttccctgacagccttgggattctagcatagatcattttggagtttgtcatttaaatttattttcacggcctgctttggacattttttcagctagagctgttaggatttcagtacatttaagacagtgatgacatgctccagtcctttcatctctgtctcctcagttaatagaaaggaaacatagctcatctatctggacctgtacagaagaatttggagggaaaaaaaaaaacaggcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcgaggctgggcgcgctggctcatgcctgtaatcccagcaatttaggaggccaagacaggcagatcgcttgagcccctggagttcaagttcagcctgggcaacaaagtgagaccccaatctctacaaaaagacttttaaaaagtggaaacataaatataaataaataaaaacattcatatcatttggtttgtggaaaagagttgctgtagagtcctcaaacttgagccgttgagccagttctcactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctctccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaagaggagggggatcacaaggcaggacaagctgtgtggctcccagcctcgccactgactcactctgatcttggtcaagggagagtgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatataacttctttgaagaaatatttattcacatcctctgcccatttaaaaaattgatttgtctttttattgaattataggaatttctttatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattgcactcaagcctgggcaacagagtgagactccaatggagacggggtttcagcacgtttatccgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcgtaagaaatactggtctgtaattttttgtgtgtgatgtctttagtttggataccaggttaatatcaccctcatagaataagttaggaaatgttctctcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctatttatgtctctaagaacaatagtaatgtcccctctcatttctagttttaataatttggtcttctgtatttttgcagtgcagtggctcatacctgtcatcctagcactttgggaggctgcggtgggaggattgcttgaccccaggagttcaaggccagccagggcaacatactgagagcttatctctacaaaaaaaatttaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatctttttcccacatttcccccttttctattcaacaaaaccgccattgtcatcatggcccgttctcaatgagctgttgggtacacctcccagatggggtggcggccgggcagaggcgctcctcacatcccagacgggcatgcccagttagttttaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagacaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctggtttttgccaaggggctctgtgtacatgttggggcataccttcagcactcagctagacaatttacagccatgccttagctttcacttcttgcttgtgcagaacctcaaggtgtcagccagggatgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaatttttcttgaataaatgctccttgggttgctgcaagactttggttacatttctagagttctgaaaaagtttattgtggtcaattttttttttttttttttttttttttttttttttgctattttttttggtatttgttgcttttatgaagggatgaatttttggatgtctcttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcgctttgttagccaggatggtctcgatcccctgacctcgtgatccgcctgcctcagcctcccaaagtgctaggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgttctccagcctgggcaacacagtgagtgagaatgtgtctcttaaaaaaaaaaaaaaagtctcattgaccatagactaataaactatttaatcatgggaaatgattaggggaaagacataaaaagagaaactgtaatccacttttttttgctctgttgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcagtgtaataattattatttttataatttctgcctaagtacaaagataattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaagttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattctattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaggtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaattttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagtagaattttttttgagattatgctaccatccatgttgttgcacctatcactacagctggccctccatatctgcaggttcctcatccatagattcaacgaaccatggatggagaatatttggaaaaaataaaatatataaaacaacaatacaacaataaaaacagtagaaaatttaaaatacagtataattatgtacataccatttacactgtattaggtacttagagtatacctgaggctgtatacaaacattatgtcatttcataaaaaagacctcagcatctgtggactttggtaactgcagggggtcctggagccaatcccctgcagacaccgagggacaactgttcactcctttttattgctgagtagtattccggttgtgtggaaatgccatctctactaaaaatgcacaaattaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagtcaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatatatatatataaatcagccaggtgtggtggcacacgcctgtagtcccagctactagggaacctgagtcaggaggatcacttgaacccaggaagtggaggttgcagtgagccaagatggcaccactgcactccagcttgggtgacagagcaagaccctgtctaaaatatatatatatttatatatatgtacgtgtatatatgtatatgtatgcctgcagggccctattgtgagtttgttacacaatttactgcaacttcaattgtgccaccagcccccacaatatggcaagctaaatagagactcagttatgctagggctggttgagggaattttgcaagattagcatggaaagggcccttcatttagcactctgctccgttcatttttgtcaggtcactttcttatcttcaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaactgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagacttgtcagtatactttaaaacaatcctgggaacagttctagattgaaggagactaaagaatcatgtactaagtgtaatgtctgatgtttgattggattctgaattttttaagccatgttatgattaggacaattgtgaaaatgtgtatacggaccgcatagtagacaatgataatatgaagttccattgagtgatgatagtcctctggttatgtcggagaatgccttggttcttaggggctgcacactgaagtcttcaatggtgaagggtcattatgtctgcaactgactctcaaatggttttgtccagaaaatgtatagacatacacacacggaaagcaaatgtggcaaagtattagcaactactgattccagatgaaagttatacaggtgttcattataccatttgaaaatgtttcccagccattctaaggcttaaaggaaaaaaagaaaatgtttaaaataaaaagttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggaccccaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatcttccatgacattggcattttttaagagtcaaagatagctgtcttgtaaattgtcccacaatccggatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttattgcagtgtatatttcaggatttttaaaggatcctcgctttcagatctctgtgaattgaaaccaagtgaatcccactagactattttaagaagtcgatataatagcaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcatcctccagtgtgtaaggcattgtctaaataggtccagttaaagcactacagagtagccatcttttacaaaaatttttggccacatttttaagttcactggtgaggaggaacgtctcatactctagccctcctgagcctataccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgctaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctggtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtacatgagacttataatgaataaaaggaatcaatacagatttggagatggtggttgttgtcatagataatcttaattgcgttttcttctaaaacagatatgttgtcaccgaaggtcattacaagaagatgaagaaggattctcaaggtaaatattagtctggtgattttttttttcttctcttttgagatggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagggcacttgtctccttcaaggctgatggaaggtaggatatgtgagtccttcctcttaagtggcaggaaacagtattttctcttttatttctttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaagaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtcagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatctgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacattaaaaaggcaagagaagccctaagcagagtgagcaccagactccacaggttaagggctcagtcacacagaaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaaggaaagtttaaaaaggaaaaaacacctaggagaaaagaaaaatgataaattaacaaaggacaatgctcttagcaccgccatcattcaggaatttccaagggttttaggagctttgtgttaggaactggggtcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaaggtatccacagggaaattcaggagttttgtttgtttttttttctttttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaatttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagcctagaaaaagggacctcttttattctttttttttttttttccagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggccccgcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatgcagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaattctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaacttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaaaaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcaccataataaagtaatcaaccaaatccagaatgtggaataagcagttaaaaaaaaaaaaaaagggggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatatgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatcttcaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaggccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaagagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctatagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcaatggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaactctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgg

SEQ ID NO: 745 - DNA, 42646 bp, Homo sapiens
cagaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcaatgatgatgctctaagtcgttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttaccatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagtcaggcatggtggtgggtgcctggagtcccagctactcgggaggctgaggcaggagaatggcgtgaacctgggaggcagagcttgcagtgagccgagattgcaccactgcactccagcctgggcgacagagcaagactccatctcaaaaaaaaaaaaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagctataatttgttaaatagaagaaaaatgggagtacagtctaggcaaacgcatggctacaggtatggttggaatttagtagaccaatgtggctacaaagaattaggtgagggagcaatgaagatacgattctgtaaaaccttgattatcagctataggagtttgaaagttacacagtgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaagtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccagtgaccccgcataatttcttgatgaattgtgcaaactgggaagctgatagctctggaaatgagaaagcaggtgttattttctgtttctgaatatccccaacaaggttgcaatgattcttttacttatcgtgttcattgttttcctacctattcaaggatataaactgtgtttcttcacagaaatttccaaggaaactatatttcttacattgatggaaatgtatggaaagcatacagttggactgagaaactgtgagtatattctctccaaatatgacaaaaagctaactgcattgtaagatccttcttggtccagaattttgaggtcggtacctctgaggaaagatatttctcctccatgccccaaatcaaccactgttgattgcaattgtatggtcattttaaaattaaatttggtaggctctctttaaaataagaggcaatttaaatttattttttatcatacaaatagtacatggttatattcctttttgttctcttttttgttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtacttagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaacattttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattatttcaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagcgattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaaggatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccaatttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataatagaatttggtgggaagaaacccactcttcaaggggtgtgcttgagtgtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctaacactagctacctcctgtgcattttcagtttttaagttatatagacaaaatacagacaaaaacatttcacatggtaagaaaatctgagcagtgactgacacccatatgaaccttgttttataagggttcacatatcattctttttctattcagtctacaaccaatagatctaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaataatattatcaagaatattaagctaccaagagaatagactggtattaaggatttcatttcaggaattgttatattaaaacagatgtttaaaatgatggttaactgatagagctagaaatgtttacactaagaagcacatcagaaatgcccctaactcttcactaattacaaaataacgatcgccccagccctgttaccagaaagggatccctgtatttctgtctgtttagagacaagaagatactatgttcattgctatgaaagcttgattcttaccctttgtccatagaggtctgtatgtcattaatccttattaagctcattagtgatgctcttttgcaaacagattctttcaaatatagaaggcttaaggaaagtgggtgtaaagaccctcaggtggatgccaaagtgctacagagaccatgaaataataaaactacatttcctttaaaatagttattttccttctactcactcccccagctattcatttattttacaaatatttgagtttgctttatttccatgtgtcagttttaaacatggtgggcaatgcagatgagcaagacctagtccatgctttcagggagtttatgctcagaagaaatgggataaaaaataactacattaagaagaagaaatggatgtgggcactaggagggataaattgtttctcgaacatagaagaggaaaaaatgccttcaatttggacccaggaggatgttactagaacaatgccatttgaataggactttgaagggccattgtgtaacatcagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactggagatggagatatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcgatctcggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaataggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctctttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagatatgctgctaaacatccttcaaggtataagacaaacccccatggcaaagagttatatagtccaaaatgttgatggcactgaagttgtgaaatcctgttctagagaaataaagatcacttaacacaggtatttactgaacattcactgttttgtatctaatgcaccacgtgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttatgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactttgtgttaagcttccttccttgcagctaaatgttgcagacatctaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccgggaggtggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcactgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagactttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttataccactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattaggtgggcatggtgacaggcaactgtaatcctaggtactcaggaggctgaggcaggagaatcacttgaaaccaggaggcggaggttgcagagagccgagatggcaccattgcactccagcctgagggacagagtgagactctgtctcaaataataataataatataataataataatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggctccgttggagtcaaatcttcctggtaaacaaagctacactgcagtcatatttggcatatgtgacatataggcccactgcatttccttccaaaggcaagatgccaagggaaggtgccagtaattttatgaccaaaatgacaccattttgtggtgtttgtaagttgaaacaatatatttccctgcattacacaagtttataaaaaacaaacaaaaaaagaggccccagctgtggttgatcgatgatgaattgaatagagcctaaccttccaggcttctcacttgcacaggcccttccaaggtcctgggagggcccctggaaatttttgtagtcataatttttttaatgtttttactagataaggctcaggccccacaaaatcctgaaatcatccctgggttccaatagttacaacccagtaaatctcttgaatgaagcctctatgttattgacaaatactgactggccaagttagcagggttaaaaggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatattagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcatcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacatggctaataagtggcagaaccacttacaagctttgcaaataattttcaatgcagctcttagttcccctgtaataggagctgaatgatgacaatttggctttgtgtgcattgtgtcttactttctaacttgaataggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatagtgggtgagggtctaggtcatctgcttatttctttgactaccttcttccatggaaccagttttccctgacagccttgggattctagcatagatcattttggagtttgtcatttaaatttattttcacggcctgctttggacattttttcagctagagctgttaggatttcagtacatttaagacagtgatgacatgctccagtcctttcatctctgtctcctcagttaatagaaaggaaacatagctcatctatctggacctgtacagaagaatttggagggaaaaaaaaaaacaggcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcgaggctgggcgcgctggctcatgcctgtaatcccagcaatttaggaggccaagacaggcagatcgcttgagcccctggagttcaagttcagcctgggcaacaaagtgagaccccaatctctacaaaaagacttttaaaaagtggaaacataaatataaataaataaaaacattcatatcatttggtttgtggaaaagagttgctgtagagtcctcaaacttgagccgttgagccagttctcactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctctccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaagaggagggggatcacaaggcaggacaagctgtgtggctcccagcctcgccactgactcactctgatcttggtcaagggagagtgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatataacttctttgaagaaatatttattcacatcctctgcccatttaaaaaattgatttgtctttttattgaattataggaatttctttatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattgcactcaagcctgggcaacagagtgagactccaatggagacggggtttcagcacgtttatccgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcgtaagaaatactggtctgtaattttttgtgtgtgatgtctttagtttggataccaggttaatatcaccctcatagaataagttaggaaatgttctctcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctatttatgtctctaagaacaatagtaatgtcccctctcatttctagttttaataatttggtcttctgtatttttgcagtgcagtggctcatacctgtcatcctagcactttgggaggctgcggtgggaggattgcttgaccccaggagttcaaggccagccagggcaacatactgagagcttatctctacaaaaaaaatttaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatctttttcccacatttcccccttttctattcaacaaaaccgccattgtcatcatggcccgttctcaatgagctgttgggtacacctcccagatggggtggcggccgggcagaggcgctcctcacatcccagacgggcatgcccagttagttttaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagacaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctggtttttgccaaggggctctgtgtacatgttggggcataccttcagcactcagctagacaatttacagccatgccttagctttcacttcttgcttgtgcagaacctcaaggtgtcagccagggatgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaatttttcttgaataaatgctccttgggttgctgcaagactttggttacatttctagagttctgaaaaagtttattgtggtcaattttttttttttttttttttttttttttttttttgctattttttttggtatttgttgcttttatgaagggatgaatttttggatgtctcttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcgctttgttagccaggatggtctcgatcccctgacctcgtgatccgcctgcctcagcctcccaaagtgctaggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgttctccagcctgggcaacacagtgagtgagaatgtgtctcttaaaaaaaaaaaaaaagtctcattgaccatagactaataaactatttaatcatgggaaatgattaggggaaagacataaaaagagaaactgtaatccacttttttttgctctgttgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcagtgtaataattattatttttataatttctgcctaagtacaaagataattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaagttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattctattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaggtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaattttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagtagaattttttttgagattatgctaccatccatgttgttgcacctatcactacagctggccctccatatctgcaggttcctcatccatagattcaacgaaccatggatggagaatatttggaaaaaataaaatatataaaacaacaatacaacaataaaaacagtagaaaatttaaaatacagtataattatgtacataccatttacactgtattaggtacttagagtatacctgaggctgtatacaaacattatgtcatttcataaaaaagacctcagcatctgtggactttggtaactgcagggggtcctggagccaatcccctgcagacaccgagggacaactgttcactcctttttattgctgagtagtattccggttgtgtggaaatgccatctctactaaaaatgcacaaattaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagtcaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatatatatatataaatcagccaggtgtggtggcacacgcctgtagtcccagctactagggaacctgagtcaggaggatcacttgaacccaggaagtggaggttgcagtgagccaagatggcaccactgcactccagcttgggtgacagagcaagaccctgtctaaaatatatatatatttatatatatgtacgtgtatatatgtatatgtatgcctgcagggccctattgtgagtttgttacacaatttactgcaacttcaattgtgccaccagcccccacaatatggcaagctaaatagagactcagttatgctagggctggttgagggaattttgcaagattagcatggaaagggcccttcatttagcactctgctccgttcatttttgtcaggtcactttcttatcttcaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaactgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagacttgtcagtatactttaaaacaatcctgggaacagttctagattgaaggagactaaagaatcatgtactaagtgtaatgtctgatgtttgattggattctgaattttttaagccatgttatgattaggacaattgtgaaaatgtgtatacggaccgcatagtagacaatgataatatgaagttccattgagtgatgatagtcctctggttatgtcggagaatgccttggttcttaggggctgcacactgaagtcttcaatggtgaagggtcattatgtctgcaactgactctcaaatggttttgtccagaaaatgtatagacatacacacacggaaagcaaatgtggcaaagtattagcaactactgattccagatgaaagttatacaggtgttcattataccatttgaaaatgtttcccagccattctaaggcttaaaggaaaaaaagaaaatgtttaaaataaaaagttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggaccccaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatcttccatgacattggcattttttaagagtcaaagatagctgtcttgtaaattgtcccacaatccggatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttattgcagtgtatatttcaggatttttaaaggatcctcgctttcagatctctgtgaattgaaaccaagtgaatcccactagactattttaagaagtcgatataatagcaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcatcctccagtgtgtaaggcattgtctaaataggtccagttaaagcactacagagtagccatcttttacaaaaatttttggccacatttttaagttcactggtgaggaggaacgtctcatactctagccctcctgagcctataccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgctaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctggtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtacatgagacttataatgaataaaaggaatcaatacagatttggagatggtggttgttgtcatagataatcttaattgcgttttcttctaaaacagatatgttgtcaccgaaggtcattacaagaagatgaagaaggattctcaaggtaaatattagtctggtgattttttttttcttctcttttgagatggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagggcacttgtctccttcaaggctgatggaaggtaggatatgtgagtccttcctcttaagtggcaggaaacagtattttctcttttatttctttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaagaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtcagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatctgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaa

SEQ ID NO: 746 - DNA, 22356 bp, Homo sapiens
tttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaaggtatccacagggaaattcaggagttttgtttgtttttttttctttttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaatttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagcctagaaaaagggacctcttttattctttttttttttttttccagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggccccgcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatgcagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaattctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaacttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaaaaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcaccataataaagtaatcaaccaaatccagaatgtggaataagcagttaaaaaaaaaaaaaaagggggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatatgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatcttcaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaggccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaagagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctatagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcaatggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaactctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgg

SEQ ID NO: 747 - DNA, 26968 bp, Homo sapiens
caacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaagaaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaattttttttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagccttgaacacccttggatgctgctttaaatgactgatcctcgatgcctcccttctaactcacactcccctatatcaatctcccagaaaaagggacctcttttattcttttttttttttttttttttttttcagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatacagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaaattttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctctcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcactataataaagtaatcaaccaaatccagaatgtggaataagcagttaaaaaaaaaaaaaaaaagagggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatgtgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatctccaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaagccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaacagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctacagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcagtggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaattctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcaccc

SEQ ID NO: 748 - DNA, 63022 bp, Homo sapiens
atgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaggtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccggtgaccccgcataatttcttgatgaattgtgcaaactgggaagctgatagctctggaaatgagaaagcaggtgttattttctgtttctgaatatccccaacaagattgcaatgattcttttacttatcgtgttcattgttttcctacctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttatattcctttttgttctctttttttttttttttttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtactgagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaactttttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattattccaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagggattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaacgatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccagtttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataacagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctagcactagctacctcctgtgcattttcagtttttaagttgtatagacaaaatacagacaaaaacatttcacatggtaagaaaatctgagcagtgactgacacccatatgaaccttgttttataagggttcacatatcattctttttctattcagtctacaaccaatagatccaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaatattatcatcaagaatattaagctaccaagagaatagactggtattaaggatttcatttcaggaattgttatattaaaacagatgtttaaaatgatggttaactggtagagctagaaatgtttacactaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttaaagggccattgtgtaacaccagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcaatcttggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaacaggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacatgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaaaaatctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccaggagggggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagacgttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttatacaactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattagctgggcatggtggcaggcaactgtaatcctaggtactcaggaggctgaggcaggagaatcacttgaaaccaggaggcggaggttgcagtgagccgagatggcaccattgcactccagcctgagggacagagtgagactctgtctcaaataataataataatataataataataatcatcatcatcatcatcatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggcccttttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaatagagcctaaccttccaggcttctcacttgcacaggcccttccaaggtcgtgggagggcccctggaaatttttgtattcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatactagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacacggctaataagtggcagaaccacttacaagctttgcaaataattttcaatgcagctcttagttcccctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgcttatttctttgactaccttcttccatggaaccagttttccctgacagccttgggattctagcatagatcattttggagtttgtcatttaaatttattttcacagcctgctttggacattttttcagctagagctgttaggatttcagtacatttaagacagtgatgacatgctccagtcctttcatctctctctcctcagttaatagaaaggaaacatagctcatctatctggacctgtacagaagaatttggagggaaaaaaaagaacaagcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcaaggctgggcgcgctggctcatgcctgtaatcccagcactttaagaggccaagacaggcagatcgcttgagcccctggagttcaagttcagcctgggcaacaaagtgagaccccaatctctacaaaaagacttttaaaaagtggaaacataaatataaataaataaaaacactcatatcatttggtttgtggaaaagagttgctgtagagtcctcaaacttgagccgttgagccagttcccactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctttccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaaagaggagggggatcacaaggcaggacaagctgtgtggctcccagcctcgccactgactcactctgatcttggtcaagggagaatgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcacatcctctgcccatttaaaaaattgatttgtctttttattgaattataggaatttctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattacactcaagcctgggcaacagagtgagactccaatggagacggggtttcagcacgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcataagaaatactggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagttcgaggccagccagggcaacatactgagagcttatctctacaaaaaaaatgtaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgctttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatcttttccccacatttcccccttttctattcaacaaaaccaccatcgtcatcatggcccgttctcaatgagctgttgggtacacctcccagacggggtggcggccgggcagaggggctcctcacttcccagaaggggcagccgggcagaggcgcccccccacctcccggagggggcggctggccaggcgggggctggcccccacctccctcccagacagggcggctgccgggcagaggggctcctcacttctcagacggggcggctgctgggcggaggggctcctcacttctcagatggggcggctgccaggcgtaggggctcctcacttctcagacggggcggccaggcagagatgctcctcacctcccagacagggtcgcggccgggcagaggcgctcctcacatcccagacgggcatgcccagttattttcaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagagaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaaggtgtcagccaggggtgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaattttttttgaataaatgctccttgggttgctgcaagactttggttacatttctagagttctgaaaaagtttattgtggtcaatttttttttttttttttttttttttttttgctattttttttggtatttgttgcttttatgaagggatgaatttttggatgtctctttttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcactttgttagccaggatggtctcgatcccctgacctcgtgatccgcctgcctcagcctcccaaagtgctgggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaaaaaaaaaaaaaaagtctcattgaccatagactaataaactatttaatcatgggaaatgattaggggaaagacataaaaagagaaactgtaatccacttttttttgctctgtcgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaacttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaactaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagcagaattttttttgagattatgctaccatccatgttgttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccggttgtgtggaaatgccatctctactaaaaatgcacaaactaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagttaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggacccaaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaagaaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaattttttttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagccttgaacacccttggatgctgctttaaatgactgatcctcgatgcctcccttctaactcacactcccctatatcaatctcccagaaaaagggacctcttttattcttttttttttttttttttttttttcagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatacagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaaattttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctctcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcactataataaagtaatcaaccaaatccagaatgtggaataagcagttaaaaaaaaaaaaaaaaagagggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatgtgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatctccaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaagccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaacagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctacagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcagtggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaattctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcaccc

SEQ ID NO: 749 - DNA, 42940 bp, Homo sapiens
cagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctcaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagccataatttgttaaataggagaaaaatgggagtacagtctaggcaaacgcatggctacaggtatggttggaatttagtagaccaatgtggctacaaagaattaggtgagggagcaatgaagatacgattctgtaaaaccttgattatcagctacaggagtttgaaagttacacaatgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaggtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccggtgaccccgcataatttcttgatgaattgtgcaaactgggaagctgatagctctggaaatgagaaagcaggtgttattttctgtttctgaatatccccaacaagattgcaatgattcttttacttatcgtgttcattgttttcctacctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttatattcctttttgttctctttttttttttttttttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtactgagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaactttttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattattccaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagggattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaacgatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccagtttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataacagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctagcactagctacctcctgtgcattttcagtttttaagttgtatagacaaaatacagacaaaaacatttcacatggtaagaaaatctgagcagtgactgacacccatatgaaccttgttttataagggttcacatatcattctttttctattcagtctacaaccaatagatccaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaatattatcatcaagaatattaagctaccaagagaatagactggtattaaggatttcatttcaggaattgttatattaaaacagatgtttaaaatgatggttaactggtagagctagaaatgtttacactaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttaaagggccattgtgtaacaccagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcaatcttggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaacaggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacatgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaaaaatctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccaggagggggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagacgttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttatacaactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattagctgggcatggtggcaggcaactgtaatcctaggtactcaggaggctgaggcaggagaatcacttgaaaccaggaggcggaggttgcagtgagccgagatggcaccattgcactccagcctgagggacagagtgagactctgtctcaaataataataataatataataataataatcatcatcatcatcatcatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggcccttttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaatagagcctaaccttccaggcttctcacttgcacaggcccttccaaggtcgtgggagggcccctggaaatttttgtattcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatactagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacacggctaataagtggcagaaccacttacaagctttgcaaataattttcaatgcagctcttagttcccctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgcttatttctttgactaccttcttccatggaaccagttttccctgacagccttgggattctagcatagatcattttggagtttgtcatttaaatttattttcacagcctgctttggacattttttcagctagagctgttaggatttcagtacatttaagacagtgatgacatgctccagtcctttcatctctctctcctcagttaatagaaaggaaacatagctcatctatctggacctgtacagaagaatttggagggaaaaaaaagaacaagcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcaaggctgggcgcgctggctcatgcctgtaatcccagcactttaagaggccaagacaggcagatcgcttgagcccctggagttcaagttcagcctgggcaacaaagtgagaccccaatctctacaaaaagacttttaaaaagtggaaacataaatataaataaataaaaacactcatatcatttggtttgtggaaaagagttgctgtagagtcctcaaacttgagccgttgagccagttcccactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctttccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaaagaggagggggatcacaaggcaggacaagctgtgtggctcccagcctcgccactgactcactctgatcttggtcaagggagaatgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcacatcctctgcccatttaaaaaattgatttgtctttttattgaattataggaatttctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattacactcaagcctgggcaacagagtgagactccaatggagacggggtttcagcacgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcataagaaatactggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagttcgaggccagccagggcaacatactgagagcttatctctacaaaaaaaatgtaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgctttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatcttttccccacatttcccccttttctattcaacaaaaccaccatcgtcatcatggcccgttctcaatgagctgttgggtacacctcccagacggggtggcggccgggcagaggggctcctcacttcccagaaggggcagccgggcagaggcgcccccccacctcccggagggggcggctggccaggcgggggctggcccccacctccctcccagacagggcggctgccgggcagaggggctcctcacttctcagacggggcggctgctgggcggaggggctcctcacttctcagatggggcggctgccaggcgtaggggctcctcacttctcagacggggcggccaggcagagatgctcctcacctcccagacagggtcgcggccgggcagaggcgctcctcacatcccagacgggcatgcccagttattttcaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagagaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaaggtgtcagccaggggtgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaattttttttgaataaatgctccttgggttgctgcaagactttggttacatttctagagttctgaaaaagtttattgtggtcaatttttttttttttttttttttttttttttgctattttttttggtatttgttgcttttatgaagggatgaatttttggatgtctctttttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcactttgttagccaggatggtctcgatcccctgacctcgtgatccgcctgcctcagcctcccaaagtgctgggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaaaaaaaaaaaaaaagtctcattgaccatagactaataaactatttaatcatgggaaatgattaggggaaagacataaaaagagaaactgtaatccacttttttttgctctgtcgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaacttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaactaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagcagaattttttttgagattatgctaccatccatgttgttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccggttgtgtggaaatgccatctctactaaaaatgcacaaactaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagttaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggacccaaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatg

SEQ ID NO: 750 - DNA, 427207 bp, Homo sapiens
attatttaaagcacatttttattatagataggttaagtgtggtttgctgtggctaaagatatatttataatggatgaacaagcttttctagataccaagaggtataatatttttctttcagtattgaactaatatttctctgataacaaggagacattgaactggctgagcctattttaaatgggaaaagacttttttttttctggatgttgctttaaagactggtaaattaaaaattttaaagtactaacactaaatttaagtacagtgaaagaaaatcaatgaatactacaaaacatataatttctacaaagcagaaatataaaggttttataatttaaaacagcagcaatttcaaaaaatttgctgaattaaaactttacaaaatatatatacactaagtatcattccagatgatcatgaactttaaaaacagtatggcacaacccccaatctgtaccccaaacctactactagatgtagctggcctataataatttttacaacaatttaaaaaataaaacaaaaacaaagaaatctaattcttttgcgtacaagcacaggttacaatgtgctggctttgattccaaatacacaaagagaattttaaaataaaacaaggacttcacataaatagtttcacgtgttattaagtgtgtgaccaaacaaattaaaataagtactaacaaccaaaacatatcttgatgtaaccagtacatacacttttaaagaatgacaaagatgaaaaaggaaatagtctatgaaagccataagcaccttgttttcgaaagagcaccaagcaacacaaagaggcaacacgtaagaggtagtgtatcaccggctaagatgtatatgcccatcggggacctgaatacagcttagtgttttggaaaataagacatattagactgtggcttgtaatttttagacagaagcagtgcacatctggaagcattagccagtattgctccatagtgctctgcatctccagctgtctaatgggtactacgcactcagtcaaaaatataagataccctgaagaattccatatttataaatttttagttctagggaattctctaagaaagctgagatgaatataatttttaaaagaattaaatactttatcaatcatagtcctttaaaaatgccttttctccttcttaggaggaagtctgttcttcctgagattctttaagatttagccaatgctttattacatgcatttcataatgactgtatctgtctgtcttatttctccctctgcagcaattacctggccaacagcctgaattcggaactaattcagagactttacagaaagcatacagaactgctgtcaatgtaatactttcgttcagttttgagatgaggaagtttttgtacttcaatcactggaagttgattaggttcctgggtgtgaaaaagaaatgttgccttatgccagctgccatcttgaatctgtaaaataagaacaaaatgctttcatacgcatttcattagcagtcactttcagtagacaatgcctttcacagataatgtgaacttgttttaaggattagagataacgaatagaaagtgcctagaacaatgctcaataaatggtaaaattactattattagttgaaaacctggacttattcctttctctagaatggcactgtctgttctaatttttcacttccagaggctaaggccaggcttctgcttcaactgtctgtgaattattggaccagatatgaattaaaaggctgcaatactcctaatatgagtaataaccatctgttctgtattcctttatttgggactgatacctcaggatggatatttttctttgataaaagggaacgagctatttcaacctctgtattttaggtagaaaataaacagaatcacctcagtcagaaatagttaaaattataattatgtgcaatcatcttttaggtctcttcccccccgccccattctgtagctctctatttatacagtttccctctttcttctcttttgtgtctaataaactctgtggaacaaaaacatatcataagatatcctgtgattaagattcaaccagacacaatagagaaaaacaattgatgagttttgtggagctgttatttaggagctaattcacttattcacagaattatcatgatataaattttaaattttgaaggaactttagagattatttaagctataaattttattttaaagttaaggcaattgaagctcattgaaaataagttacttgtctaaagtcataagcttggtatgataacaagacctaaaattctgtgtgtgaggcactgttagattcattcattaagtcttttaagcaatatttattgaatactaagtatatttagcatagttgaataagatgtaacacttagtgttcttatagtgcttgtgaaatacacgatgaatacaatagttctggcttctaaatgctagtggcttataaatctaattgaagagagtaaaaacataaacaaataaccacaacaaaagaccatctatagaaagtacaatgtaaaaaatgtagatagttagtaaattccacatttctaactagagtactcagggaaagcttcatgaaaaaatttggaatatagatgggctttaaagtatgcctaaaatttccacttgattagtgaggtacagaaaggcatttcagagaaaatgaatggcttaagctgaacacccatacatatacacacacacaacaaccaccacaaaaaactaaaaaacagaagggcaagtagaaagtggctgtgaaaattagcttagcatggcgtttaaattcacggatttgacctgggacagattttgatagaaattctggtactctcactttccccacatataaaatgggaataataaacacctacctcacaggcttgcgaggattaaatgaagtttcaatcaaaagtcactagcagtacagtaaggcctgggctttggagttctccatgcctgggattgatttcttttcttttcttttttttttttttgagacggagtctcactcggtcgcccagctggagtgcagtggtgcaatctaggctcactgcaagctccgcctcccaggttcacgccattctcctgcctcagcctcctgagtagctgggactacaggtgtctgccaccacgcccggctaattttttgtatttttagtagagacggggtttcaccgtgttagccaggatggtctcgatctcctgatcttgttatctgcctgccttggcctcccaaagtgctgggattacaggcatgagccactgtgcccagccatgcctgggattgatttcttgttcctcctctaattagctgtatgactgcgattatctaattagctgcattactttaatttttatttattttttactttaatttttattttacttatgctaattttacttacttgcgaatttatttttaattatgctaattggctgccttactttgctcaaaataaccttgagcaagttctctgtgcctttactttcatacctataaaataggaccaataatatattctttacaaagctgttattatgaataaaataattaatgtaatgcatggtcacttaacatataataaaactcccaataaatagtagtaggagctgttgatattattatccctattattattgtaacagatgagtttgaccatagtttacaacagacagccagtgaaagcccaatctagaaaagcaggctggggtctggttgttgtaagcactcaatggagttgataagtttgaattgtgtctcagaggtactagtgagtcactgaatgtttctgggcccaactgtacaagttaaataaatttgttgatgatactcatctcttcaaatatagataataaaatatatatacttctatttgcttatgatttttcaagcactattttcctggaaataaaatgttatgaaaaagtagagtaacttggaaatgttgagatactaaatcatgggtttcatagtacacaaagataggaaatgaagctacttaaaataattaatgatacatatataaagtgtacaactccattctctaaaagaggggtcggcaaactcttctctaaagggccagatagtaagtattttacattttgtgggccctgcagtctctgtcatacttactcaactctgccattgtagtgccataacagccatagataataagtaaatgaattaaggatggctgtgttccaataaaaatttattcacaaaaacatggagtgggcccgatttggtctgttgaacatagtttgccaacacctgctctaagaaatagtgttttaaaattatagatttttcatagtaactgtcatttaatttttttttttttttgagatagagttttgctctgttgcccaggctggagtgcagtggcacaatcttggctcactgcagcctctgcctcccaggttcaagcaattcttgtggctcagcctcctgagtagctgggattattggcgtgtgccaccatgcctggctaatttttgtatttttagtagagacggagtttctccatgttggccaggctggtctcaaactcctggcctcaagtgaaccacccgcctcagcctcccaaagtgctgggattacagatgtgcccccacagtgcctagccccattatttaatttaatttaatttaattttttttttttttgagacagagtcttactctgctgcccaggctggaatgcagtggtgcgatcttggctcactgcaacctccgcttcctgggttcaagtgattctcctgcctcagtctcccaggtagctgggatcacaggtacctgccaccatgcctggctaatttttggatttttaatagagacggggtttcaccatgttggccaggctggtcttgaattcttgacttcaagtgatctgactgcctcggcctcccaaagtgctgggattacaggcatgagccaccatgcctggccccactatttaattttaatggaaaaaaaataggccagaattcaaatacttactggtggggccagtcaatatgtaattatacccatatttggtatcaggtacagggattgacagaatgaaataaaactcacttgcctctataacttgccttttatgcaataatgagatgtagaattacagcagtgaaaacacatgaaaatatttatccaaatacactatctatttatcatttatctatctgtctatctatccatccatccatcctggtataattatttcatatagggaataaaaattaaatttacatcttaacacctgttttgcatgcaaaaatctaagaccaattggtatgacacaagttgataaggtattatataaacaaatgattgattctagaaaatgcagttacaagtcaggcacattaaaacttactacccttctgtatctgcagtttgtaattaaagtcttactctaattatcctaattttatggttttatcaattttaagttagttatattgaacaattctaaaagtgccatttccttaccttgcagtcatctgaaagcactttaggttcaagtagagtgtttactttaaaaatctggccattccatcccttgaaaccaataggcaatcctgggccacttgtttgtgtgcttgtccaccttggggtgtttagacagtgaatggtgatgatatgggtggcttccgaactcagtaaatgaaggaagttcatctggactttcccaactccaaactccaactaatgtcatagaaatgatatgcaggttataacatggcaattgagaaacttaacagttcaggaaaacctgaggaaaagtccttcaaaggcagcctccagaaagctcctttccttggaactgaagtgccagtcagtggtgtgctggtaaatgtttaaccactgcttcttggaggaaaaaccatgatttatagtatttcctgactcctgtggtagaagcactcccaaagtgctgggattacaggcatggctgaattcagactaccaaggtgaggtcactgaacacggcaatgggaagaaatgttaacaagtggctttcctgagcctatatgaattggctccagcataccatcaggctactacatataatatcaataaaataaagataattttcacagtatataaagtaacaatttgcttttggttaatgctttaatactttttttaataaaaatctgagattctgtctctgccttcgagattttttttgtgagagtttccaaagatgagttacaagctgtaacaataatttggttgagtaattttaactttgagagccttaacggactaggacagaatcctattctttgtgttaccagcccttaatgtagtttcattcacacagtgaatcgtcaataaatatttattgaatgaatgaatgaatgcataaacaagtattaactaatatatatattagttaatatataggacaatatcagacttaagaagactgactgcacgtttcccaggcttgaacaggaaggcagattttcctatagctctagacatgattattattattttagcattattcaagcagggatatggtcataatgtaagtgaacagaaatagttcctactgaggaatttgtactgatttccaagcataaagttagaaaaatatcagttatgaggtaatgtagaagaaaaacaataacaacaaaaagaaaaacagaaagaaaaaacaaaatgagaggaaaggcaaaagaagggcatacacatggaaagataataaggaacattagaatttaagtaattcaattccttcattttacagattagagtcagaaacttgcaaacaatatttaagctttctgagccttaatttccttgtcagtaaattcgggtataacactaatctggcatggttgttatgaggattaaaaatgacaaatgtaatttacctagcattgttcctggcacagagcaggccctctggtggatcacagttttattccctaggttcatagaatagagactagaaccccagtccctgattccaagtctactgttcatcccagtacttctctggtcttccttgggttgagtttatgaatcaaagaaattagagaagtgatttggtcatggaaacaactagagtccgcttccccactgctcctatttcctctgcacagttcacacagccccatcttctttccttctatgataatcctatgccaacttccactggaatgaggatgatgatgtggatattttggaagtaggactatcatgctgctctttattagaggttcatgattccctaggaatggaaggatccttccctcttctatttcaggggtaataatggtgaatgcctattaagataaattgatggaatgccctggttaatgaagagaggtgttttaggaggagagggcggttcaataagaagcagctaaagagattgaattttatctgctgtctttttatgatgaacaaaacacacaataggcacatgtatcagttctttgtcaatgagaaattcttgatcatatatcaagctggtttaatcagaaaaagaaagaaacatagttttggtttcaatatatgttataggtacagctaggatttaggttttataaatatttgttataactcccagtgttataatatatgttagtttaacaaactaacatgcattcgttctaaacgtttgatttatagaattattcatgaaagaagtttttagtagtattctgtggatgtttaagaaaggttattatgtgcccaataaccataaatagcaagattttgtggcaaattcttttttaatgattataatataattttcagcaaaacttcaggtaactgattactggttacaaacactagctgtttaagaaatttctaatgtgtgtgtatgcataaaaacatagcatatgttgcacaattttaaaaggaatttaaaaaacatgatcagtagggtaaggcaaactaagccaaataataaaaagacacaatcaaaatgtcaagatttactgtgattaactagttttaaaaaataacatatttatttctcatacacaatagagaataatctttgctttcattcttaaaattcataattatttaaaatgatagaattttaaacataatttttcactgatactgtgcaatataacgacatgtgttctaaaattcagtaacatacctttgttacagaaacaggaggtaagcatgtctggccaccagcactgaaattgcagaaaacctcaatggcatctgaaggacagccaagatttgggtcaatccagtattttcctaataatttatagtaaaacataaagttaaagttattaaatgccataatccttataatttcttttttttttttgagagagagagtctcattctgttagcccaggctggagtgcagcggtgcgatcttggctcactgtaacctccgcttcctgggttcaagtgattctcatgcctcaacctcctgagtagctgggattacaggaatgggccaccacacccggctaatttttgtattttcagtagagatgggatttcaccatgttggtcaggctggccttgaactcctgacctcaagtgatctgcccacctccacctcccaaagtgttgggattacaggcgtgagccactgtgcccggccacatccttataaatggtcatggtactttaaatacatattatcacagtttcacctgttaaaaacttagaagattatatatttacatttagtgaatgaatgaatgctgcattatgtaaaattgatactaaaaatgctgtatttttcacataactatcaatttcagagtgtttcataattttaatcaattatgattaaattatgataaaatgatagaatagctgaattgattgcttcattctacagataagaagatgtgctcagcaactaaaagtgaattgtttagttacatagttaacaaaaaagttgaacttaatgaagtatatgtgtatatttctgttatacatcattacagtgtttcaaacgaacattttgttttataatagaaacaacttccatctcttgaaggaaaaatatatctttatgtataatactgataagtaaaataaaaatatgagaacatttttgttttcacaaaaaaatcatacaattaaatgtttatcatttttgtactctttcagattttcccactatcactcagtgggaaaaactgaggtccctatagctagtgaaattctaccagtctttgctccactgagtgcccaagagaataaaactgggcctaaactcagactacagaaaatacttagactgaaaagcaatggcctagcatcttaattccagactaatagactgagagtattaaaatagcatcttattccaaatacaaaggacaggaatttttgaataaggcagccctgttttcctgcattaaaaacgcaagaacattcaatggtttttgttaaatgtcattttttctacagtaggcagaagtccttgttcattccacttttattccatagcaaagattcctctagctcatcctgagtttcctctagcttctaaaacatcctcaaatattctcctctctactattctactaatccctctaaatgcttacttgcttaattggtagctcaaagggtagaaatggtcctcagctgcagcagtgttcaaactttagtgtgcatcaaaccatcactaaaacacacatagctgggccctacccttgagagttgctgatttattaagtctggggtggggcttaagaatctgcatttctaacagtatctaattctggtccagggatcacatttggagaaccactgatatattgaaatacagaagaaaggggtgaaggaggtcaaccattcctagtcccttatcttcagaattttgaatatttcataaagtttttagaaagtacagctgaatttttcatcagaatctgatgagggcttccagtcttacctaatggagtaaacatatatcttctttcaccttctcttgtcttccaagaaatactatcctactactatatgagctaataataaaaaattctttataaaaggttttccatcaagcaaattttatttttatatggggtgaaatgctttgaattcaggtgttatattctatttgggtaggggctccataatttctttcaaggtatgccaagctagagatgaagtcctataccatgacatatcttttgtgagcctaaatgttctgactcaaaactagctcttccctgaggacactgcttctcttgtagcctctacagtgttgtgcccgaaggtggcaaggcatctttcttgctctttgttgctacttacagaccattctttgcattttctccctgaaaacactccatattgaaattactataatcacattatatcattcattagttcctcctggtgtaatcatttactatttttctatgacaattttagctttttatcactttcagaaaatctacttatgacctaattcttggtgattttaaagccacatagatgatgctttcaacatgttggtcttcagttccttgaattgtatcctccccaaccctcttacttttccaccaatgatcttgtaccctccccctaccctcgtaccttactttaaccattaacttccaaggccatatcctagcttttgttattaccaacaactgcatctcctccataatttcatttctcttctctttccagttcactccctctagtgtcctaactccaataattcttcactttcatcgggacctactatcactttttcattgcccctaatgatcatatgttcacttcccttcttacccagcttaaaaatccacagtcctttactatagtaatgtccttataaacttccttacacccttgccctgcctcatttcactctacttgtcttataaatccccaatcctacgtaagtttctccctaacctgtgcctatacctgcacagaaaaaagtggtaggagaaaaacacaactgttgtgatgggcatccttcaaattcaaatgtgtctgtaaagctgctagacagtaatatggtgtttccagagtttattccctctatcactaagatagttaactatcttacacctattcattcgctcttatcctcaactgataagcttccaatttcaatgagacaactgaaggaatctgaagaaaatttatgtaacttatataaactcccactatcatatctacccacatgtctgtgcttgtacacatatattctaccttctctctctttttgaaataggaatttctctcttgctctgttgcccaggctggagtgcagtggcatgatcttggctcactgcaacctccaccccctgcaggctcaggagatcctcccaccttagcctcctgggtagctgggaccacaggcacattccaccatggctggccaatttttctatttttagtagagatgaagtttcaccacgttggcctggctgttctcaaactgatccgaaaaaaatgttggcctgaagtgatctgtccacctcggtctcccaaagtgctgggattacaggcatgagccattgcacctggcctgccttctctcttattatagtgaataaactgtgttcctatagaagaattatcctaaggccgggcacggtggctcacgcctgtaatcccagcactttgggaggccgaggcgggcagatcacgaggtcagcagtttgagaccagcctggccaagacggtgaaaccctgtctcttctaaaaatacaaaaaaaaaaaaaaaattagctgggcatcgtggctggcgcctataatcccagctacttgggaggctgaggctggagaatcgcttgaacctggaaggcggaggttgcagtgagccgagatcgagccactgcactccagcctaggcacaggggtgaaactctgcctcaaaaaaaaaaaaaagaaaagaaaagaaaaggaaagaaagaaagaagacttatcttgttcattatacttgcagatttaaattctacttcttttctctcttttgagtctgctttcgttgtctgctgtttctactagttctcattcatggtgttgtgtcaacttgtgtgtttggttgttgattgtgtgctgggcactgcatttttgaaattatttgtggaaatagtttgagttctaggaaaatgttatcttttatagaagatttttgtttgtttctgacagtatgtgggagttccagcagtttggaaccattttaatacaagttcaaagtttgggattttctgagctatccagatgatgtgaagcaaagctacagtctgtatgaatgttcgttttcttccagtttatctttactactagaatgcaggcctttgaaagtctaagtcctcacctttggtgggccacagattctaacttttgacccctacctcctgaagccaccaagcttctcaacatactgggggcaaaagtagctccaaatgttgggttcactttctgctgtctcctttaaagtctcagcttgaaagttcattgctgtttgttatttattttatgcttttaacttaaaaaattaatttagccaggtaatatgaattatgtgcttcgttactgggaatgaaaagttcctagcattatccttttctcttaaaatctgataaggttttaactactaccattcctctaaactgctcttgatgaaggtccttaatgatgtctgcattgctaaattcagtagtcttcctcagtttttgctttacttaacgtggacccagttaatcccttccctccctcctcctctggcaaacattttctttgcttgattttcaggacaccacatccagtttgcctcttatctcagtgatagctgcttcttagttttgtttgctagttcgccctcaccttcctgatctttaaacattagagaaccctaggatccagtttttagacctcatttcttttttctttttttttcttttgagacagagtctcactctgtggccaggctggagtgtggcggtgtgatctcagctcactgcaatctcggcctcctgggtcaagtgattctcctgcctcagcctcctgagtagctgggactacaggtgcgtgccaccacacccggctaatttttctgtatttttagtagagatggggtttcaccatgttagccaggatggtctcaatctcttcacctcatgatctgcccacctctgcctcccaaagtgctgggattacaggcatgagccactgtgcccgtcctagacctcatttcttcctttacttactatctatgtagtcttaagcagtcttaaggcattaaacaccaattaaatgtaaatgatttcataatttttacccttacttaggatctccttcttgaccttgaacttgagtagtcaactacctacttgacattcttacttgaatgtctaagagacatctcaaagtaaatatatccaaaattttactcctgatcttatctccaaaattgcatctcctgttaacaacatcccacccttttacagaaaaaaaaaaaaaaccctgagagtcatcctttaccattctagttctctcataacccacatccaatctatcaacaaaaactgctggctctaccttaacccatttattcctgaggttgtaatttttttgaatttttgcaatcagaccttggtgatgaccttaagaagtaggatataaatgactcccacatgcttagtgttccaataatggaacgctaagcataaagcatattcaagaatctaaccactttttaccacttcccctgcaaccaactctagtccaaccaaccatcatctctcctggattatgtcaatatccttctcagtggtttccctacctctacccctgtcttcctgattgtatttgcaacatattagctagagtaatattttaaaaatctgagccaaattatgtcacttcttcgctcagcaatttccaatggcttcccatcttatcaagagtacaagctagagacttctgagtagtctagagggtcttgtataatttgactttttgatatctttctaatttaatttcctatcattctcccctatatgcactctcttccattcatactggctttcttgctaattctaaaacttgctaggtatactcaaagactcagggcttttgcatttattctttgtgcctggaaagctctttctctagatttcttgtggcttgctctcttacctccttctgatatcacccaagtgtcacattctcatagatgccttatctgatcattctatttaaaaattgtatcttgtgctccacttcctatcaaatctccctaccctgctgttttgtttttccttatagcacttatgatatcctagtgatgaaagtatttggggggcgtaaagattttttgaacactgcacaatccacaccatttagctatttctcttataaggaaggtagactttgaattacatttcatactaattttgtatgtcttacaagatctttgttcctttcaattctacagaattacactttaatgccctcaaatatgggaaaaaatcaagctgagaattattataggcaactacaattttagtattattttagtttttatattaatctagggcagaaaaatatctttagaagttaagtgtttgattaatgtaaacaaaatgaatgttttcattgaagttctagaacggaagcagatgttttggacatgtgtgtatgtgcgtgtttgtgtgtgtgtgagtgcatgtatgtgagatgtgtatgtacaaacaaaattaaaatgaccacagaataacataacatagctttttcaaatcagcatttttcacatcagcacttttcaaatcatacatttttttttcaaacatgtcattgtgttaaaactagagtttgtagcagacaaggtttcccctgtttaactgatgacttactcctcttgatttaaaacctttccttggttgttctaatctaaattcatttttgcacctctggctaatgaaatcggggcatctgtgttgagattagacacttccaagaatgacaaaccgctcccatcttcatggtcatcaattctagaaggcgacatttaaattccattttgtattaaaaaaaacccagacttttagggagtatggtgaaggagatgctataatatatttatttatgttgctaacttttgtagtcctgacttaccaagttctgatgagtactactgtctgttaatgcaaaggtcaggcctacctttcttaatttttaatatgaatatgctgtataccaagtacaaaatataagcaaatgatatagctaggggtggatgacatcagaatcatgtctccctcatagagaattttattcttgatgacattaaaatggcttctgccagggttttatcaaactaactatgatttggagtgaacacattacaaatctcaaacacactgaaatgatgaaatgaaattcactatcagagtttgaggtaaccaagaacttaccatctgatactttttgttcacagttaagtaaatctttgcagattcgtgctgggttatctcgtgtgccaagaggattcttgatgctgtgcaataaattgctaaggtagttcagggttttgaatatctcttcactgtggtcaattaaagtcacttcagtattctggtagctctgccaagtcatcataagaattatataagcaaaaaaatcctgaggaccaacatgggccaaggcaggagaagaatgtgtttccattatgtgtagtaagttgtgagtagaatgtaaagaacagtttatatttaagcataggcatatgtgtatgctttaataaccttaatcttttaaagaggttaaattcacatttgcaagtttagttttcaagctaacataagaattgctatgtctactgtattatgttttttaaattacacattgaatcattagagtttaaataaatgagtagtgataatatatatatctcattttaagaaacatggctaacctcatttaactactttcttggatagtaccaaattccttacaaataacagtactaaatttttgatttaaatgttttccttacaaaacatcctacgcatatatttctgtttaattataccaaaatcacttactttgttcttgagaatggtttcacattttcaatctgttttaaatacaatctttgagataatgtcacattttggcctccaaaaattttctctgtttaattggtatattgagagacagtgccaatataaataaaaccagatatgttacctccatctgtagggcagtatttgattcaatcaaggcttgaatagcagcattgatatccatttgcttctgtgtaaaacaaaaccatttgagattagcaataagatcaacactgagtgccctaaagtaaaggctgtaaattctgaaagcactgctgttaaagtataccagacttattatctgaaggggttctgtaactcttacggttagacagattttgcaaatattgcctggatatctgaaaggacaatatgccaccttcatccaaatctcaaacgtctcctaattaaaataggaccagagtctacagtcctcagatgaaaaactatttgtttctgttgcctgaaaacacacacacaaagttcctcaaatggaagagaataaaatatgatcctctcagttaataaattgtaaagtgaagaataaataactgtagcaatttttaacagttacattcttggaaggagtagaataaaatactactgtcctgaggtagtcaccacattaatttaatctgatacttctgcggttttaaaaataatttctgaagttggaaaatgtaccatgagtcccaaaagaaataatacagaatgaaatcaatctcctcttgcatttaataaaatatatttttagaaaaagactgagcacaaccattagtaaaagtcttttttttttgtaattcttttaaaaaaattatcttagaacaatgaagcatgagttgggagaaggttctgggaaatggcatctgtgtaagtgaaacaagcaatttaatttctttcagtcattgtactgtgaagacatctttttacttgaaggctgcataatagaaactgtattcaacagatatctcatagctcatggttggtagtttgaaaaactatttgaaatgatggaataatcaataaaatgtactctcccttgcttcagcatgtgttgttcatactggaaaataattgactcattctgcatatatatactgccaaacactgtgatatatattgaggataaaatggtaaagaaaaaagaaacttgcccttatggaacttaaatttagagaggagataggcaataattaaattatctcaaaaatcctaattaccaattgagatacatgctatgaaagaaaagtgcacgaaactatgagagaaattagagaaattaatcaaatctggaaaatgtaagaggttggaaggaataggtcagggaaggcttccctgaggtagtaaaatttgaactgatgtccaaagaataaataagaattgttaggagaaggggtaggagagctttccaggcagaagcagcaacctggcacaaaggccatgagacagaaggagcatggactattcaagtagcaaagagggtaaacctaaaatattctctgcagattaaataattatgaccatcctgcttgcgtgaatgagcagattttggatatgggtcacacaaaaatattggcactaaatatgggaaactgaattaagggctaaaccatagccacctttatgttgttcacttggtcccctgctggtgattatgggttttaattagaaaacctagcatagtggttctcaaactcttcagaatcagaatccttttgcacttttaataaaggattcctttattattagaggccttacaaattttttgtttatgtgaattataactttttttttttttttttttttttaatttgagatggagtctcgctctgtcacccaggctgaagtgcagtggtgcgatctcggctcactgcaacctccgcttcccaggttcaagcgattctcctgcctctcagcctcccaagtagctgtgactacaggcttgtgacaacacacccagctaatttttgtatttttggtagagatggagtttcaccatgttggccaggctggtctcaaactcctgacctcaggtgatctgcccgccttggcctcccaaagtgctgggattacaggtatgagccaccgtgcccggccaacttttgatattgactatagtagaaaccaaaataaattttaaaactattcatgtgtcaattgctttaaaatttcaacaaacccattatatgttaatataaatatttttataaaaattaactatattttccaaaacaaaaaaattaatgagaagggtcacccagttttacacttttgtgcatttctgtaatgtctggattaatagattacagctaaattctcatatttgtttttgtattcaattagttgtgaagaaaacccagcctaatagagatatgtagtaggaaaaaagaaaagtatttaagtcgtgtttttcaaataattatggattttcttctttcatattataccttataccaaaacttgataagtggtagtttcttaaaggttagtttttgtgggaaaactgaacccacctcaatgaacgttttgtacttttatactaaaatccattggtctgttttatactttcataggtcttttgcttatacatgattttattaacataatatattgatcattctgaaaatactgatttatggaattatgcaggtcttccaaacacagatacagctcattccttaatgtcaaaaattacatttgttaacatcattaggaaaacataatgttacttatcaggaaaacataagtactgggaatctgtcaaatcctcagtgataaatacatgttttccctaatttttatttttgcttgagagcttgaaatttctcactggcatcaaattctgtcagttgttttccttgaaatggaaggctaacttcattcattttcaagaaaatatctgtgaactactcatgtcttaataatgctggtagtctgtcaataaaaaatggtactctatgataaaactggctagttgggtttgcaactcaaatagctgcacagtgcttttgaagcaatcactacagtgtgcactatatgtactttatatgtccttccatttcatctacgaaatattaaaaagatatttaaagaagataagaaatctaggagacagcaaaagtggtggaataatagccttccagaattctctcttaggcaagttaaaaaatgaaataaaaccatgtctttagaactaaaggacagagggaggagccaagatggccgaataggaacagctccggtctacagctcccagcgtgagccacgcagaagacgggtgatttctgcatttccatctgaggtaccgggttcatctcactagggagtgccagacagtgggcgcaggccagtgtgtgtgcgcactgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcactgattgctagcacagcagtctgagatcaaactgcaaggcggcaacgaggctgggggaggggcgcccgccattgcccaggcttgcttaggtaaacaaagcagccaggaagctcgaactgggtggagcccaccacagctcaaggaggcctgcctgcctctgtaggctccacctttgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacagcagggtattccaacagacctgcagctgagggtcctgtctgttagaaggaaaactaacaaccagaaaggacatctacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaagactcgagaactacgtgaagaatgcagaagcctcaggagctgatgcgatcaactggaagaaagggtatcagcaatggaagatgaaatgaatgaaatgaagcgagaagggaagtttagagaaaaaagaacaaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacgtccccaatctagcaaggcaggccaacgttcagattcaggaaatacagagaacgccacaaagatactccttgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaacatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcagtcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacaattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaaactctgaatagaccaataacaggctctgaaattgtggcaataatcaatagtttaccaaccaaaaagagtccaggaccagatggattcacagccgaattctagcagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccattgtctcagcccaaaatctccttaagctgataagcaacttcagcaaagtctcaggatacaaaatcaatgtacaaaaatcacaaggattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcttacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagcaatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactattgcaagaacaaaaaaccaaacaccgcatattctcactcataggtgggaattgaacaatgagatcacttggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaattaaaaaaaaaaaaaaagaactaaaggacagtatgagaaagatgtcttactaagtagagaatataataaaagcacataaattatagaaaaaagaaccaaatagaaattctgaagttaaaaagtacaatagctgaaataaaaatttactagataggctctacagtagatttccataggcagaagtaagcaccagttaacttgaagacaggtttattgagattatcctgtttgaggagtggaaaaaaaaatgaagaaaagtgaacagagacttaagagatctgtaggacactgtcaagcttatcaacatatgcatgatgagagtctcagaaggggaggagagagaaaagggggcacaaagaatatataaagagatcatggctgaaaacatcacaaatctgatgcaaaaatattaacctacacatccgagaagttccacaaactttcccagacacatcataatcaaactatctaatgctatagacaaagagagaattctgaaagcagagaggaagctcatcatgtccgagagatcttcaaccagattaacagctaatttcccataaaaaaccataaaggtgagcaggcagtaggataatatattcagggtgctaaaagaaaagacagtcagccaagaattctatttccagtaaaactctcctttaaaaatgaaggaaatattaatatattcccagttaaataaaaaccaagacaatttatcactaacataccttccctagaaaaatattatagggagtcattcaggcctaaagtaaaggatactaggcagaaacttgaatccacctgaagaaataaagagcagtagtagaagttacaatatagtaaatataacatatagtatagaccccaagtagccaaaataattttgaaaaaagaagttgttagaggcatcatgtttcctgatttcaaaacttactataaagctgctgtaatcaaaacagttggtactgtcataaagacagacataaagaatgaaatataatagagagtccagaaataaaccttctcatttatgatcaaattattttcaacaagagtgctaagaccattcaatgaagaaaggatggtcttttcaacaaacagtgctggaaaaatggaatatccacatgggatagaatgaagttagacccttaacttacatcaagtacaaaaaaacttacatcatgagttataccatgaactcaaaatgaatcaaagacttgaacataagaggtaaaactataaaattattagaagcaaataggaaaagcttgataacatttgattttgcaatgatttcttggaatgataccaagagcacagtcaacaagagaacaaagtagataaattagactatatcagaaaaaaaaaaaaacttctgtgcatcaagggacactataaagagagtgaaaaggcaacccaacggatggaaaaaaataactgcaaattgtctttctggtaaaggattaatatctagaatatttaaagagcttctacaacttactaacaaccaaaaaaaaaaaaaaaaaaaaaaaggcaacccaattcaaaaaatgggcaaataacttgaatagacatttctctaaagaagaggctgggcacagtggctcacacctgtaatcccagtactttgggaggccgaggtaggcagatcacttgaggtcaggagttcgagaccagcctggccaacatggtgaaatcccagctctactaaaaatacaaaattagccaggcgtggtggagggcacctgtaatcccagctactcaggaggctgaggcaggagaatcacttgaacctgggaggcagaggttgccgtgagctgagatcgcaccactgcactccagcttgggcaacacagcaagagtctgtctcaaaaaaaaaaaatacaaatgtctaataaacacatgaaaatatgctcaacaccacaaatcgttaggaaaatgcatgtgaaaaccacaatgagataccgcttcataaccattaggatggctgttatagaaaaaataaaccagaaaataacaagtgttggtgaggatgtggagaaactggaatcttgtgcactgctggtggtaatgtaaagtgtgtggcagctatggaaaacagtatggcagtttctcaaaaattagacatagaattactacatgatacaacagtttcatttctaggtatatacccaaatgaattgaaagtgaagactccaacagatatttgtacagcaatgtttatagcagcattattcacaatagccaaaaggtagaagcaacgtaagtgtccatttggataaacaaaatctggtatatgtattacatggactattattcagctttgaaaataaataaaattcgaatatacgcttacaaaagagatgaaccctgaagatattacgttaagtgaaataagccagtcacaaaaagacaaatattgtatgacttaacttatatgaggtacctagagtagtcgaattcatagagacagaaagtagaacggtggttgcaggggctgggtaaagggaggaattgagagttattacttaatgggtacagagtttcagttttggaagacaaaaaaagttctaggcatgggtagtaatggttgcacagcaatgtgaatgtacttaataccactgaactctacacttaaaaacagttaaaatggcaaaattttgttatgtatatcttgccaacattaaaaataacaagtaaatatgctcattatcccttagaccaaactatcctacttctggcaatttgtcctctaggtattctacaaaatgatatgtatatggacaggacatttgtactatgtgtaattaaaaaaactgaaaaaaagatgctcaccaacaaagggcaagatgaataaatcacaggatattcttagttggcaacactatgattttctgtgtgtggcagtaaataatacaatgactattagtagattagtagtgtagagtttgatgctttagtcatgctaaggtaccagcaattttaaacaccatcagtgcaggcgacaactcaataaaaaggcattttttttcccaacaggtattagaaagaaaagaaatttcataacacttggccactcaaaaattttcttgacaatctccatattcctagaatccccaaggtattcacaaagcctagctcatgactggcacatagcagtcaatcaatttgttgaatttattgactttttccccacaggcagactttaagaaaggcagggtcagagaaattgtattaagaggatttgcctgggaagtcattcagtcacatctaagtgcccacatcgaagtataaatctctcattaagtgcagtgaggggatcaaataaggaaaaataacttcttccaggcactctagttagagagaacatattcttacatggaaatcactcaatatttacaaaaacatgcatgtaaaatagaaaacagagaataaagattgattatatgttgtgactagtgagtgtgaaataatgaggggaattagacagcaggattcattatactttgggagaatgtaatcttcataattctctccaaatcattcgagtgaagagcagatctagtctaggcacctcagtattttgaagagaagcgttattttttcatatgtctaaagtttcaagatcactggatggtgaaaatgctgaccaaataggaactcatttcaggtcacacccctctttatgatagaagtttttgctgattctagagaaccagtatataatagcagcagccacttcttaattcaccaatccaggttctacagttgacccattaattggaatacatcagttgggaattctttctctcacttaatgatttttaacgattgttatttccatcatatacaccaaacacagacacatatagacaccctgttcttccctttattctactaatcatttctggttaactttgacatcatatggcatacttctgtgttcatttctaaataccttaccatacacactgaggtctggtcattaccctatcctcacattcaaattcaccatcaatacatattccttttcctgaaacatttccttttagctattccactttagagaactgagcaagttactttagtttcataggtcttataaagatgtggctggactggattagaagttttcatacttatcttgacccacagtaagaaatacatttttacatcatgacaaaattcacacaaacatacatatattcaaccttaaaaagttctgtaaaaccatatttattcttactgatgatgatgtactgatttttttaaattgaggtaaaatttatataacataaaattcactattttagtcatttaaaaatatacaattcagttgtctttagtagattcacaacgttgttcaaccactaccatgatagaatttcagagcattttaatcacccaaaaagaaactccatatctattaagcagtccctccccaatatttttctattctatttcatttgctctaaaaataatcctgaatgagactcactaaattggtcttatgatccgctgaccaatgaatcccaactcaaagtctgaaataactgcttaataattactgagaggacctctagttctatgagtctaattttttatagacattgtttctctccaagtgaaatctagtttagaagattcccactaaaatttcctgagatgttgccttttttgtattcatgcaagcatgcactcaacatttattaagagcttaaatggaaggagaatttaaaaagtagtctctgtcttcagagggttcacaatataatagaaaagacaaacatgaaaataaatgagtatgaacaaagaaggggaagtgatcagttctatcttgtagtgtgatgagggaatggaattaagaaaagtttcatggaggctgactttagaaagaatgtgtaggtgtcttattgtcatttagatgtctgctctagaaatcttatcctcaatgttattttcctacaacggactctgcaagttccaggaaaacagcattatatatggaaatctgttttcatattggccaagaaggaatacagaaaggaggaaaagggagaaaagaaggaaacaaagaaactagcatttattgagtagttataatgtattcaacacacgtattttcttacttaatcttcctgattaatttctcaaagtgtatacatattttaatccacattttgctctgagcaaaaacctctcatgtcttactctattttggctgtgtaggaacacatgtattttccaagtgagacagggatatgtgtcacacagtttggcacttaaatgtgaaaattttcactaaacatttctttaatttgccaatgacgtatgatcctttagaacttgaacttgttctttcttgagaagggagctatgatatatcaaagtcattataatttgggaaggcaattaatgagggtacttgtaatccatgcattgtggggatccaggaggaaaggaagaataaacaagtggaaagtgatttgaagacttggagaaagacattgttttttttttttttttgtttgtttgtttgtttttttgagacagagtcttgctctgccaggctggagtgcggtggcatgatctcggctcactgcaacctctgcctcccgggctcaggtgattctcttgcctcagcctcctgagtagctgggattacaggcatgtgccaccatgcctggggttttgccatgttggccaggctggtctcaaactcctgacctcaggtaatacacccacttcagcctcccaaagtgctgggattacaggtacaagccaccatgcccggccgaaagacattcttattgatgtccacacagggagagtttccctccatgttagtcagaaggccagaaaggggaagtgattttttaaaatcacagataaatgggtctcttgttttcaaggggatagtcttccttgtggcactttgcctggaagttattccttgccccaatgaaaagctgagggaaatgaagagttcctgatctgctgagagtagaccacaggaaaccaccacctagaactagcagagatctaaatgacatcagagcagcatgtgaaataagaaggcttaaatggcataggactgactattgtttgggatggtgtagcgaacagtagatccatgttaggcagaaaatgtgaccaaggaccactgtatttgaccaggaggctggaggagtggggtgtgggtgaggttgcagatggagagagacctttcatagggagcagaaagacaaacagactgcggaatatgagagtggatacaaagcataaggaaaatcaaacttagaatatcagagggcatgagaatagcagaagcaacataaacattgcctcagagataagggtagcaagttttgggtcatagtagttagataataagcaaacataagagaagtctgatggcttccagagttaccagcaactgagaaagatttgatttacttcatgtaaatcaaagaagtggataaccctggctggcaaaaagagaacatttaaaaaaggagagtgaagatgtagaattaggaagaaatggagataattagtttttcaagtgcttattatgtattatacaatgtgctgcatgctttacttcttactcaacacttgaaaccacccaagaaagcaggagataccatctccattttataaataagaagtctgaggcttggatttcatgtttgtgtagctgggccagccctgtatcaggttagcaaaaaagaacagaggtatccaaaagggataccttttaatagagagttaacagaaggatatttaaaaagttaatatgacatactaagataaaacaaaacaaaatcaaaccaagcaaacttactcttgggcctggtgctccaggtggaccctagaacacagcaaattaaaaaaaatacacatttatttagtagacatcttaaaccaggcaaacatataagcatcaatggtaaacagatataaatgaaaaccaactcactggaggccctggttgacctcttggtccttgaggaccctggaagaaatggagacaaacacaagacctatatattatacttttggttgggtataagcaagataactaatattcaacctctgtaactgcctttcgtgccaggcaagtcatacaatttaaaattgttttagtattctaaagttatatgctgtggtacttagcaatcatccatattcataaacaagctggatatttattttcctgtttatcgatattattagaaactgaatttactcattttaataaactattataaatgtaacattttaaaatattagtattgtctaaagatgtttttcctgttatttctaactaccatccacctaatcatcaaatatagaaacttcggtgttcttagacacattaatttcctttatctacctgtaaactggttactaactcctgttgagttcacctgaaaatctctccaaaataatacttctccatttttattgataattaaatgaatgaatgatgttaaaattaattagtattaatttagaaattagaaaagtgaaaaggtgtatcgcaaaatgtcaaaagttatgttgacatttttcaaagcgaagcaataattactgttaaaaatgctcaaaggccctgtacatctgttcaaaagtaacttagatgttcagctaaatgttaagactatattgagtcaactccaattacggttaaaagatggcaaagcaacacttatcttcagctaagttttggataatgttgacaccatgcttgacttagtattaagcatcttgtattgccaaagctgttaatcctaaatatactgtgatagctagaacaaacaatacatagtaacttgaaaagatcagagtactccaacactgtgcctgctagacatgtctcagtttatctggtttatgattacaagtttaagcagagaatgtacaaaacttgtacataattaaatgaatgaatgatgttaaaattaataccagttaattttaatactagtcaaaattaatactagttaatactagttaattttaacatcatccattcatttaattatcaaccaatgcatatatctcagaagctgcagggtagctgacagaaatgtcacattggagatagccttttaaatatacagaagctcaaagtgaaattggttatgtccgcttctccattttggatcaacaatgtaaaaataataaacagttgcaatagtccattccacttagcaagtttttgacatttggaaaatatcactgatggttcagtacaaaatacatatgttacctttgacttcaaaagaggaatttatcatagaaaaataagaaacaatttctactgctgattttataaagttcacttcagcttattattcagaacaagtcagatcacaaatatgatcaaacaaaatacttcaaacccaccaggatagggcagggcaactccaatgtaaccacatagaatagggaaagtagccaagttaaaaaaatatgattccaacaatataacattttattagttcttttttattactctagctaatacaccattaaggtgaagtgattcactgtctattctatataaagctgtttataggccaggcatggtggctcacacctgtaattccagtactttgggaggtcaaggccagcggattgcctgagctcaggagtttgagaccagcctgggcaacatagtgaaaccccatctctactaaaatacaaaaaaattagccgggtatggtggtgcactcctgtagtcctagctactcgggaggctgaggcacaagaattgcttgaacccgggaagcagaggttggagtgaaccaagatcacgccactgcactccagcctgggtgacagagtgagactctgtctccaaaaaataaaattaagtaagtaaagtagtttataacaacaccatgattgtctctgttaattttcttttactttctttttttttttttttttgagacgtagtttcgctctgtttcccaggctggagtgcagtggtgcgatctcggctcactgcaatctctgcctcccaggttcaagtcattctcctgcctcagccttccgagtagctgggactacaggcgtgcgccaccactcctggctaattttttttgtatttttagtagacatggggtttcatcatgttggccaggctggtctcaaactcctggcctcaagtgatccacctgcgttggcctcccaaagtgctgggattacaggcatgagccactgtgcctggccgtctatgttaattttctaaaggggaaccaaattactctgaatggttatggtggttatttggctatagtaaaaacacttcctatgaaaacaagattctcttttcactttatcccagaatttacatacgatcctccaaaagtaacatattttatcagtatactttaaaaatacgtgtaagtgcatatccttaaacttgagtatgttagtcttcctttttgtaaattcttttatttcatttcctaatgtcatttcctttatgtcatttcccttatgtaaatgcaatcttgatttagcttcatgatctttattttaggctggctcagttgcacagagcttccttttctcatttataaactgaggagcttccattgtaggatgtttagcagcatccctagcttctacccactagatgccactgacatctcattcttttcccccaattgtctcctagggtggtagggggacaaatggctcctggttgagattcattggtttgaaaggagaatttagtaatattaaataagattaactagatagtaatgtaattagaatggaatgagtgagcaccacaagtcatagggcgtgactgcaaataagaacataaactcttcaagttgtcatgcgggtgacagctgggctactcttgatctaggtggaggatacacacacacacacacacacacacacacacacacacacacacacacacaccatattccttaccaagacctcctaaccctctttttctgaaaggcactataatttatagaaaaacacaatcatataggaattgggaatctgggctctggttttgtctttgtaacttaatttgctatatggtcttaagtgaactgctgcacatttggacctcagatatctaaattgtaatataataggtctagtgaagataatctccaaggttcactttagaattatgattttcaagacttttatcaattttcttcctgatgtgtgtttttttaatttttaaattttctttaaagacgggagtcttgctatgctacccaagctggctttgaactcctgggctcaagcaattcttctgctttaggatccctgagtagctggtaccacaggcatgtgcttctgcatgacctacctcatgttttttatctggataaagaaggtgtacacaagcatacagattgggaatttaaaatttaaagtctgtacaaatgtaatggtaagtgttcttgaatttaaaaagtttgatacttttaaatgaatgatttatactatttatgaattttaaaaagaaatacatacatatatatgctttaaatgcttactgtgttaatatttaggacctatttcccatatcctagtttttccttctaatgcagaaaccatccttctcactttcaaattggaggcaaataagacaactgctaatcaagaactgtgaagacatattaacttagagataatattagagaaaatgtcaatgggatgtttcaatattttatgatttcattaaatagtatattataaatatgaagcagctaatctgaaaattcatgctgagattgttctctgtttttttttattatttctatagctgtaagttatatgattcaagttgttacattttgtcaaaattattttcaggtcaggtatagtgactcatgcctgtaattctggggctttgggaggcagaggccagaagaatcacgtggggccagggttcgaggccagcctgggcaacactgggagacactgtctctaccgaaaaaaaaaaaatcattaaataaataaataaataaataaataaataaattagccaagtgcaatgacacgcacctgtagtcctagctatttgagaggctgaggtgggaggattgcctgagcccaggagttcgaggctccagtgagctatggctgcaccactgcatgccagcctgggtgacagagcaagactctgtcaagaaagaaaaaaaatcctttgccgatatctgacactaggatatcatttctgctataagttaaaattttacttagaattttacttaagttaaatttttactaattgtatcccattatttccagcagtcgtctttgcattacttactctgaaatttactcagttgtgttttaagtgtttcaggtctcatagaaagtaggaaattttgtaaactttcaggatttatttggcagtaacacaacagttttgaagtagaggaagagtagagaattctacatgttatctgctaggtttccttaggatgccataaaactctggctctgtttagaatatatatatatgaataggactgggtgcggtggcttatgcctctaatcccagcactttgggaggctgaggtgggcagatcatctgaggccaggagttcaagactggcctgggcaacatggtgaaatcccgtttctacaaaaaaataggaaaaaaattagctgggtgtggtgctggatgcctgtaatcccagctactcaggaggctgaagcacgggaatcacttgaaccagaaggtggaggttgcagtgagctgagatcttgccactgcactccagcctatgcaacagaacaagactctgtctcaaaaaaaaaaaaaaaaaaaaaagaaagaaagaaagaaaaagaaaaagaaaatatatatgaatctagggactcattttaaaaacagtccataggcaggcagaccgggagcaagtatagaacagaaagaaaaataactctttcataaatggccatacagaatcagctctctcagtggtggaaaggacctacttgggatcaatactagagtttacaatgttaaattacagaagacatgaagttttctaatcaagaaacccaaattataataaaggagttacttttcatgtattgtataatgagctataaacttatttgcatttttttaaagtcactgaatcatgctttggtcatttttttggttatatttaggtataaaacttggtaaggagagcacagtttaataaattcatagtttaataaattttcctccatggaaaattttaaaataagattgaggcccagcgtgatggctcacgcctgtaatcccagaactttgggaggctgaggcgggcagatcacgaggtcaggagatcaaaccatcctggctaacacagtgaaacctcgtttctactaaaaatacaaaaaattagccgggtgtggtgatgggcgcctgtagtcccagctactcaggaggccgaggcaggagaatcgcttgaacctgggaggtggagcttgcagtgagccaagactgcgccactgcactccagcctgggtgacagagtgagactccgtctcaataataataataataataataataataataagattgacaaaccaatttgatagattgttgtgattctgatctttgtgcaaagacttaagtctcttacttgtctcaatacaataggtcttagctaataaaatccattccaaaaatgcaccatttactagcattttctgagaatgacctccgcgaatgtattacattctgaaagacagtaaccaattaggcgtctttagccagtcaattatttaaactgcctccttaaagaaaacaaactggtagaatgtactgaaaaattcccaatgaaaagtgtaagaaatgttaccaagcttttccataaaacaaaggagaaaaggtttaacggcacattttatggattatgataattgcagaatgatctccaggaattaaaagattaactttataaagctccttaaattataatggaatcaaaggaaaagaagtgattaaaaaggtatttagtatcagttatcagttactcaacaataaaacagaataaactcataattgtaatgtgccagttaatcctttttttttttaaacagcatatttagttgcctactctaaatgccactgtgcctatttcccatctcccttgggtactggaagtttgcaccttatttatgaagagaagcatgataacccacagactaaaaactctaaaaagcatgttaattcaggaaatgctactttaccaggctagaactggaaatagtgtttcactttttaattttagggcatattattcatttatcaactattacctattacatggcaagttctgttctagacactgataacctgtgtaccacacaaagttccctactctcatgaagtttacattctagtggaggggacaggaaataattgcaatgagtgctattatgaagaaaacaaaacaagatacagtgaaagagaatgaccggaaatgatgagacagaatggtctgagaagacttctttaagatggtatttgagcagagacctgaatattgagataaaattagtcatttgaagagtatatgaaagaatttcctaggttaaaaaaaggcatattcctaagaatagaaaggaggttagtgtaggtggcaggtggaaaatggtacatcaggacactggagaggcaaacaggggccagttcatgtagggccttgtaaatcaaggcaaggaagcttagattttattctaagtgcaagaagaagtcatagggaggtgtttaaagaggagaatgatataatttgatttattctttaataatatcactctatttgctatgtagagaatagatcgtagtgggggaaaagtggaagaaacgacaagaaaccgggagtccaggagggatatcatgatcacctgcacaaggatgccagtgaggaagaatgagagatggattgagaataggatttacagctgatgggaattaatctctaaagaactctttatgttctatggctttgttagttcttttgtgcggggggagggcttatttctttttcttttatgtagaatcacacatattcagatctggaaagaactttatgggtatctcttctaattccctactcagtgcaggaataccagtccagtaacttggggagatggtcagtaggctttggtgaaaggtagttattaccttgcaaaatgatctttttgtgtagttttcattattatattagacagctcattattacatggagctgaaattagcctcagtatcctattaactttgtcactaagtttttattgtgttaattatgtatccggtgctataatagactgggtactaggtggtaacaacgatggtaggtaggtactaggtggtatctaatatatttcatgccttcatggagctcactttctctcagggagctgagcacagaattcaataaattcaaacaattcaataaataagtcttttaaattttatcctctagagttactcatattgtatctatcctctcttatataagataacctttcaaatatttgaagacaactattatgttccaacacctcaattttgtctaattcatttaccaataattcattaaatatttattgaatgccaactataagagaggcactgccaggtgtgagggacacagcattaaaacaaaaatcaacagttaaaatgtttgtgtcttcaaggctacattctagtgaggaaaaatataataacaacaaaaaacaaataaatatgtactatgtcagttggtagaggcacaggtagaaggaatataaggcgtctcaggaaggtgggggcactgctattcacacaggctagtcaggataagaggacatttaagtacaaaactgaagaacacgtgccaggcattgtactaggtcctgagggctaggtattatgtccagggtgggagtagggtggggtcaaaacattagcatgcctgccccgagaaatgttcattaaatcaaaatgtcaagatcagcaggagctctctaccatacataaagggtatggtagagaaataacaggtacaaaagccaggaagtgcgacgagagaagaaagaacaaggagagagatgtaatcaggctgcagaatctggtagaggctaaccatcccagatatttcaactggtcctaccaggacataggttcccccagatccttccccttctctgaatgtgctttaatgttgtccatgttttctttggggatagcatgactggtaccactacctgctttatactgcatgccatatttctatcactacaacctaagatggcagtcctaatctattgcatttgtaatccatcacagagccactcaatttttttttcatgtgaaatgcttgtgacattgccataggtacttcaggcttcctaatcctgatggaaactatgtcccagccacagtacttggagaggatactggggaggcatgcagagccacactgatatggaacatgggctaattccaagtctctctgcttttcccttccctctttcactcttccttggaaatatagcttcactgtgtacatatgctcttgcttcctgttacaataaatctgctgagaaaaggtgaggatcacatttctacaaattgaacacatcgatttaaatatccttttgtgattcttaggctatctgaaataacataatttctcctttttagctagttaatataactgcaacttaattattctgagtctcaagcataccctaagatgagaaaaaaaaaaatctcagctgtgactatgtaatctcattaccttctaatcaagactttactgctatatttaagtttattctcatgggccttatgtacttggtttcaatctccctcattttattccatgtctgtcctctgtttatggtgctgctttaataagtttggcatggatcacatgctaagtgagtagatgttagcttctcttgcaataaaaaaaaaacaaaaggatgggtaatcatgtgagatgaatatgttaatttgcttaaaaaattacttataatcaaattacttgcttataaataacctttttactatctatatgtatcctataacatcatgttaaatctatacaataaaaaacttattaaaaaataagcttagcatgatctctgctgaagaagtggcccctttacaacacatcttctttagcatggaagaattggcatcctagaaatgagggaagtagggccagtataagctactttggtcacaaaagtgctgtgtaccttttgcccatcctctcatcattgtctctaactggctgatatgcaactaatgatttgcctctgcattgcagatctctttggtgctgactggacatagtgggtatatgcctaaagcgaattggcagtccctttgttctgccactggtgaagaaaacccatatcccatctcctgatgcctggcaaggcaaataatccatttcacacagtgatccgggaagaagtgattggcgggttcttaaacatctttagggtttatcagatttcactgcaatctaccacatagggtttttaaattattattattatactttaagttctgggttacatgtgcagaacgtgcaggtttgttgcataggtatattcgtgccatggtggtttgctgcacctatcaacccatcacctacattaggtatttctcctaatgttatccctcacctagcctccgacccccgacaggccccggtgtgtgatgttcctctccctgtgtccatgtgttctcatttttcaactcccaattatgagtgagaacatgtggtgtttggttttctgatcttgtgatagtttgctgagaatgatggtttccagcttcatccaggtccctgcaaagaacatgaattcatccttttttatggctgcatagtattcgatggtgtatatgtgccacattttcttaatccagtctactactgatggacatttgggttggttcccagtatttgctattgtgaatagtgctgcaataaacatacgtgtgcatgtgtctttattgtagaatgatttataatcctttgggtatatgcccagtaatgggattgctgggtcaaatggtatttctagttctagatccttgaggaatcgccacactgtcttccacaatggttgaactaatttacactccctccaacagtgtaaaagcgttcctatttctccacaacctctccagcatctgttgttgcctgacttttttatttatttatttatttatttatttatttttattatactttaagttttagggtacatgtgcacattgtgcaggttagttacatatgtatacatgtgccatgctggtgcgctgcacccactaactcgtcatctagcattaggtatatctcccaatgctatccctcccccgtacccccaccccaccacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacattcatcatcactggccatcagagaaatgcaaatcaaaactacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcttgctgctataaagacacatgcacacgtatgtttattgcggcgttattcacaatagcctgactttttaatgatcgccattctaactggtgtgagatggtgtctcattgtggttttgatttgcatttctctaatgaccagtgatgatgagcattttttcacatgtctgttggctgcataaatgtcttcttttgagaagggtctgttcatatcctttgcccattttttgatggggttgtttgttttttcttataaatttgtttaagttctttgtagattctggatattagccctttgtcagatggatagactgcaaaaattttctaccattctgtaggttgcctattcactctgatgatagtttcttttgctgtgcagaagctctttagtttaattagatcccatttgtcaattttggcttttgttgtcattgcttttggtgtttcagagatgaagtctttgcccatgcctatgtcctgaatggtattgcccaggttttcttctaggatttttatggtcctaggtcttacatttaagtctttgatccatcttgagtggatttttgtataaggtgtaaggaaggggtccagtttcagttttctgcatatggcaagccagttttcccagcaccatttattaaatagggaatcttttctacattgcttgtgtgtgtcaggtttgtcaaacatcagatggtggtagatgtgtggtgttatttctgaggcctccgttctgttccattggtctatatatctgttttggtaacagtaccatgctgttttggttactaccgtcttgcagtaaagtttgaagtcaggtagtgtgatgactccagctttattcttcttgcccaggattgtcttggctatgtgggctcttttttggtttcatatgaagtttgaagtagttttttccaattctgtgaagtaagtcattggtagcttgatggggatagcattgaatctataaattactttaggcagtatggccattttgacgatattgattcttcctattcatgagcatggaatgtttttccatttgtttgtgtcctatcttatttccttgagtagtggtttgtagttctccttgaagaggtccttcacatcccttgtaagttggattcctaggtattttattctcttagtagctattgtgaatgggagttcactcatgatttggctctctatttgtctgttattggtgtataggaatgcttgtgatttttgcacaatgattttgtatcctgagactttgctgaagttgcttatcagcttaaggagatttggggctgagatgatggggttttctaaatatataatcatgtcatctgctaatggagacaatttgacttcctctcttcctatttgaataccctttatttctttctcttgcctgatttccctggccagaacttccaacaccatgttgactaggagtggtgagagagggtatccttgtcttgtggcagttttcaaagggaatgcttccagtttttgcctattcagtatgatattggctgtgggtttgtcataaatagctcttattatgttgagatatgttccactgatatctggtttactgagagttttggcatgaaaggctgttgaattttgtcgaaggcattttctgcatctattgagataatcatgtggttttcgtctttgtttctgtttatgtgacggattatgcttattaatttgcgtatgttgaacgagccttgcatcccaggaatgaaggcgacttgatcgtggtgggtaagctttttgatgtactgctggatttggtttgccagtattttattgaggatttttgcattgatgttcatcagggatattggcctaaaattctctttttttgttgtgtctctgccgggctttagtatcaggatgatgctggcctcataaaatgagttagggaggatttcttcgttttctattgatcggaatagtttcagaagaaatggtaccagctcctccttgtacctctagtagaattcggctgtgaatatgtttggtcctggactttgttttggttggtaagctattaattattgcctcaatttcagagcttgttattggtctattcagagattcaacttcttcctggtttagtcttgagagggtgtatgtgtccaggaatttatccatttcttttagattttctagtttatttgcatagaggtgcttatagtattctctgttagtggtttgtatttctgtgggattggtggtgatattccctttatcattttttattgcatctgtttgattcttctctcttttcttctttattagtcttgctagcggtctatcaattttgttgatcgcttcaaaataccagctcctggattcattgatttcttgaagggttttttggtgtctatctctttcagttctgctctgatcttagttacttcttgccttctgctagcttttgaatttgtttgctcttgcttctctagttcttttaattgtgatgttagggtgtcaatcttagatctttcctgctttctctcgtgggcatttagtgctataaatttccctctatacactgctttaaatgtatcccagagattctggtacattgtgtctttgttctcattggtttcaaagaacatctttatttctgcctttatttcgttaggtacccagtagtcattcagaagcaggttgttcagtttccatgtcgttgtgcagttttgagtgagattcttaaacctgagttctattttgattgcagtgttgtctgagagacagtttgttgtgatttctgttcttttacatttgctgaggagtgtttcacttccaattatgtggtcaattttagaataagtgggatgtggtgctgagaagaatgtatattctgttgatttggggtggagagttctgcagatgtctattaggtccgcttggtccagagctgagttcaagtcctggatatctttgttaattttctgtctcattgatctgtctaatattgacagtggggtgttaaagtctcccattattattgtgtgagtctaagtctcttttactgcatcggttaattctacttcctgacaactgcaattttatttttattctacaagtatcagagacataataatggataactctaacagggtccttgctttcatggagcttatagcctagtgtcagggttactataatcacaaatttagttaaacttacagtttcacctctaaagcccttttcacctctgggtccctaaaagaaaaaaaaaagatgttagttcattgttattgatagttacgtattaaatgtagctgaggtcattatatgtagaaacatgacaatttatatttttgctttttctatatagtaagacctgttttgttaaattgtataagttctagtgttcttttcctaaataaagcaaagcaaacaaaaaacccttagtgattcatgttgtctgctttgctgttcctagttctaaccttaaggtgagactgagataactacttattcattcaattaagtcaaaacagcttatctgacaatcatatacaaagcaatttaaaaaggaaattctaaattcaggttaaattcttctaataattgtttttcttaacttttgaaaaccctgtttctgggatggtttcccttctctttcttgcaaattttaatatgttgtatatgtttccgtgcagttcaaaatattttctaattttcttggagacttgctctttgatccatggattatttagaagtgtgtgatttaattttcaagtgtttggagattttcctattatctttctgttattgatttctagtttaattccattggcaagagaatataccttctatgacctcagttcttttacatttagtaaaatttgttttatggcccataacatcttctattttggtgaacgttccatatgcacttgaaacgaatgtagtttgccattgctgggtggacctactgcttttaaaatgtgttaatattttcctgttcatccttttgaaaattttatatgtatatatatgtaaaaaatgagatactattcatcttttctgtaacctgaatttacaccttcataaatataatatgaatgctcttccatgtcaatatacattcttttagataattaaaatatttaataatcttacctagtatttaatatactatgataatattttaaatttgctattattagactttttgctaatttttgtcattgttagcagtgttgtgagagatacccttacagtctaaaatttttgttaaagactgtcttccagaaagttagtttgaaattacatacacacctgcaaaaatggaagtgtacatttcttctgatctatgtcatgttctttgttaatttgcaagctaagaatactatcttatcatttattcaccatttatattacttctgtgtttctcatcttgtctcaattcattttaaaccagggtattaacttaaaaaaaacttatttatttatttacttatttttttttttttgagaaggagtctcgctctgtcaccaggctggagtgcagtggcatgatctcagctcactacaacctccacctcctgggttcaagcgattctcctgccccagcctcctgagtagctgggactacaggagcataccactaagcccagataatttttgtattttcagtagagatggcgtttcaccatgttggccaggatgatctcaatctcctgacctcgtgatccgcccgcctcagcctcccaaagtgctgagattacaggagtgagtcactgcgcctggaccctgatttttaagatatctacacagcactttaaaaaaatatatacacccttttccacaccctacccagtattaacaacctggtatgtatgttttcatacctttttctaatcaaatattgacaaatacatttatgtatgtatgagaaatattgctgttttaaaatattggaatcatattatatactcttctatgcatcgcacttaacaatacatcatgaaataactgagtcagccaaactagatataataaattcttttaaacaattgcataatattccatgaaatggctaacctataacttactcaatcattcctttagaaatgagtattcacgtaatttcaattttttttccaataaaagtagtattacaaaaaaaagtctttgcaaaatttcattagtgtattgggtgcttttatacctatgggataaattcctccaagtggaactgttttgttaaagaatatgtacctatatttaacaaatctttccataaagtctgtaattcacatttttaccagtgatcaatgagagtactgttttctcctatattcccttctgagaagttaaatgtaatatcttattttactttaatttgcatttctctgacttaaatttaggtgagtgtctttttattataaaacaatagttgaacttttggatttgttctttttttctccgctggctacttttttgatggaatgcttttcatttttctattgaactttctttttcaaactataagagctcttggtatatgtgtgtatatgtctctatctctatctatctatctatctatctatctatctatctatctatctatcatctatctctagatacatacacgtatccatagcaacagataggtagataattttttatttttaaattttttttgcccaggctggagtgcagtggcatgatcatggctccctatagcctcaacttcctcagatcaagtggtcttcccacctcagcctcttgagtagctgggactacaggcatctgccactacgccaggctcattttaaatttttttgtagagatgggatctcactatattgccaaggctggtctaaacttctgtgctcaagcaatcttccagcctcagcctcccaaagtgctggtaatacagccgtgaactactgttcccaactgagctctttgtatattaacctgttatatattgtatgctttgtaaatatttttcccaatcaatagtacttttaaactttattcatggaatcttttttccatacaaaatgaaaaaaaaatttcaagtattcaaatatactttctgttcttttacaggtctccccaatccttaagctacatgttagttttctagattattcttcaattttttttttttttttgagatggagtttcactcttattgcccaggctggagtgcaatggcatgatcttggctcactgcaacctctgcctcccaggttcaagagattctcctgcctcagcctcccaggtagctgggattactggcatgtaccgccacacccggctaattttgtatttttagtagagatgaagtttcaccatgttggccaggctggtcttgaactcctgacctcaggtgatctgcccacctcggcctcccaaagtgctgggattacaagcatgagccactgcgcttggcctcttctaagatttttattgttttattttttacattaaagtcgttaaaagttcatctaggagtaaaatacttttggcaaatggggttccaatttttctttcttcttttttccttttttaaagagatggggtctcactctgtttgcgcaggctggagtgcagtgggtgcagtcaactcactgtagcctggaactcctgggctcaagcaatcctcccatcttagcctcccaagtagctagggcttataggcatgtaccaccacacacagctaatttatttttatatgatgggggtctcactatgttgcccaggctgtgttccaatttcttatagcaggaggatactcaaagtaattccatctctcttccctgtcactgacgtaggagtgaacatctggctgaatgctagacaattagatatgaaaaaaatgtaatcggagacttctaaaaaattcttatttttgccacaatagtactttatgtcattttttttttcctttggataattatatctggatgtagttcttgagaagttgtagtcatcttgctataagcctaattatgaagccaacattcaggatattagagtagagacatagagatataagagatacataagaacctggtcttggatgagataattgagtcgccaaattaaccaaatctgaaggctttcctataatgtgatacaaattttcttattgctaaaagtactttggttcagggttcctattatttgcagccaaaccttcctcaattatatgccatttttgttgtaagtaaattcctatatatacttaagatcaaattctgggctctagtctgttacaccgatctgtttatttctttgtattaccatatagtttcatttacaaatttccaagcctgtcacccctcactggtattttttttcccaatgctttcaccaatctgaaatgcttattctttcataatgaacttttcttctcagaatggaaaaaattgaatatggaaaaattgatgtacatgctgaatattataagggtctttaagaactatctataaacaaaacacagtaagatattttaattaagtaattttaaaattacattttccttgaccaattaatacatcatatttttgacagaggagaaaaatcattctgtaatcagaacagtatgtgtcccttagcttgctgaagaaccactcactgaaatatgagaattctcccacttacaatcttatatagctccgagtggcaaatgttgaaagtctacagaaatactgagttatacattttacttcttttgtttacatatccagtaactttggtggtttcttctctaaatttatcaaagagaatagtggtactaaacacttgaagcattctatttttatattttttaattgtctgtgtctataaataactttcaaataattcaaaatattaattccctagatagaatgaatctttcctctctaagtctcaatttgaccctttctactgtgctccttgcttgtttatactattatcaatattggaaaactttcccaacatcacttgaccaatcattgtctcatttttatgttttatttcatagccaaatttcttaaagcactggcatataatacctcaatttcctctccagacacagcttgaatggagtggaaagagcgctggtcttgaagaaacaccagctatgtaatccacgaggtctatcaccttgaatgactagatgaacctccataaacctcatctgtctcctcatctgttaaatgaaaataatatctactgcaaaagtttgttgtaagaatttaaggaacattattattaaacattttcccctacttccttcatcactgtaacctgtactgtatcttctactgcaatttattctctcaaagattactgttgactactcctttcttgaaacacttgctattctctcgaacgattctttccttcctttatagtgggtacttccaaaaactcaaatgttggatgtctgcacatcttttgctatctatgttctttccttcagaagaagaatttatttttattgctcaggagttcatctctatgtttataacactctccccttcctgactcagttctattttcttttctcaactccaattataaacacttacctacttagttacactgtcttcattacacatatggtccctaacttctcaggaatcattttccagaagaaaatgtatatctattttttccattttcttctcaaatacccaggctaattctttgtagaatattctagaaatagaattaaagaaaaaaaagagtacaaaagacttgtattatgataaacttacagttctacctgttgggcctattataccttctctgccaaggggaccagtgtttccctgttgaggtaaaagaaaaacagtctcactgttagtataattaaaaaaaaaaaaactccacagaatctcttgtacaatggtaaaagagccatgtctacataattatcctttttagtataaaagcttacagtattagcataaattacaataatcttggttaacagtatgtgacacaattctgcatattattaaagtctcttatcaggagagttgcatctgtataatttctaaaaaactgatgaattagcattatgatttttatgtggtgataacttcaaagatgcattttacatgtatgttatataacaaataaaactactttatataaaaaagaatagaatgatgaactaggttttgaataaatttctgtgcagatgttgaaaaagtagatgtttgggtaacatgaagcatgaaatagagaaaaagtacagtaaggaaccagagaacagcatatgtgaccaactaaacttcagttcttcatctgtaaaacaggaataagaacatctacttcatagggccattgtgagaattaaatatgaaaagtgcttttaaaactttaagctattatttggttatgaagataaccttgaataagctggatttctggtcaattcctcccaaagtaggaagagagtctataatttctcagtgaatacaaaatgcccattttagttttttcctacaaacttcagcttccgtggttcttcagaaatcatgaaaataactaatatatttatagctgaagaaatattcagaaaggtctttaaacaattaccatgataatactcctctttgcattattttttgaattagtattgttttaactgagatggagtcttgcttcttgctgtcgcccaggctggagtgcagttgtgccatctcggctcactgtaacctttgcctcctgggttcaagtgagtctcctgcttcagccttccaagtagctgggattacaggcatgtgccaccatgcccagctaaatttaaatatttttattagagatggggttttaccatattgatcaggctagtctcaaactcctgacctcaagcaatccacccgccttggcctcccaaagtgctgggattacaggtgtgagccactgcatctggccctttttgcattttttaaaattatactttaagttttagggtacatgtgcacaacgtgcaggttagttacataagtatgatagactggatgaagaaaatgtggcacatatacaccatggaatactatgcaataaaagatgatgagtttatgtcctttgtagggacatggatgaagctggaaaccatcattctcagcaaactattgcaaggacaaaaaacctttttgcattattgacaacaatttattgtaagagttaggaaagcggtataggattttagaagtttgactttcatttaatagttatttaagatacctttatcctacatctgcactgcttccctttttcctctctctgctctttcaacacttgcccctgcagctgctattagtcatagagatgctactaccacagccaaaccattacttgaagttttaaattttttttcagctttttttcagttttatagaacatctcatcaattagaaagctttgattaataaaaactaaaaacaaaacaaaaaactaaaaacaataatcagtaagcactggtggcttatttgtcctatttatattctctacaatttgcaattacaagcactcattgctaattggagttcttcagaccctgctttttgcaactatttaagcggttcctcatcactctcttgggatacctgcccctgagctgggaaaacacagctattgggaaatattttcagtctggtctgaagagctctggtcatacacaagcttcttccaggtggtgcatggaggtggtctctggttgcattaatgcttataacgtgaaattgctgtatgtttttgttcctggcgtgagttaatacattatccagtcttcacagtaattctgatgattctttttttttttttaagtaagactaggaagtacgggtggtctatgaggtattttgctcaaactaatatatgaactgcaaaagattgaattctgcatgtgcccttatgagtttctaccttaaaagtcatttcattaagttatttacttgaagtacattacatttagagctcttaagccctgcagtaagcaaagaaccacaatttctggtaggcagaatgactttacacttactctgtgtccaataggacctttaggacctgatatcccaacaatgccagcatccccttcaggaccctagacatacaataagaaacaaaaagataaaatttgtagctctatatgaacattttacaaaactatataaatctatcaagaattgctcttttaaaaatggaatataatactgttgtgcatgctgaagaattcagaaggaagtgtactgaggcctacaatttacttagaaatacaccaatgaagggagagagggatacgtagatggataagcacaataatgccagcagggtaaaatgttaatggtaaaatttaggtaatgggtataggcatttactgtaaaattttctcaacattgctgtatgtttgaaaattttcataataaactgcttgggaaaagggatgaaagaaaacaaaatcatatcatatactaaaatttctgggaaaatgtatagttacataattttaaaaacagatgtattcgaaactcaaatatataaatatgtaccaactgaaattttacagatttaaaaaagctcaagttacagactatattatttcaacagctcttttatttctagatagctagaagactagaagaaagtatgtaaacatactttagggcctgggaatccttggaaacctgtcaaaccttgaacaccatattctccctgcaaagtgaattgacatgataataattattgtacaatggcagcctgctctgtagaataaatgcttggtgaatttctgaggtggtacatacaggctgccctttcaggccagggtctccacatggtccttgatcaccttgtgctcctcggtgacctcttttaccttgaattccaggttgaccaggtagcccttgttcaccctatgggtagaacaaagaaaagcgatctttacatcagaacatataaacatattggcttttgaatgaaacccaaatacaggcccatccttaggcccattccataaatacaaggcactggggaaatcaaattttgcatgttcatcttgttcaccaatattttccacacaagtagtatttaattataatgtaccagaagagtagcagtgggaaaaggaaattccagagattgtggtgatgtgtggaaagaagagggaagggggaacctataaaactagtaggatagtaaggcttgagaggggatagtgagggtgtggtatgtgtgggtgtgtttatatgtgatggaacttatattttgtttatttatttattttattttttattagagatggggtcttgctctgttgcccaggctgtagtgcagtgatgtgatcatggcttactgcagccttaaactcctgggctcaagcgatcctcccaactcagtctcctgagtagctgggactacaggcacacatcattgcacctagctaattctctatttttttgtagagacaggatctcactatgttgcccaggctggtcttgaactactagcctcaagtgatcctcctgcattagcctcccaaagtggtagaattacaagtgtgagccactgtgcctggccagaacttgtattttgaattgatatcatttttctgtgttttccctaccatccagagatgattcagctatctaataccagaaaaagagtagtctcctgaagtgtaaaccctggttttagccatgattatctttttaattccatcaataaaaaatttccattatctgtctccctagattcctttgatatgaactgtctttatcccctaaaagtcactttaagtacatacttaatcaacattattgaatttctaaaagtcaagtcttttttcattgatttttatttttgaaatgagagttgaaatatctttcacaccatttctaaaagtaaatttaggaatcaggtggattttagagataggttaatgaaaaacgatgcttggtagactttggccaaagcttctttaagattaacaaattatctctcactgtcttgagacaaagctatacaattttggggtttgacaaatatggatctttcttattgcaaattcaagcctaaaacatgggatctttacttcttttcctggctttagcatttgcttagctgctttgaattttagcacaaaggaatattcatggtataaacattaacagaagactaatattgtaaacagtaaacaagtaggtcatgattttcagtttacccacatgggtcagaaatctgaaaattctttagaagtggaactgggaaaatcaggttaagaggtaataatggtaagggtgccaatgtcttagtcttaggcttttatgaaagagctttagatgttggactaatttctaagttgtctgggtcaatcctgtatgagatatttctaaaagaggttttgtctggaaagtctattgacatgtgacagactccacacaataaatgcaatataagacttagttactgtcacattaactctaagaaacagtctgtacggttatcagattaattaattggttggttaggttcagagtcagaagaaaaggaattgtatttgagaaagtatttatctggaagtaaataagatttccctgttttggaggagaagacagatgacagagaaggaaaaagaacaaaaatgagtcaaagacatagcattttttaaagcatcactagtcctgggtcaaagagttgttatgacaaattacaggcactgtggctatcatgggagatggatatgtcaaaactacatactttctcttttcctaacgtgcttttactattagccaaattctattaaaaactattaatcttaccattctgtgatctagccaatgaactcagggccagaaaggatggccaatactgcttacccattggaacaaaatattaaagtacctttgggccttgaattcctgggcttcctggcaagcctgatgaaccctttactcctggaggacctggagccccagcaagacctgttcttcctgggccgcctctgatgccctaaataacacagataagaaatgaaaactgggaaagtttctaaaaagtcagtttagaggctcaataaaatgtaggaagagttgtgccccgaaaggcgtctgttaacatactgcccaggagttatcctgggcttctttcccagaagatgaaatgtttaaatacttttttaggaatactcaccactcacttgaaatttctataatttatgcaatgatcttgggtttttaaaatgaaaacactaaagcaatacgaagtccaccagtaccttcttacttataaagcctaggtgtgaagtatgtttgttgtgttctaacttttgtattatactctggtgtacatggcaactctaataactgctgaaagtctccttaagaagaaaattctattcctcaaccatacatgattccagaaaatttgctaaaaattgtttaactggaaataaagttaagcaagcaaacagtatatccttaaaactaaatcctaaatcaggttggcaaactacactttgcaaactaaattcagtccatcacctgtttttgtagatctcatgaactaagaacagtttttacatttttaaacattgaaaagaataatacttaaagacatggaaaaattctatgaaattaaaatttcagtatgtattaagttttactggacagtcatgctcattcatttacatattgtttagggctgcatttgcacaacaatagcagagctgagtagttatggcagagtttttttttttttaatttcattttaagtttccgggtacatgcgcaggatgtgcaggtttgttatgtaggtaaatgtgtgccatggtgatttgctccagctatcaacccatcacctaggtattaagtccagcatgcattagctatttttcctaatgctctccctctgcctctgtcccacctccaccaacaggccccagtgggtgttgttcccctccctgtgtccatgtgttcacattgttcagctcccacttataagaccatgatatgtttgattttctgtttctgcattagtttgctgaagataatggcttccagctccatctatatccctgcaaaggacatgatctcattcctttttatggctgcatagtattccatgctgtatatgtaccacattttctttatccagtctatcattgatgggcatttgggttgattccatgcctttgctattgtgaatggtgctgcaatgaacatacgcgtgcatgtatctttatgatagaatgatatatattgctttgggtatatacccagtaatgggattactgggtaaaatggtatttctggtattcctggactttggttccttaaggtcttcgaggaatcaccacactgtcttccacaatggttggactaatttacattcccatcaacagtgtaaaagtgttcctatttctctgcagccctgcaagtatctgttgtttcttgactttttaataattgccattctgaccggtgtgagatggtatctcatcgtggatttgatttgcatttctctaataatcaatgatgctgagcttttttttgatatgtttgttggctgcatgaatgtcttcttttgagaaatgtctgttcatgtcctttgcccactttttatttttttaattttaattttattttattatgttttttggagacagagtcacgctcagtcacccaggctggagtgcagtggtgcgatctcggctcactgcaagctccacctcctgggttcatgccattctcctgcctcagcctcctgagtagctgggactacaggcacctgccactacatccagctaatttttttgtatttttaacagagatgtagtttcaccgtgttagccagaatggtcttgatctcctgacctcgtgatccgcccatctcggcctcccaaagtgctgggattataggcgtgagccaccgcgcctggccctttgcccactttttaatgaggttgtttttttcttgtaaatttgcttaagctccttgtagattctggatattacacatttgtcagatggttagattgcaaaaattttctcccattctgtgggttgtctgtttgctctgatgatagtttcttctgctgtgcagaagctctttagtttaattagatcccatttgtcaatttttgcttttgttgcaattgcttttgatgtttcatcatgaagtctttgcccagcctaagtcctgaatagtattgcctagattttcttctagggtttttatagttttgtgttttacatttgtctttaatccatcatgagttaatctttgtataaggtgtaaggaaggagtccagtttcaattttctgcatatggctagccagttcccccagcaccatttattaaagagggaatcctttccacattgcttgtttttgtcaggtttttcaaagatcagatggttgtaggtgtgtggtcttatttctgagttctctattctggtccgttggtctatgtgtctgtttttgtatcagtaccatgctgctttggttactgtagctttgtagtatagtttgaagtcaggcagagtgatgcttctagctttgttctttttgcttcagatagtcttggctatacgggctctttttttgcttcatatgaattttaaaaaatagttgtttctaattctgtgaagaatgtcaatggtagttttatgggaatagtattgaatctataaattactttgggcagtatggtcattttcacaatattaattcttcctatccacgagcatggaatgtttttccatttgtgtcctctctgatttccttgagcagtgttttgtagtactgcttgaagaggtcctttatttcccttgttagctatattcctaggtattttattctctttgtagcaattgtgaatgggagttcactcatgatttggttctctgcttgtctgctgttggtgtatgggaatgcttgtggtttctgaacattgattttgtatcctgagactttgctgaagttgcttctcagcttaagaagcttttgggctgaaaagatggggttttctagatataggatcattcatctgcaaacagagacaatttgacttcctctcttcctatttgaataccctttctcttgcctgtttgccctggacagaacttccaatactatgttgaataggagtgaggagagggggtatccttgccttgtgccagttttcaaggggaatgcttccagcttttgcccattcagtatgatatcagctgtgggtctgtcataaaaggctcttattattttgaggtatgttctgtcaatacctagtttattgagagtttttaacatgaagggatgttgaattttattgaaggccttttctgcatctactgagataatcatgtggtttttgtctttagttctgtttacgtgatgaattacatttattgatttgtgtatgttgaaccagccttgcatcccgggggtgaagccaacttgatcatggtggataagctttttgatgtactgctggatttggtttgccaggatattattgaggattttgcattgatgttcagcaggaatattggccttaagttttctttttttgttatatctctagcaggttttggtatcaggatgatgctggcctcataaaatgagttagggaggagtctcttcttttcaattgtttgaaatcgtttcagaagaaatggtaccagcccctcttggtatacctctggtagaattcagttacgaatccatctagttctgggtttatttttggttgataggctatttattactgcctcaatttcagaactcattattggtctattcagggattcaactgttactggttcagtcttgggagggtgtatatgtcaatgaatgtatccatttcttcttgattgtacagtttatttgcatagaggtgtttatagtattctctgatggttgtttgtattttttgtggggttagcgatgatatctcctttatcattttttattgtgtctatttgattcttctatcttttcttctttattagatagctaatgatctatttcatttttttttttcaaaagaccaactcctggattcgttgattttttgaagggattttgtgtcttggtagagatcttatatggcacttccattgctttgtactgttgcttggtgtactacaaattgcagtgatgcagttatagtgtttcaagtggaacatatattactgtgacactttattttacgtattaccagtgcacatgctatcatatcaaagcaagaaaagaaaagtggacttcgaatattgtatttttaggcaccatggaaaatgaattttcttattgaattagatggcaaagccttgtatttactatgtaatattactatagctatgcttaaaaattatacagtatatatcaacattatcagactaggcacataatataatatttctacctcacaggaatgcaacagtcagaaaaattggaaaatgtaacatggagtattttatcacagcagaatttcttcacaacaaaatgaaaatgaggctgcaactgaagtaagtttctgagtgttcacttcatttgttagcccaataaggaaaatcccttattgatgacttaattaaatcacatagcaaaaatacacttatttaagattgttagctttttggcaagaatagctgcttgaaatgttgaggacactggtacagcatcaacaatcaattaaaaaagaaggttctttctttttttcttctctccctaccagcacggcctgttggttcttgatgagtcaatagaaattagcaatactgctcagttgctcattcaaggagtcaatgctgagtatgggaaggagtcaatgctgagatggaagaattgtataaatagtctgtggggtaactgcaagtgagaatattttcaaagaagtttaaaaaaaacactaaatcagtacaatcttctgtggattctgctaagatacaatacaactgacagctatggatcaaaaaaagaattattggataaatttggaaagcatatggtgggtagattttctgaactcaaacagtttcagtagcatatcttagacctagatgcaataaatttccatatttcaaaatcgatttgactgtgcacttgaggagtttccacctagcttacaattggaaatgattaatctacaaggaaatgacatgctaaaaggcaaaatcaagagaacctaatagaattctggatattgttttcaagcaatcagtatattcaatgaaaatcatacgctcatgaattgcagcatttggcagtacctatctgtgtgaaaaaaattttcaaagatgaaatatgtgaaatatgcaaagtctcattacaggccaatattaacagcattaacaagtgcagaaaattcttacaatagggaactgtaataagatcactttacaggaaaggcaagctttaaaaacaaaattcttatgtatagcaccctccccaataaaacagaaacagctgaaaacctaaagaaacccacagagaaagcagattttaataagctaagtgttatcctatacaaagcatgacatttttctcattactagtcttgcattacaaaatttttacttaattatatttttaatttcatgaataaacattttgtgaacagtttctctcttcttacataagttcacaagtaatacccttgagtttgcttcctgcaaatactaaaatttattcatatttatatgaatatttacagaaatatgttttcatatttacagaaaaagtttgttgacttctcttctaggaataacttattttctgagttgattcctaggatattaaattgggttattcaatagtttctccatgtattcaacaaatatttattgaatatcatctatgcataaggaagctaccatgggaatccctttaaaaatatagatataaataatatatggttcttgtttttaagaagcttaaaattaaatgaaaaagatgagaccaggtgtggtggctcatccctgtaaccccagcactttggtagaggctaaggtgggaggattacttgagcccaggagtttgagaccagtctgggtgacacagtgaaaccccatctctaaaaaaaaaaaaaaaaagaaaggaaaaaagtagttaccagggcatggtattgtgagcatctgtagccttagctgcttgggaagctgaggtgagagaatcgcttgagcccaagagttcaaagatgcagtgagccatgatcatgccactgcactctagcctgggcaacagagtgagaccctgtctcaaaaataaacaaataaattaataagaaaaagaaaaacaaaaaacgaaatgtgatggaatgtactatataaataattataatgacagcaaaagttttaaaaaaattcctaagaagagagatgtaatgtaaatacctgagaggttctgaggaggggaagttacctttagtggtaatcagaaaagaaattagtgagaagaaactggatcatgatcataatataaagatattgcccttaaagttataaatgtggtgggagagatgttttggctcaagacagactaaagccatttctgtggaaggtctggttgagagaatggtatttaaaaagtaaagtcaattttgaatttagtaccaaagcattttttccttttttttcaaataacattttcttcatattatgtcatcacatattttattattttcttgcttatggtaaaagataattaagtatatttttaaaaattatcctttctaagtagattttcctcacattccaaaactcactaaaataatgtattttgtatctaaggttcatctccaatcctgggtgcttacagggaggtacatataggatataggttcatgttcctcagcttgacctttaagtctttttttgtcccaactatctctcaccatttatctgcgttagtggggctcaatattttaaggaacaaattacaagggcaaaatcctcacagaaggagaaatagaggaagagagaggaaaagaaaaagggagaaagagaaggaaagagagagagagagaagaggagggaaggaaagagaggggagagagagagcgagagcgagagatccatgctgtggacttaggattcaggtgatgtagttcttccaagttgcttgtgcctcatcctaagtgtattatcttatcctgtttctttcccctggtttctatgtgttttatatttgttttaattttccatgagcctttctgttccatacctatgggatacattatctggtagtgtactttgcacatgaatgatgagaaccctggagtcatgagatggtgccattttagagatcatcaatacaaatgatagtcatctgagactttgggatttaaattttcaaaaatgttcagaaaagacataggtgttataccaatgaccaggtctctaatggggatatgacttaacaggaaaggcaaattttaaaaacaaaattctgatgaatagcaccctccctaataaaaacaaaaatagtataaagacctaaagaaacccgaagagagagcagattttaaaaagtcatatatacaagatgaaagaaagggcatgtaagcagcaaaaaaaataaagtaaaaaacaaagtaacttcagagttaaaccaactgaaaagttaagttatagatgtagatcgtgtgagaatttttttaaaaagcattaggttgtcttgcaagtttgtgagcctcttatctccagatattttatagaggtaatggatattttagggagacgcatcattagaactgattatcctagatgattttaagatacctcaaaattgcataattctaaaatagaaccattttgcctcactttacttataattctaggcaattttaaagttcttcattttctaatataaaaaatgtatctttcaggtgatacatgacaatggacattcagaaactactgaccactcttgaagtcaagatgtacttttgactgagaataataaggagcacaaaacttgtcattagggttaactgtaaactagcaacttcattttacttgcagtgccatcagatatttaacccagtagaatgaatatagtccaagtcatttactatgcttgttggtttcttagagagaaatttgaggatgatagcagagtgttctgttcaacgttccaaacaatgtttcatacaagtaaagaacaaacatttcttattacacagatggctgattaattttgtttgcaagagaaacagatgctaaccctaggcattctttccagtgtcttctaaatgatttgtctaaaacaattcagcctatgttaaatcattctgggtaaattttaaaaagtaaatataattataattattattaactttggtcagagatgccaaaaatcaatgaacagcttacatgtgtattaaaaattaatataattataagagtacatggtgtcgcatgaccagagacttcctttattctcagataggagccagtctccctaccgaaataagttttaaacctagcaggaaagtgttgtcagttttgacaggactgaaacccatggcttcctaagcctttggactctaaagaaacaagtacttcgatcagtaatgacaacaacaacatcaaccacaactgcaagagttgctttttattgagtgcattccatttgtcagaaatgaatagcattatggtttgtattattttatttgatctggtgtcagttaaggaaagaaggcattgcttttcactttgacttccctctgggaaaaggaagaaattgttttagtgcaagtctgccttcattttagaactgaatggaaagatctgggaaggaaaatggtgctatatgcacacatttagaaaaaagatacagagacaaattttggaatgatgattacttatttgtacataatagtgaaacataccaaagaaagtgtcactctgttattcccccagctccttggcttagccgtcatattctcattaggattgaaacaaatatattaaaaaataagcaataaaaaataaaatttgttaaatccaggcaacgataaaaatctacattctaaaaatagctaaaaatattatatttaaagttatgctgagtgaaattacaaatatttcgaatatcaattttattgatttctcatagtagaatgacaaaatgacactgaacttcatattggttgatatttttctttaaagtactaccttaacatttttctaaaaaaagttttttcctttctcttctgccaggcaccttatgtgtacagagcattatgtttatatagttattaactatgtgagaagataataagaaaaattaatttaaaattaatttactttctgtagtacaaatataatatcctagattattaggcaatgtaagtactattttttttcttaagccagcaaacccagaagttatataaataatactttacttcctttagtctgagcaactcaaaacacttctgtttaagtaggaatttctcgttttatttggtttactaaatatatcccttcctgcaaaggattggtgtttaaaaatatgtgggatggtaattattaggtgattatatgcaaggctacattttacataaataatgtagcattcataatattttcctgccgtgccaatcataagtaatgtagccaattgctagaaataagatttatgaatgagctatatactaaagttaggaggtaattttagttttgaatttctaaacatattaaagcttatggaactgagagtacagctgaggcaggtcgtaaggtagtgaagacaggtctgtttgactcacatcaagggtatacaatctcttgctcaaccttaatgaatacaggtatttcaacattgttttacttcacagaaattatttacaactgatgttttatcaatcctaaaaaatagtgcaaatgtcactatgatatttgacaaaataaaggtattttatgaaatctcctttacccaggtcttgacatccaatcacaggactaacagggactgaaagaagatgtttcatctatactttgactcttagatatgtctgggttcacatcattatagagaaataaatgtctatccttttattcaaaaaattacaaataatctactcatactatcttatttgattctcccacaaccctgtgaacacaccaaactccatgagggcagttttttgaccatgattaactgctatattccctaactcctggctcttagtaggcacgaaacaaattattttttgaatgaatgcatgtaagcttaaccatttatatttattattatgaaaagatgatacccaataaatacatgcagtgtactatgcattttacatacaatatttcatttgattcttataaaaaccatatggattaagtataatactattgtactcattttataaatgctgcttaagatgtcaaatacctatcgcatctagattttaaacccaggtctccaagatcctaacaactatgcaaagaacattcaattcctggccgggcacggtggctcacgcctgtaatcccagcactttgggaggctgaggcgggtggatcatgaggtcaggagatcgagaccatcctgggtaacatggtgaaaccccgtctctaccaaaaatacaaaaaaaaaaaaattagccaggcatggtggtgggcgcctgtagtcccagctactcgggaggctgacgcaggagaatggcgtgaatctgggaggtggaggttgcagcgagctgagatcgcaactactgcactccggcctgggcgacagagcgagactccgtctcaaaaaaaaaaaaaaaaaaaaaaagaacattcaattcccaaatgtttattgatcttctcctatgggcctgacatggtgctaggtgattctacaggactctttggagagaaagaaagacaacatccatgctctgatggaggcagtgtactgagcatccaaaagttcagagcagacaagctcaactccgactagaaaggtgagtgaaggaggtaatagttcagttaagtcctaaaagatcaccataaagttagagggaaaaatggaagagctttctaagcagtggaaataaagtacacaaaggccagaaagtgggggaaataatagaattttgggggctaagtaaataggcatacttgaagaagcatagctctgaaactaagatgcctggtttgaattctgattggattacttgttgtctgtgtgaacctgcggaagttatttagtctctctcggtctcagcttccttttctgtaaactggatataacagctgtctctacttcatggaggttttgtgagggttaaatcacttaatacacatcagcacctggaacagtgcctgggatacagtaagcgtttaataactgttagctgtgattatgactgaaatgcacagcacacatcagaagcaaggtagaatatatgtctggaaatgtcaacagaggctagaccacgaagaaacatcattccataaaaagtataaaccagccgagcatggtggctcatgcctgcaatcccagcactttgggaggccgaggtgggataactgcttgagctcaggagttcaaggctagcctaggcaagatggtgagatctcatctctacaaaaataaaaaacaataaattacggaatgtggtggtgcatgcctgtagtcccagttacttgtgaatctgaggtaggaggatcacttgagcctaggtgttcaaggctgcagtgagctaagatcacaccactgtactccagcctgggtgacagagagggaccctgtctctattaaaaaaaaaaaaaaagtatgaactttatctgatcaggagtcatggaaaattcaactaagaaagttaaatcctttagcagatatttcgttttgttgccaatacgctgccaaatacactgaactttgttgctctggaagagttcctaatgagtagaaaatgggccaaaacaagcggcggggttgggggtcggagggagggaagaagtaccaatcaggataagccataactgaataatcaacctcttaataatgagatgacaggatttgctaaatgtaggtctggacaaagaatgtaggtctctttctccaaaatactgtgaagaaaaaagtgtatcttcttagaaagaaaagtttctttcgtgtgactagcctatgagaacacacagcccagatgggtggcagggtagctggatttcctaatagaagcttcgatggtggtcctactacaaaggtgctgatgaagtgtgtttttcttccttatactggacacaatccacaaatggaaaattcaggattttcaatgttcctttaagacaagaaactcattttagacaacacttatgcttgtgttcacctggaaaactgcaaagtcaagattgaaaggccttgatttgtccttagtcaagtcgttagttttatttctttccctcttttccaatgaccagttttattagttacagcaataaaaaaataaaaagactggtaagcattccttttggtgataaatggatttatgatatttgcaaggaaaagttgttttgctttttcctaaatgactgaggtactatgcttgtacagaagttgaactcgatgaaaacatcatggtagactcatttactacagatgtgctaagttgactggcctcaaaacactcattttcacagaaggaaattcacacaggcaacggtgagcctcccctgtactgtccctcagttacagtcacatgatcttgaaaaaacattgaaactgcagagtgaatatgccaagaattctttaattccttggccacataaaagaaagaaagaaagaaagaaagaaagaaagaaagaaaagaaaagaacattgtttaggaaaatcaggcagttgcataatgctaaaaatcccagaataaatatttttctcagtggaaaaacccagcagtctttaaaggtaagccaaggaacaccatggtgccatgactaaaaaaaaaaaaaaaaaaaaaaaaaaaccaatggaaagatgtccttatcctcggttgaaaatattccaaggaacttgctagtatttagaaatggtcttatttcctcttaagtagtttttctattaccacagtaggtttgagaaatacttctcttagaaatcactttccctaatgcccagttagccattactaccttgtttcactgaacaacagaatgattccttataaagcactataattctaattccatatcaaatattccacagagagcagagacatttatagaaaagatttccatgtacataaataccaactgcatgtgcaaaccttggggttacaaagggatcctcaagagaaaattattttatttttattttgatggatacaaaacatttcaacacatgacatcctaatattctaagtatgcatgtaaaatttgtctaacttgttctgtgaaaatgctaaaaagtagcagatgatgacttatgatctggtagttaattgcttgctaacggcaacattagttaccattcaacttcatggccctaggaggtatgttgcaacagtatttaacattactgtaatccatttgtttctttcaaagtgcaatgagctttctgtaccagtcgtacataaagggacagaatctgttctatggctcagaatctgtttttataaacaatggttcccaattagagtaacttaggaagaggagctagaatatgcaggttttgttgtctaattcatactcagattttcccttcccttgactgtcttcaacctctccatatttactaggtccttctgatgagcatttaaatgtcaggattctcacatttaaaaataactttctactttaaatttattctctggtcattgccctattttctccttcagaaccaaatgtctccattgagtggtttgaatatcctgattttctcactgtccactctctctcctcaggaacgtcaatcctattcctgcccccaacctgacaagattctttgctaaagttactgatgacctccacttactaaaatacatgaacataatttcattttattagatctgcatattagtcagagttcttacttgcaaataccagaaactaatactggataataaaggcagaacagacattgaaaacacatttggtagctcatataatcacagataaacctggagaatcaggtttggaaaatgagcagaattaaagtgatgtcaggaagccagaatttgaacactacagcgtgtactacatctgctgttggacattgaacactattactgatgcaaccgtcatccctggaaactgggagctgttgatgttactgccactgccaccacaacagactctccactgtccccgcctctgtgtatcactaaatccccatttgaagatgaatataactaattgatcaggcctaggtcagagcatgcatccttgtttcaagtgacaaggaagtaaaagtttggaacttctggctactgcagtaaaagctggcctttcaccaaaactcaaaaagagggatttttaaattaaaaaaatgggataaagatgctgagtagcaaaacaaacacaaaatgcatctacaacatcaacacaaaaaccccacaaaaaacaaaattaataaaacaagtgtccaacacagtttctcgagattattagatatgttgatgaggttctcctttttgaaatattctttcttaagtctccatgacaccacattcatttttttcttacctattataatcactcctttcagtctttttcctcctgtatctgactgttaaatgttagagttcctcacagcttggttctggacctccttcccactgttcaacaaaatttgtgtttgttttctttcatttgctccccagatccatttaccaccccttctctatcttgcaacttgtcctgcgaatctgactttcaatgcactgcatcgctggggttctcttgacctctggcttccagttggggttggccagtgtgatgcaccactaggatattgaaaagtgagaggagagaaaggtaatatatttatttctcccatttccttctgtctttggcattccataagtggttgggttattctcaactatagctcctgtcagatgcctctttccagcagttcctgatctcaacttgattctagtaacatcatttcttccctttaccatttcaggtctaaggacagtaatggcttcctactgttgacagtctctgggtttcccagcactctttgttgacttttttaaccctttctacatttctgtaggtagtttcctcaaaattccaattgagcattccatctgcttcctaacaggactctgactaaagcatgcatgtgctgatgactcacaaattcatatttgacctcctctctcagctctagctgaggatatttaattgctaacttaatatctccacttgaatgtcataatcttgctcacaaaatttaggcctcctataatatttgctttttcagtgacgggcagacatcacaaggtattaagttggaaacttgtgcaagttagaaatttggaagttacccttgatatctctctctctccctcatgtctcccaatcaaatatcaagtcctactaaagccacctcctaaatagtacctaaatccatccacttctttccatttacacttcaccagtctagttcaaaccgtgaacacctatagcctggagtactgcaaaagtagtcttattagtcttctgcatcttgtcttgtccccttccaatccatttactatactgaagccagagggaatccattaaaaatgtaaaattgaattggataatgtctctcctgagcttaaacctcaatgaggtctactctctttagataatgctcaattaccttaatacgtccttcaatagcctccatgatgtggtcattgtatacctcaacagcatcaaaccatatcactctacaccttgctcaccaaactttagccgtactggtctttttttgattctttaagcacatccagttcttcctaactttgcatatgctgtggtctctgcctagaatgtttctttcctgctttctccacctataattattattattcccaatttacaaactccagttatcttttggtatcatctctctcctcctccccactcatataatatatgaatttatatatgtagataagatatttatctctatatacctatttcactgagtataattgacacgaagtaaatttcaaagtatataatttgataaactggcataataaatatacctattaaaccatcaccactatcaagataacatatccactacccctagaagtttttcctattcctttgtaaaccctcctttccacacctccccacatgcacttctatctcctgaaaacccgattagctttttatcattacagattattttgaaatctctacaattttatacaagtggaaccaaacagcatgtatctttttgtctgtttttttccccactttgagattcattcatgttgaagcatgtatataattctttttcactgagactaatatttcattgtatacatgtactagaatttatttagccattcactttttgatggacatttggttcattcctagttttgggctattacaaagaaagctgctatggccattcatgtgcaagtttttgtgtggatatatgctttcatttctcttggctaggaatagaatggctgggttatatgttagaaatatgttaaacatttttagatactaccaatatataagataattgacatcttaacaatatagaggctgggtgcagtggctcatgcctgtaatcccagcactttgggaggctgagatgggtggatcaccaggtcaggagtttgacaccattgtgaaaccccatctctactaaaaattttagttagatatggtggcatgcacctgtaatcccagctactcaggaagctgaggcaggagaatcacttgaactcgggaggtggaggttgcagtgagctgagatcatgacactgcactccagcctaggtgacagagcaagactccatctcaaaaaaaaaaaaaaaaccataaacaaacaaaacaaaacaaaacaaaaacaacaatatagagtcttatgatccagagacatagtatatataccatgtatttaggacttctgtaatttccctcagcaatgttttatagttttcaggatataggtttgcactttttttttttggtgagaattatccctaatatttcacattctgatactactgaaataatactgctttaaaattttccatttctgattgttaattgctagtacatagaaatacaattaattttgtatattaatcttgcaactttgctaaactcagttttccgtagattttggatattctactagacaatcatgatttctgcaaataaagacagttttacttcttctattccaatctagacatcttttatttcttgttattacactggctagaacctcattgaattggctacaacctcattgaattgactagaatttccagtacaatattgaatatgtcatataaatatgagaaggtaatacatatatctgtgggcatataagacatcagaatgtttgcctcacaaagacctacattaaaaataatttttggagaaagcattgaaataataatagaaaaaattcaggagattctgcaaagaatattgaaagtattggttatcaaatagcttaattaagtttactatttaaaaaggagtctagaaataacagaaataaaaggagaaagtaaatgaataaagactaaaagtgaaaaattgaggcaaaatacaaaaatgatgaaggagaggagtggtctataaaaacaaagggatatgagaatatgtgaaagtgttttgttagagggaagatacaggtagtgatacgttcaacaaatcaatagatttaaataaatacacacttggttattatgttcagcagaactgcacaagaggaacaacaaaagaagtaatttttaagccagcagaagaaactttagtcatccaatggaaatgaggaaagaaggagaaataaaccccaaaaggatagtacaggtgcattagtccattttcacgctgctgataaacacacctgagactgggcaatttacaaaagaaagaggtttattacagttccacatggctggggaggcctcacaattatggtggaaggcaaggaggagcaagtcacaccttgcatggatggcagcaggcaaaaagagagcttgtgcagggcaactcccgtttttaaagccatcagatctcatgagacccattcactatcacgagaacagcatgagaaagacccactcccacaattcagtcatctcccaccaggtccctccaacaacatgtgggaattatggaagctacaagatgagatttgggtgggaacacagagccaaaccatatcaacagggcaaaggaaatacagatttcagatggcaaatactcttttttttttttttaggattttgttttgtcacccagtctggagtgcagtggcatgatgatacttcactgtagcctctaactcctcatatcaagcaatcctacttcttcaatctcttgagtagctataggcacatgctacaacacccagacaatttttaaattttctgtagagacagggtcttgctatatcgcccaggttggtgttgaagtcctggcctcaagaggtcctcttgccttggtctcccaaagagctggggattacaggcatgagccactgcacctgggtggcaaatattcttaatgaagaaattttagatgtattccctgtaacatctggagcagtagaagaatttctacgattgctgctattgtttaaaataatattcaaggtcacttgcatggaaagtgaaatggaaagaaagaaatacatggaaagaaaaataaatgaatctaaggaaagagataatgtaaggaaggaaataaatctgccattatttgaagatgatattatctacctaaaagcccaatagaatcacaacagcaaattatttgaaataaaaaattcagccatattagactataactgatacaaatcagtagtgcttctttaaatcagtaataactacctagtaaatagaataaaaataagaatataaaaagcctttactgagtggcaatattgcagatttataaagacaaaaaatatggagttttagactgcctttgtcgttatgtgactgtagaaattacttaatttctcagtgcctcaatttctgcatctacaaaataagaaatataattatgcctacctcatggggttgtaaggattaaatttgttaatacattaaaacacttatggtacgtgggcaagttctaagcattgtatgaattttgccatgactattatgaagaaattctattagaaaatgatagaaataggccgggcgcggtggctcacgcctgtaatcccagcactttgggaggccgaggtgggcggatcacgaggtcaggagatcgagaccatcctggcgaacatagtgaaaccccgtctctattaaaaatacaaaaaaattagctgagcgtggtggcgggcacctgtagtcccagctactctggaggctggagcaggagaatggcatgaaccaagggggcggagcttgcagtgagcggagatcgcgccactgcactccaggttgggcgacagagcgagactccgtctcaaaaaaaaaaaaaaaaaagaaaatgatagaaatatatatttcctccttttatattaaataactaaaatgataagatacaaattttctccaactaaatctataaattcaagacaaatctaataacaattcaacctttgttttatttttagagaaactcaacaaactgaatctcaaattatgtggaggaataaaagtctgtaactagctaatcaaccttaagaaaagaatttaaataagggagacttgcccactacatataagaacatactacagagccatagtaataagaataatgtgatgatacaaatagaccagaggtcagccaatgttttctgtaaaagggccagacagtaactctgttagactttgcaggccatatggtctctgtgtgaattattcagttctgctgttgtagtgcaaaagcagccatatgtaaataaattactgtggctgtgttccaataaattaatttatgaataccaaaattcaaatttcatatgtttttcacaaaacattcttcttatttctactttctaccactaaaaaaatgtaaaaaccatttttagctcatgggccatacaaaaacaggctgatttgttcaccaaatgtggtttgctaatactggaatggactgctgatattgactcatgcataaatgagaactgttaaacaagttggctggattttatctgtttgccttttgagatccagtctccaccctgctctacgacccagcaggctcctttactctagctgttggccagtgccttaccaaaggggtatgaatgggaatgaagtcccctgtagtcacaaggcagatatgactgagaacccaacccactgtaaggcttgcagaatttgcatattaatacatcttcatcttcaactagccagattctatgctaagataagagcactggtggagaaagagaagaactccaagacaagaaatggggacatttgaacagacatgggcaagactaagaactctgaacctctaatcctgcttaaccttcctggcttgtggaggcagcccctactcaagtgcctgggaacaccattaatagtccagtagattggcaatttgaagcctggactcgattgtggcctacagtcaatgaggttgaaatgctataacttccctcacaatagaaaggggttcaaaggcccaggaagatgaaaatgtggagataactctattattgcaatcgaatcagctaccctctaaccacagcccctggaagggctcaaagagcattctttaccacagagttaagaaacatcattggaaataggttctctgatataaatgggaacactggaatccctgagtggtagaatccaggtcatagtgctttgctatcagagaaaaggtaggagcaattatcacaataagctacaatgatggagtggaatcagactgttttgcacagatctgtggtgatggttaattgaacataggagacataggaattgaatataccatagtgtactagaatatattaatatacaggtggaaaaattgtaggtcttatagatataaatcttacttaagtcactgtgcttgggattcatgtactctcactcagttctcagactcaagccagttcctagatcagaatcccttgattgagaaggaggtaggttctctttgagaaaaaacactgcaatgtggtcagagatgtatactacaactcctcccctaagtattcttgagagagacctatggtcatttactaggtgactgaacactgggaaaagacaaattccaagtctttctagagctgttaagatactagttataacctgatgataatccctggaaataaacactgtggtcagagtggaagcttacgagggtcaagtgataaatggagttttcatccaattccatttccaagtgggtccaataaagactgtgagctcagtttttattttctcccctccaatctcagagcatagtgaaacttcctaactataaaggctactactatggtaagatgggaagacacaaatgaatgttcctacaactatcccttcctgtcccctcctcaccaatataaatctaatgtaataacacatccttgtgaaaaactgtacatattactcccatccctgtggaaaattgtacatattattgccataaaggcctgaaagatacaggggtagtgattcctactatattccctatctgttttactcatgtgtttggctagagcaaacaacaaataaacctgaagaaagtggtagtgtattacaaacttaacgggttgggggatgatgccaattacagctgcaggttctgatatggtatctttactaaacaatatagccactggcaacaacagctactgacctagcaaaaatatttcctatccacattcttatcagtaaagataattggaagcagttttcttgccttcatgtggcaggaaaagcagtatcccttccctgtcttagctcagtgctatgtcaactcaatttgcttctctgtcataaaacagactgagcagatatctttatattctggatatctcacaaaatatcattcaggtccattaaactggacttggagagtagaaaagaacaagcaccctaaaggtgtaccagaggatagaatttaaaatttcaggggcttgataaatgggtgtaatcacccaatgggttctccctgcccgttgcacagacaaaaataaattcactgagactgcagcattgcagtagagtttaattgatgcaaggctggcccacatgggagaactggagttatcattcaaatcagtctccctgaaggcttaaaggctagggtttttatggacaatttggtgggcaggcagctaaggaatgagtgctgctgattggttggggatgaaatcacaggggtgtggaaaactgtccttgtgtgctgagtctccctctggatggggccacaggatcagttgagtcatgattcatgagtctggtggagtcagtcagaaaggtatctcaaaaaacccaatcttatgttctacaatagtgatgttatctatagaagcaactgggcaagtcgcaaatcttgtgacctctggccatataactcctgagcagtagggattatagaaactatacctatcttgtaatcttggccacatgactcctgagcagcaaggaattagagaaactaaacctacatgttagtagagttcaggtctctcccataatcctattcttgtgggctttaattagtcttacaaggcagttttcattccctgagcaaggaaggggttaattttaaggtgggactattgtcattcttgctttcaagttaaactataaactaaattcttcccaaagttagcttggcctttgcccaggaatgatcaaggacaacttggaggtcagaagtaagatggagtcaattatgtcagatttctctgactgtcataattttgaaaaggcagtttcatgggtgaagttccaggaataatagtttgggggcacatcaggatacctcctccaaagtagagataaattgttgtactttgcactgactgaccatcacaataaaaggggcacagttctggtgagcctctgtggactttggagtcaacttatatcagatttgggtgttctgctccaatccattttcttagtaacctgtaaggttgctgttttttttgtttttattatggagatatatatatatacacacacacatatatatagtatataatattatatatagtatataatattatatatatataatcattttaaccatttttaggtatgcatttcagtggcattagtacatttacattattgtacaactgtcactaccatttatctacagaatttttatcttctttaactgaaactctatactcattaaacaataactctccattatccccttccaccaaaccctggcagccccattctactttctatctctctgaatttgattatcctaggtgaggaaggaggtcagcagcacttgttttccaagaactggctatgacccctgctgatcaaaacaggatctggctaaaatagggtgcagtaaagaaactgaccaaatacagctaaaaccaaaatggtgaaaaaagtgacctctagttgccctcagtgctcattatacactaagtataatatattagcatgctaaaagacactcccaccagcaccatgacagtttaaaaatgtcatggcaatggttggaagttaccctatatggtttaagaggggaggggaacccttccttggttcctggaatgccccatcccttttctagaaaattcacaaataacctgccccttatttagcatataattaagtagtagctataaatatagctagccagcagtctatgagggctactctgcctatggggtagccctgctctatctatggagcagccattttcctatactctgttgctctgataaacttgctttgtgacatagtttggatatttgtccctgcccaaatctcatgttgaattgtaatccccagtgcaggaggtgggggctgggggagttgtttggatcatgggggtgagtccctcatggcttggtgctgtctttctgataatgagttctcacaagatgtggttatttaaatgtacatggcaacaccccctctactctcactctttgtctctcttgcttgttactgctttcaccgtgtgatgtgtctgtccccacttcaccttctagtctccttaaaagctgaataggttccagcaccatgcttcctgtaaagcctgaagaactgtaagccaattaaacctctgttctttataaatcacccagtctcaggtatttctttatagcaatgcaagaacaccctaatactctttgccttcactttactctgtcagctccctcctgaattatttcttgtcttcctggaagacaagaaccctccctggctgagccacagttttggggtttgccagtatcataggtctttcatataagtgagatcacaatattcatccttttgcgtctggtttgttacatttagcataatgtccttcaagtctcatccaggttatagtgtgtcagactttcattcctttttaaggctgaaaaacattccattgtcaattattccaatatattccaaaaatattccaatgtcacattttgtttattcattcaatcactgatagacatttgggttgtttctactaactattatgcataatgctgctacgaacattggtgtaaaaatacctttaatgatgaatacattaatttgcttcactctagtcatctttttactatctatatgtatcccataacttcttattgtatatcttaaatttatacaataaaatttatttaaaaaaatcttttacattcctgccgtcagttcttttgcatatatatatacccagaagtggacttgctggattatatggtaattcaatgtttaattttctgaggaactaccatactggtttttacagtattgtgtcatttaccttcccaacagcaatgtgcttgtgttctaatttctccaccatcttgctaacacttgttattttctgtttttgtttgtttgtttatgtttgttttataatagcatcctaacatgtgtgacgtgatatctcattttgcttttgatttgcatttccctaatggtagtgatgttatatatccttccatgggattactggtcatttgtaaatcttctttggagaaatgtctattcaagtattttgccaggttgccagttttgagtggaccctgaagtaagaaaaggctctgcagcagattcagggtgtaagttacaatgctattaatatttggacctcatgactgagaaactctaattatatcagaaggctctgtagctggtagagatgccatatgagccctttggtaatctcccataagagaaaccctgcttatatctgtaagattttggagacaggccatgccctctctgtcaaatgcaatttaccatttggaatacagctatgagcttgctccgattgaaactgaatgactgaacctggaatgtcaaatggctacgctctcgttctctgttttgcccattatgaactcggtaataatcgaattcactgaaccataaaattgaatgtataccgcagcactctattcttaaatcaaaatggcatgtattgaaactgggccctagcacgtctggaaagcacagacaaaatgtgtaagcaagcaattcagatttccatgacacccgttcccattgctttgacattgctccttcagctttcctagagaattccctttaccagttaatggaggaggaaaaacctcaggcctgatttttggatagatctgcattgattgtcaacatcagccagaagtgtacagtttcaggctgcattagagcttgaaagatgttagtaaagtgaactctttccagtaggtagaacttgaggcaatacatatagttagaaggagagatggcttgagatacggatctacattaattcagagagcactggctaagagtttggccagctggtcaggcacttggaaataatgggtttgaaaggctaatgataagaaggtccgaggaagataaatttagatgaacttctcaaaatgaaatcaatgtagagttaattatattccatgtagatacttaacagacagcatcctctatagagtaggttctcaataatcaggtaaacaagatggacctttagtggatatcagtcaacatttttccatactaatcatagtggttgctcaatgggcccactaacacaaatccaacaatatggacttttcttcaccaaggttgatctggctaccacccctggtgactgccaaacctgccaaacgtagaggccaacattgagctcccaacaaggcaatgctccctgggagataagttggagctataatagctgcaattgttctcacaggggtagatacctattctagacatagatttgctattctaccaaaagttcttctggtagttaaaatgtagttgatacacagcacgaattatatgtcagaagagagagagctgatatacctatagcaatatgaatgtatctttaaatcccagtgctaagtgaaaaaaaaaagatgcatggtctaatatcatttccataattaaagatatgcataaaaacctgtagtatatttttgggacagcatacagataagaatatacattaaaacatataaaatagtggctattttagggggaggggaatgagagtggggataaaaagaagtcagcctaagagtaggtccatgcaaaaactgaaggatgacaatatgccataaattcattaatatgattatcccaacaactgtgtacctaaggtaaaagacagagggagtggaaaaccttaaagaaaaaaaaaaaagaagccaaagctgaaagacctttttttttgcctcctttggcatccaggactctggcaggtgacttaggtcaaattactagaaaatctcattcaggtcttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggacgacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcctcattcaggtctttgaatcttgaaaaagtggcatgaagatgcatgacagtttagaaattattcatagtgcagtagcattggcactgagagtccaatggtggccatgttgactggtgccaatgtcattggtggcaccctaactagactactctttgcttggggtgttctgttgcaagaaatccttaatttcagactgttttctgaccctggattttgagctttttagctgattctgtaagcaacccagtcactatcttataatttgttttctgcttaggttagccagagaagatttttgtttaaaaccagtcagacttggctgatatcccaaagtcctaattgggttatagaatgcaaatagcctcatcatctggccttaagaccccttcattcttgtgtattctagatagagccagtgtttcgatttcaggcatgagcctttgcccacacagaaaataaaactagcatgacagattctaggaataaggtttagagtggcattgaacggaatcaacattttatttgtgttaactcagtattttttgtattggctttctcttagccattaaattactatcctttaaatattacctcaatattgaagaaaaatgtagagttgttagaaaacgtctattttcttgctagaaacaagcaacagataatcagtgccacattgcaattttcctaaataaaaatggcatatattgaaactgggccctagcaggtccagaaagcacagacaaaatgtgtaagcaggcaattcagatttccataatatctgatctcaagagaaaatggtccataattttataatccatatcaatgttttcattccttaaaattttctgtccttcctgagggatctctaggtattacatattgctagaaagaagttgtttgtcataatgaaccagtaaatgacttgagtaaaaagtaattaatgactttgatatgtcactaatgtcctgacgagtatctcataagctgaacatctgaaattgttcttaaactcatatataggatactggtttctattatccacatagggaactaatatctggattagtagtattttagcctgagaacaaatgacttcctggtcctattaataagttaattactactaatatattattaaataaattcatttgctactactagtacttttacaattcactatttagccttataaactattgggtccatccaccccacctccatgattatacctgtgtatagcagcaacaaatatgacgtattttcacatgtggttttccttgtttgaattctcaaaaatcttattcaaagcaacaggaaaagattcactacaatatttcccagtaaaacttaatccacaaaaatacagactctcaaaccaattcaaagggttttactgttgtatttttaaaatttcacaatctcattataagactatcacatggtgagtccggagattagcatgaagatggaagcccagtgcatgagctccctttaagactgggatctcaaatgagtctcttttaaccagactgatactactagcaaaagtctatacaatatttattttaattaaaaactttggcctggctgttaaagtttcgtaggccgtaacctgatgccatgaggctctgatatgtttcttccaaaacaaatagaaaccatgttaggacttcttaacagccttcatattttcagagaatctgactagatatttattagtgacataattatattggttaagttatcatttcatttttttaaacaaatgagataactcattgtagtgaaaaagaatattaatttgtatttaagtttaggtatagcaccatactagatttgaataaacattagaattgacttattacctaagaaaagagcaacaaatcaataggtaaccatatccaaatagcagaaatttaaaagggtaagttttactgtattcttaaaagtgtgtggttaattcgtctaatgtttaaagtaaaaacaacctgtggtaaaaatgtctcaattaggatgacattagggaaggaaagcgggaaaatggttaagcaaagacaaaaatgtgatttttaaatttctgatcaaataagtaagatagaaatctgcataaaaataagaatgaatctacattattgcattacttttttcccataactatcacggtggttgctcaatgggcccactggcacaaatccaataatgtggacttttcctcaccaaggctgatttggctactacccctggtgactgccaaacctgccaaaagtagaggccaacactgagctactaacacagcaatgctccttaggggattagttcgagctagctgtgattgtcctcacaggggtagacacatattatagacatggatttgctattctaccaaaagttcttctggtagttaaaatgtagttaatatatagcatgaagaattacacatcagaagagagacagctgatggacctattgcaatgaatgaattagatgaacacagagaaaatattcacacaattcttgtaaaatactgaggctataaaagtaaagggaaaatgatttttcacagaacctaccttgagttactgccaagacctaaatgttccaaaggtggcttaaaacatttgatgaactcaaagtacagccaggttgtgtagtccttaagcttttgcttctttataggtcttctttaacagattttatatttttaaaatggcatgaattattaacactatgagttattagatataaaatactgaagagaatgtacctattgacagttcctggaaatcctaaatacaactgcataatagctattagagaaatgaactggcttaatctgagccaatgccaaagctaaaatagatagccaaaatatctatggtctagcaaggagacacatgcataggaaataatgagcaaagagatatccgtactactcacaggaagtccctgttttcctggtggcccaatttttccagggtttcctgaaatgccatctgctccatggtatccttgtatgccttttggcccaagtaggccttgaagtcccttgataattaaaaattatttggattgtagagatgctgaaaagatgttaagatgacaaatacttttttatttattgagctggagaagtttacatttttatattttgttctaggacaaattttcctgtttcctggattccttaatgatttactatttggattcaacagataactttaaaagtttaaaagcctttaaaagttccccaaacaaaaatgccaagctgatcagcaatttactgtgtaacttttgcgccttagtgtaattctctggtgtttcttattgtgtcaaccaatattttatataattgtggagaaaagatcagctatatgcacctgtcagcttaggatagaggttatcatttcccatctgccaaaccttgtattgtgttattttcccaagaaataaattatggctattcagctgccactttgaatcagataattatatgactgaagtaaggtctgaacattttgtttctacacttgggcaactaaatttcatatgcaaggatctctgatctgaatgtgcttataatttacattcattttctctatttttttttcaagccaatacaagtcacccaaagcaggcatctaatccttggctaggggacaccagtaaagtctttgctaaagagccagtcaacacttatctgcctggccaggagaggaaactgatggtgaggtaaaagttaatctttgtgatgaaaagattaaattttttttcctaagactttttatttgtctagagaatgagaggctgagtcctctaaaatctagctcatgtcattttaattatgcttgaatatctctggcctttgtcaccattcattttgttacgattctaagttctctgtttttcagtggttcaccgtcagaagcatgagtccaccgggagggcttcataaccaggaaaatagcatccttcaactgcagggacttatatttaaacagcaagtttggttttgagttaatggtcatattttgttccctctgtgttccagcatgggtttaatttttttaaaagacaatctgatttatccaacatgatgacacaattggccccaaacttttctgcttgctaaagttgccagttccatttagaaaagcaagaaagatgaaagaggcctgttacttacaggaatcccaggtttcccagaaggaccaggagctccttttttccccttattaccctaaagatggaaagcacagttgtcaattgactgtaataatcttacttaaactgaagccatagaaaaggacactgagacctggacgctgcagcaagaactagcacgaactagttgtatatcattaggattgccatttaattttcctgggagtcagcttcttcatctgaaaatgagaaactttgacaagatcatctagtaatttccttgtagctctcaattatatgatttaagaatttaaactgtacttctaaaagggacctgaatagattatttaataaatgtccctactttcaggaagggccttgatctccttttgaaaatgctacatatttacttaattcagtaaacatttattgagtatcatgtatcagggactctgtcatgcgcttggaaggcaaaggcaaagttcctccttacaaggcacttacagtgtggtaagaagaacatgaactgatagcctaaaatgtgcttttctggaagaatagagaagagcatacttgtgattcaaggaaaagatatttatttcccacggaactgtttgtttttccatgtgtgagatgttttaaatcataattgattcagcagtaatgggtctgccaggatagttaggaactttgctcttgcaaatcatgccattgttctgatgacattctaaaagtatttaaagaagaaaatgtggaaaaggtgacttggttcacaaataagaaaaggaatcatgttgtcattaccagacacatttctcagaaatcatcagaagttctcacaaacaggataatcccactaaaatgggatgttaaatcattcaattttgaagacaaattgtgctaaagattcagtttaataataacaacaaagaaacaacttcaaaagatgttacttttttgacaaccagcttaaacattttatgaagaaatagtatatgttgtcacagagaaaaagagcatcttctctaagagataaaaatccaacttttgcaggatttgacaatggggagatataaggatcatgggttgtacttccaactttgaaaactattgtacttgtcttagaagtcactaatgcaaaatgtttctaaagatgaggaaaccagaaaatgggatagttagtgacctgggtttaattaaagtatacacatttctagagcatatgatccctataagtaaaatatgtttttcctaacacaataaaaaagcaaaataaacaaagactattttaaatagtggaaaaaagttgtgatttcagtcatcttgaaatacttattaaatagcatatgaatcataatatgcaattatgttaatcagtgtgttttttcctttacagtatttctttttatgcaacgagatatatctgttctatacttttgatttttcaaaatagacttttccttggcttttgaattttaaaatagtccaatgaaactcatggtgggggtaacagtttgaaaaaaatatgttttcagtttcaaaatcatgttttttaaacacaaaagcctgactcttaaatattaaaagtctatctttgagttaaaaaccaaggtttgttataaaggactcaagtcataaaatttatgctataaagaacagatttaaaataataataataatgtaacaaagagtttttcccatgaaaggggataaagatcctcaagctggggaaagggaaaagaagaagaaaaagagaagcgggactgttagacactgacggcaatctctgaaaagagccccttgcccctcatcctacccttgagtctttctcttttcctttttttttttttttttgagacagagtctcactctgtcacccaggttggagtacagtgtcatgatctcggctcatggcaacctccacctgccaggttgaagtgattctcctgcctcagcctcccaagtagctgggatcacaggcatgcaccaccacacccagctaatctttgtatttttagtagagacggagtttcaccatgttggccaggctggtcttgaactcctgacctcaggtgatctgccctcctcggcctcccaaagtgctggaattacaggcatgagccaccatgcctggcctgcccttgagtctttcttagggtggatagaaacactaatgctcccagataagtttggggatctgggcacaaagatgatgcctagggagactaaagtcctcattgagaagtccacataaagtacatagagtaaaaatctctgcatgacatgtctaggacagtgggattaagaatgtctttctgagtcctccaagtaccctgtatggtgtggggagcagagaatgttatttatatgtggccaagaacagaagaagatggccctgagaggcctgaggaggtcttgtacctgagatgagcaaatagctgcacatgccagcataggtcaaaatacttctggcaggagggccaaggtagatgccaatacggtgagacaatagcaactgtgggccaaaagtgatgatgtgcatttcaggggacactagtgtgaacagatgatgactgaagactaaacttattttccacctgccttccctaccatctgtaactccaaatttgaaaagagtgagtggggaaaactctaaatcaaatgtaggatatttgagtgaatggggttaaaggcagtcaatggattagatttacagtacatataaaattgtgctttctttttgcctggccagcactgaaaaataggtagagtggcccatttgaaatcagatccattttgaaaggcttctgttcattgggactgtgctggttcacagactactagagaaagcagtctgattcttttgataagggaaatattttttaatatgcaacgttaatacaaacgcttgttttttgtttgtttaaatgaggctgaaggacagttatctagatacttcactagttctaacactctttaagaaggcagctttataaagcaaaaatagatttagagagttaagcaaaaattattctttcttttttcaccaagaaatttcaattcattgaaatctggaattttgttttgggagaacaaatattttggcttgagtcttggtctttgagagtcattataggacagttcactcacatttgcattacaaaagtcttttaaaaaatgttggttctgcaattggttttgacttgctctaaatttttctttatagctgcccacagtcttatgcccaatgaatgaattggttggttaggttaaattaatcatattttacttaatttttaaaagattacaagtaataggcttcttcataataacaggagctaggaaataaagtttctagtgttgtttctgttgctaattagttctgtgattttaggtaactcataatctctctgggattttaatttcttcatttgaaaattaagagggttatccagataattttaaagggtcatttccaaatctaaaaaataaatttaaagctttgcaaaaacaagatgacagcaattggacaggacccatctggccactgaaggtgtccctagtgaataatacacagtcagtcattattcttgtagcaattaatactattttaaattctaagaggctttttaatgtgcccttgggttgtatgccagcattacccaaagcagggaagaactagcttgcctggattatacagaatttaaactatggcttcttagcaccttttagctccaacacgcagggattgttgaccatgtaggctagagaggcagttgactagtaaaagtatttgatattcattagcctaattttaacatatactaataagcatcagaaaatgtcttactcctgagacctctcaagatggaaaaagaaagcctgcaaatatgaaagtattaattgtaaaaaagtagatactttcggatcaaatgttggacagaacttgcattcttaggcacttactgcaaatataaggaagtagcatgacagcagtagcagtattctaggttcccaatgttttctatgactttttccaatttgagtattaaaaattctaagtgaatgacttaactatcttctttctctgcttgtttaggcttatcttcgatatgatatttttatttattaatattatttattggggaacctaacagaaagttactgaatagatgccaagactatacaaaatgggttctaggtaagtgaatgcctatttaacatatctgattcaaccccattttattacttactcccataagtggaaaacacaaatatgggtgaaggctgcttaacaaatcaggagaaacacaatctcaaatcattactttttattcattctcatctaatttattattaacagtgtagtgcattttcttaagaatttaatttgaaatcaatagcatgtgaagtcagaatgcctgaaaaacagggcagcaatgaattgaaggtgcaaatgacaaagttgcttgctatttaaagttgaggcaatgtctatctggccacatggaaagagaagactaaattcagtaaaccaacagatttttagtttgcttgataagatttgccttatgaaaaaacaactttcaaaccaattatgagcctgtgttacatagtcaaactactttttcctctcttatcctatgacaatgattctttgcttggtcaaactttagtcaggctcctgaaccttctaagccctccgtgtacttccttgtaaaatccagttttagcaacgaaccctgccaagtcggtttagcaagaaccttcacccttgatatctgatcacccttgatatttgatatctaactgggttcctcatcctctaccatcccccagttgatgtctgattatcccacagttgatgtctggtcaccttggcctgtcttcagcaaaattcttgttaggtcagtttaaccaaaattcccctggcccctggtgtttcctcttaagtaattttccattcactcatactcaatctgctcctttgttataaattcctacttgcccatgctatatttggtgttgagtccaatctctcttccccattgcaaaatcccattgcagtggtcgctatacctattgtaatagtcatgaacaaagtcttccttaccatgctttaacaattatcatttaataattttttctttaatgctttctacaacaattatataggtttgactgattttttttaccttataatactagttttaaggtttgctggtatttctgtttgaaacctcaagaacatactattaatttgagacaactgaggcaattttcacaaagctagaataggcttctggaaaagaaaaatttggataatagtcaaaacaaatgactcaatcaataattttgtattagcacaattattgaaaaacaccctacttagaggcccatagtgatccatattctacagtgataaatgataatttgaattacaataaatagtaactccttgtgctcctgctttctaaaattgctaacaatacatctcaaattgccttaaataatttcaacttacttcagatcctctctctccttttagtccttgttcaccctggtcacctggttcgccctttagtagaaaccaaaataaaaatcacatatgaagcagagaccaaataagttatattaatgttaatttttagaaataatgctttcaaaacatactgggggtccttgttgtccagtggcacctcttagtcctggtacacccacatggccctagaaatagaaaagattacattattagagtaagtagagacatgtgacttaagagaataggatactatcacttaaaatggtagcaaagtgttgcaaagctcaacttaaatgtcgtagagattatgattcttcttggaaatagaaaagaacataatagctgttggatattatggtagctgaaaacaagttagggttttctttctttctttctttctttttttttaatgtgaattaatgtagcaggctgaatggtggcctcccaaatgttcgtctatgtcccaatccccagaatctgtgaatgtgatcttgtttggaaaaagggtctttgcagatgtcactaagttaaggatctcaagataagattatcctggattatccatgtgggccctaaatccactaaagagcataagtgacacagaggtagactgacacagacaacagaggagaaggccaggtgaagacagaggcagagattggagagatgcggtcataggaatgctgacagccactagaaactggaggaggcaggagtgtggccctagagcctctagagggagcgtggccctgttgatcccttgattttggatttctggtctctagaactgagaaaattacatatctattgttgtaagccacccattttgtggtaatttgttatagcagcctcaggaaactaatatagtcaataaccaaaggaacagagtttgagaatacatttctttttcaacctcttcctcctccgaaagtgtactatggtctccatttttacaaactaacttcacaactatttggacggtagatttactgggctgaagactgggagcagttactgggaggtattactataataccaagaaacaccacatgactctgacattcggcaatctgtcgtcaccttagttctcctaagaaggaatgctgacctaccacatttcccttttcaagtgtgtaaatagaaactagcaacaacccagaagcgtgtcagatgagagttatgcaggaataattctgcgtgtaaattcttttatcccttttcctactcaatcagatttctttctccctattttcatacgttacagaaagaatgccttaggaaagagttatcagtcccatctcctgggctagaagaagagattgcatacataggctaacaatatttattcttttattattattattattattattattattattattatacttgaagttttagggtacatgtgcacaatgtgcaggttagttacatatgtatacatgtgccatgctggtgtgctgcactcactaacttgtcatctagcattaggtatatcccccaatgctatccctctcccctccccccaccccacaacagtccccagagtgtgaagttccccttcctgtgtccatgtgttctcattgttcagttcccacctatgagtgagaatatgcggtgtttggttttttgttcttgcgatagctgactgagaatgatgatttccaatttcatccatgtccctacaaaggacatgaactcatcattttttatggctgcatagtattccatggtgtatatgagccacattttcttaatccagtctatcattgttggacatttgggttggttccaagtctttgctattgtgaataacgccgcaataaacgtacctgtgcatgtgtctttatagcagcatgatttatagtcctttggttatatacccagtaatgggatggctgggtcaaatgatatttgtagttctagatccctgaggaatcaccacactgactcccacaatggttgaactagtttacagtcccaccaacagtgtaaaagtgttcctatttctccacatcctctccagcacctgttgtttcctgactttttaatgattgccattctaactggtgtgagatggtatctcattgcggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacgtgaagtccttgcccatgcctatgtcctgaacggtaatgcctaggttttcttctagggtttttatggttttaggtctaacatttaagtctttaatccatcttgaattgatttttgtataaggtgtaaggaagggatccagtttcagctttctatatatggctagccagttttcctagcaccatttatgaaatagggaatcctttccccattgcttgtttttctcaggtttgtcaaagatcagatagttgtagatatgcggcattatttctgagggctctgttctgttccattgatctatatctctgttttggtaacagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcattgagcagtggtttgcagttctccttgaagaggtccttcacatcccttgtaagttggattcctaggtattttattctctttgaagcaattgtgaatgggagtccactcatgatttggctctctgtttgtctgttgttggtgtataagaatgcttgtgatttttgcacattgattttgtatcctgagactttgctgaagttgcttatcagcttaaggagattttgggctgagacaatggagttttctagatatacaatcatggcatctgcaaagagggacaatttgacttcctcttttcctaactgaataccctttatttccttatcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaattaatggagagtttttagcatgaagggctgttgaattttgtcaaaggccttttctgcatctattgagataatcatgtggtttttgtctttggttctgtttatatggtggattacatttattgaattgcgtatattgaaccagccttgcatcccagggatgaagcccacttgatcatggtggataagctttttgatgtgctgctggattcagtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccatttcctccttgtacctctggtagaattcggctgtgaatccatctggtcctggactctttttggttggtaagctattgattattgccacaatttcagctcgttattgatctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcagtggtgatatcccctttatcattttttattgtgtctgtttgattcttctctcttttctttattagtcttgctagtggtctatcaattttgttgatcctttcaaaaaaccagctcctggattcattcattttttgaagggttttttgtgtctctatttccttcagttctgctgtgattttagttatttcttgccttctgctagcttttgaatgtgtttgctcttgcttttctagttcttttaattgtgatgttagggtgtcaattttggatctttcctggtttctcttctgggcatttagtgctataaatttccctctacacactgctttgaatgcatcccagagattctggtatgttgtgtctttgttcttgttggtttcaaagaacatctttatttctgccttcatttcgttatgtacccagtagtcattcaggagcagattgttcagtttccatgtagttgagcagttttgagtgagattcttaatcctgagttctagtttgattgcactgtggtctgagagataagtttgttataatttctattcttttacatttgctgaggggagctttacttccaagtatgtggtcaattttggaataggtgtggtgtggtgctgaaaaaaatgtatattctgttgatttggggtggagagttctgtagatgtctattaggtctgcttggtgcagagctgagttgaattcctgggtatccttgttgactttctgtctcgttgatctgtctaatgttgacagtggggtgttaaagtctcccattattattgtgtgggagtctaagtctctttgcaggtcactcaggacttgctttgtgaatctgggtgctcctgtattgggtgcatatatatttaggatagttagctcttcttgttgaattgatccctttaccattttgtaatggccttctttgtctcttttgatctttgttggtttaaagtctgttttatcagagactacgattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgctgttagctggttattttgctcgttagttgatgcagtttcttcctagtcttgatggtctttacaatttggcatgtttttgcagtggctggtaccggttgttcctttccatgtttagcgcttccttcaggagctcttttagggcaggcctggtggtgacaaaatgtctcagcatttgcttgtctgtaaagtattttatttctccttcacttatgaagcttagtttggctggatatgaaattctgggttgaaaattcttttctttaagaatgttgatattggcccccactctcttctggcttgtagagtttctgccaagagatctgctcttagtctgatgggctttcctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaaattctcctggataatatcctgcagagtgttttccaacttggttccattctccccgtcactttcaggtacaccaatcagacgtagatttggttttttcatatagccccatatttcttggaggctttgctcatttctttttattcttttctctctaaacttcccttctcgcttcatttcattcacttcatcttccatcactgctaccctttcttccagttgatcgcatggcctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatttcctcccatagctcggagtaatttgatcgtctgaagccttcttctctgagttcatcaaagtcattctccttccagctttgttctgttgctggtgaggaactgcgttcctttggaggaggagaggcgctctacttttcagagtttccagtttttctgctctgttttttccccatctttgtggttttatctacttttggtctttgatgatggtgatgtacagatgggttttcggtgtggatgtcctttctgtttgttagttttccttctaacagacaggaccctcagctgcaggtctgttggagtacccggccgtgtgaggtgtcagtctgcccctgctggggggtgcctcccagttaggctgctcgggggtcaggggtcagggacccacttgaggaggcagtctgcccgttctcagatctccagttgcatgctgggagaaccactgctctcttcaaagctgtcagacagggacatttaagtctgcagggttactgctgtctttttgtctgtctgtgccctgcccccagaggtggagcctacagaggcaggcaggcctccttgagctgtggtgggctccacccagtttgagcttcccggctgctttgtttacctaagtgagcctgggcaatggcgggtgcccctcccccagcctggctgccgccttgcagtttgatctcagactgctgtgctagcaatcagcgagactccgtgggcataggaccctctgagccatgtgcgggatataatctcctggtgtgctgtttttaaagcccgtcggaaaagcgcagtattcgggtcagagtgacccgattttccaggtgccatctgtcacctctttctttgactaggaaagggaactccctgaccccttgcgcttgccgagtgaggcaatgccttgccctgcttcggctcgcgcacagtgcgtgcacccactgacctgcgcccactgtctggcactccctagtgagatgaacccagtacctcagatggaaatgcagaaatcacctgtcttctgcgttgctcacgctgggagctgtagaccggagctgttcttatttggcaatcttggctcctaacaacaatatttattcttacagcaaagtcagttgaaggcttctttgtttgcattctgaggcaaatgtttacggtttaagtttcaacttcccgataaagaaaatgaaatctgtttaaggaagtgaagagtggcaagagagaaaggctagtcttgagagcttctatatagcccatgaccacactaacggaaaaaccatgatcacacacgagccttagcaaaacatgagcagagccagcaattaacagaatctggtcaatcaagacggagtgtggtacaagtaaatgtgactacttgaaggtcacttatcaaacaggattcaggaaagaagtggctggtgaaaagctggaggtgaagtaagagtgagaatatgagcaaactacaaaactctaaaccatcatgcccaattatggcttttccaccatccctgtatgtagttctacagaaatattttcagagtgatcatagaatagccaactgcctctcctggctttgtgaagtatgactgtaaatctcaccaagacaaacctgcattctaagagttttgttacaattactttggtttatcactctaaaaattgactatgaccatttttctgtattggtaaaaattaaatgtgccatagaaaatgttattacaaaattattcaggagaggttatggaaagtgatggaacttgtcagataatattagtggtgggatgagttgaatggccaaaggaacttacagaagattttataagggaagtgataagttcaatcttgaagaatgagtgttccgggcagtaaagtgaggacattctggcagaggcaatagcatgggaaataaagggatgcatctgacagaacatgttaggtagaaaatggatctgagagggctatgactggagacaggaagtctagttgggaagctattgaaataattttggcaaaaaatgatgagagcctgatggtagtttcttttgctgtgcagaagctctttagtttaattagatcccatttgtcaatttttgcttttgttgacattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcctagcaccatttattaaatagggaatcctttccccattgctcgtttttctcaggtttgtcaaagatcagatggttgtagatatgtggcattatttctgagggctctgttctattccattgatccatatctctgttttggtaccagtaccatgctgttttggttactgtagccttgtagtatagtttgaagtcaggtagcgtgatgcctccagctttgtccttttggcttaggttgacttggcaatgtgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattgttgtgtaagaatgcttgtgatttttgcacattgattttgtatcctgagactttgctgaagttgcttatcagcttaaggagattttgggccgagacaatggggttttctagatatacaatcatgtcatctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatactggctgtgggtttgtcatagatagctcttattattttgagatacgtcccatcaatacctaattaatggagagtttttagcatgaagggttgttgaattttgtcaaaggccttttctcagagtgaacaggcaacctacaaaatgggagaaaattttcgcaacctactcatctgacaaagggctaatatccagaatctacaatgaactcaagcaaatttacaagaaaaaaacaaccccatcaacaagtgggtgaaggatatgaacagacacttctcaaaagaagacatttatgcagccaaaaaacacatgacaaaatgctcatcatcactggccatcagagaaatgcaaatcaaaaccacaatgagataccatctcacaccagttagaatggtgatcagtaaaaagtcaggaaacaacaggtgctggagaggatgtggagaaataggaacacttttacactgttggtgggactgtaaactagttcaaccattgtggaagtcagtgtggcgattcctcagggatctagaactacaaataccacttgacccagccatcccattactgggtatatacccaaaggattataaatcatgttgctataaagacacatgcacacgtatgtttattgtggcactattcacaatagcaaagacttggaaccaacccaaatgtccaacaacgatagactggattaagaaaatgtggcacatatacaatatggaatactatgcagccataaaaaaggatgagttcatgtcctttgtagggacatggatgaaactggaaaccatcattctcagcaaactatggcaaggacaaaaaaccaaacactgcatgttctcacttataggtgggaattgaacaatgagaacactgggacacaggaaggggaacatcacactctggggactgttgtggggtggggggagggggaagggatagcattaggagctatacctaatgctaaatgatgagttaatgggtgcagcacaccagcatggcacatgtatacatatgtaacaaacctgtacattgtgcacatgtaccctaaaacttaaagtataataataataaaatttaaaaaaaaagtaaatacaaaaaaatggtgagagcctgaactaaagtaggacaaagtaactagattccagaaacatttaagaatcaaaagaagtggctgactgtgagacatgagtaggggtatggggaagaaaaagagattcatagagacagagtgagtgagtgagagagagagattgagagagagacagagagagggagaaagaaagagaaagaaagagagacagaggattcatctactggtttagacatctgaatggctggtgatactattcactgaattgaggacataacaagaggaagatcagattaaatttggaaaggatgaggtactatggtttggcacttactgagtttgaggtgcctgtgatgatgtccaatagctatttagatgtgtatgtctgatgctaaggagtgaaggccaagttgggatttagttatttcattgtgtgtaaaaattctatgaccattgccagcccccctccgcccacagcaaaaagaactttgagatgcaacataatttattcaaagtatttctgggacttcatctctcctaagtttagcttgagttaatcttggctatttatgtttccatttatacctttaaataaagtgtttccatttatacctttaaaaagtggctgttgccaggataatacatttattccctccatgtcctctggctctcaagcgtcaaataaatttatcttgatctatgtgatgtacagttttagtacagtttatagcaggatgacagctataattgcttttccttttatgaaataacatgaaatagctgtacatattttatagctaaaattcactatgtttatttttatactgattaagtgttcttattctccatgttttttatatatatgatgtccatgggggcagagactgtgtctgggatgtccaatgtaatatccatggcccctagctcttctcctggcccatggcagacactcaaatacaagcttaatgaccagagacatatatatatatattttttagatggagtcttgctctgttgccaggctggagtgcagtggcatgatcttggctcactgcaacctctgcctctgcctctgcctcccgggttcaagtgtttctcctgcctcagcctcccgagtagctgggactacaggcatgcaccaccacacccagataattttttgtattttagtagagatggggtttcactatgttgggcaggatggtctcgatctcctgacctcgtgatctgcccacggtggcctcccaaagtgctgggattacaggtgtgagccactgcacccggcccagagacacagtttttagaaatgttatcatacataacacataaagtatgtcagtacaactaagtattcgttaataataatgagcaggacccttgactttggtcaaagatgtttgtgactataaacatgttttttaaaagccaggtgattattcagtcataaagacaataaaatattgatatattttataacatggatgaacttttaaaacactgtgccagacacaaaaggctacatgtataattctatttatatgaaatatccagaatacagaaatccagagacaaaaagaaaaaggtttccaggggcttgggggaatagggagtgactgcctaatgagtatggggcttccttttggaagtgttgaaaatgtttggaactagacaatggtgatggttgcacatgatggcgttcaagacacactaccccaaaatatggcatctcggaatattgaatattttaagctgaagcaatctgaggaatggcatgtgcagagaggactttcttaccttcctttgatgcaggtcataagacacatgtgagaggtgtctccctatacctggaggaaaggagcatcctcatctccaaaaacgaagggacacagagaataatctgaatgaacagtccttgctaagttttccccagtttactaatcttaacccatacctttgccctatcacattcttctaagacttcctcatcaaacctagcataaaagtattcaggtttaactgtttctttggagctttatttctttatgaaggctcccgtgttacgtataatttatatgaaattaatctgtatgcttttctcttgttaatctgccttttgttaccaagtccccagccaagaattcagaagggcagaagaaaagatatttttcctcccttgcccactaacaatgtgaatgtactaaatgtcactgaattgtaaagtttaaaatggttaaaatggtaaattttatgttacatgtattttatcctaataaagaagcttggtgataatgctaaccatcagtttagcagagtgaaatcatagcatatacaatatccatatagaaaagcaaacattttaaaatatcacctgaagctataataagataacctaattctaaataaagcgtggttcctctgtataaatcaaacttgtgctaggagaaaacttggtgagggagaaaggtggatatttcatgattttgagctaagcaataaaagtagcatggttgtctggcacaagatggctaactgtttagcatagaatcatcaataaataaaatgatccctaaagcctaaggacttaggaagaaataagacagaaaggaagacatggatcaaactagtttatacaacatctacagttgaaaaattatcaggggtatacaaggaaggggaaggagaagtagattagacagtgaacctagggaaaagtgaatgactgattgtccagaaaacgccggcagggcttttctttggctagccaagtgaggaaattcttgtctcctttcaagcgaatagttaactgctcatttgctggtaaatatactgatttagctactgaatgttctgtagctggtagaggccaaaatgagatattgcaggaatctggttttcccgagactgtgtgaagaagtcatgcacagaaaaagctgaggaactttaagaggcttctcaaattatgctggaagcagttgggttggcttctcaactcggagaaaagtaaatttcaaataaatccactcaattccttgggttaggaaacacttgtagatacaaatgttatgtaaattggaaacagaacacatataacctgctaaaaatgtttctttgaaaacagaaaaaaaaatggtaatcgcaacaatttcacaaatatttagaactattctcaacatctgcttcaaagagagttttagggagtgaaagttaatttttcagattcctctggcttgagaaaaatcaacttattaatgatagttatctatctatcatcttgtccatttagtttgggtaatataaatctgcatttcagacatgaccacaggaatttcatcttgacagagatgtatcagattaattaacccatcaactcattattaaaagcttattatgtacagggattagaactagacgttgtacaagaaagaaagaagacatatgccaagtgggggagctaagacacctacacattaaaaataattagcaaaattagcaaaaaaagaatagcaacagaatgtggtaaaatgtttgtactgaatgacttaaataaataatattattacaagactacaggagagagcaagattaccgttagtgggtcaggggaaaagggaatttgagtgaaattataaaggatttatgtaagcaaagattacataatattataggcaaatagagaatgctatgagcaaaggaataagacaggaactatagggagacaggagacaacctctaactctgtaaagcaattggcaatgtaaatagagggaagagatataaggcaggaatacagaacatcctcaaaaacaaatgtgatattaaaaaatgacactgaatacgttctacacacagcctaattttagctaagttggtcagataatgtccctctcaggaatggaagaggataagaattgacttaagccttgagaatataaaggtatttagccacctacttgacacctctttattgaattcctactatataccaggaactttgtgttctagaaattgggggtataatgatgaaaatgagagacaagattttttttctcatggatcccacattttgttgggggaagacaaacaataaacaaggaaacaaatatatttaaaaagtgacaagataatatagcataaaatgtcatgaaggaaatcgagtaatatggtccagagtgattgttctagatctattttagatagggcagttagagaaggcctctcaggaggtaacatttcagttgagatctgaatgatgagaaaaagcagaagtaagaaaagacaaagatgattctaggaaggaggaacagaaagtagaaagacgtctcttctaggattaaaaacataagacattactaattatctcaataatggaatggaaaaaatggaatagaaacacagagaaccctatttaaattcattagtaaggggtataacttgcaattaccttatatccctctgctccaggctctcctctctctccttggtcccccactggaccctacagagaccacacacaaaacaatcagttttacagctggatcaaagtatatgcgaatgcaggtgataagattagtgttgtttattcttttgtcaaaaatataaaaccaaatatatgatttgtttagttccattaaataatttcaaaatattgaatttcaatgataccaagaacaacatcaaaatacaccaaccagtgaattatataaagagaatctcataatgattctactaggaaaaatattgaaaactgaagcccaattaaaaatatgaatattttcaccaagtgtggtggctcacacctgtagtcccagcacgttgggaggctgaggcaggaggatcccttgagcccaggagttcgagaccagcctgggcaataacgtgagaccctgtctctacaaataatgtaaaaattagccaggcatggtggtatgtgactatagtcccagctacttgggagctgaagcagggggaacacttgagcccaggaggtcgaggttgcagtgagtcatgtttgcaccactgctctccagcctgggcaacagagtgagaccctgtttcaaacaacaacagcagcaacagcaacaacaaaacaacaaaatgtttcaattagtacagtatgttataaatgatgcccaaataacttacttttttactaaatattaaaatgattgaaaaagatttaagcaggacagttcagtacataattccattaattacaaaagattatatttaagtgatcttttaaaagggatttaaatagtaaatcctactttaccattcttcatgagaaagtctactgttggctgggtgtggtagctcatgcctgtaatcccagcactgtgggaggctgagataggaggatcccttgagctcaagggtttgagaccagcctaggcaacagagagagaccctgtctctaaaaaaaattaaaaaataataaataaaaattagctggccctggtggcacgagcctgcagtcccagctacttgggaggtgggaggatcacttagcccaggtgtttgaggctgcagtgagccagcactccagcctgggcaacagagggagacacagtctcagaataaaagtctattgtgaaatttttaattttcaagacataaattaacctaaaaaattatacttattaattttaatccttaagccaaaaattatctaataaactcagacttacttttcctgaatatttctaatagaaaatctttaatataataaatcatcaaattatctactataaaatgaaatagaaatatcagcacccactaggacctaccatctgaacaaaaacttaaattgaaattagttggaaaagcataggatttattatagagcattaattgacaaattttaatttactcttacgtggacaaaggtaagagacatgtcaacactacaatctctgactctgctttaattatttagaatctttgtggtttaagtttcatgcctgtcccgtgtctactggataaaactactattgttatgctagtcttttaatatatttattacattttaggtggcattctttgatcctggcatacctaaatctgggaaaaacaaccactactatactccttttgccaagttttttccatttgctttaagatttttacattatttccatatatttccctctcttagtggtttagagagactagaatattatttaataaagaaacttacatattcctttagatacctatatatctattgcctctatatgagatggcttgatttaatcagaaaaattagaatctttcttgtctatttctaaaacaaagtataactttcaaccatctccaaagagccaggtcaaaatatcaggagtgactacatattctgatccttgtgccttaagattgttttactctatataatactatgtgagaaatggaaaatatagccaattatataatatttatttctatggactaaaaattttcatttaatccatttaatttacatatggtctttagacattgttttagtcaaacatgaacacagagacagttattcaaataaagctataatagctactttttagagaccatggttatagttaacccttaaaatgtttaataagaaggctatagatcagtaatctttaaaggttattggttctaataactccttagaggggttttgaaatcacttggcaactgtgtgtaaactgctataagaagtatatagataagatttttttaatatttagaaataaatctgaatgtgataattacagaaatatgtatcctaaaatgtctagagtgtataagttttctgacaatctttgtaaaagttgttatcatgccttcaatgcagaaagttagatttgggaagtcactatattaaccctatatattatgctaaaatatgacctgcatatttttcatattaaagactttaatatcatttaaattttgtgaccataaatatcaccctcctatcaaaccatgttataaaactaacaaaagaaaactccttgaaaagatttaattggtgttgtgaatctattatataattgtgttttatcttgaataaccagaattatttcagaaaaagacctactggttcacctcgaggcccaggtggtcctaggactgtgctatcttctcctgggtagccctaaaatgaaataatgatttataaacaaaactcaataaataaaataaacatcaaaaacacacaacctactatttttaagtatattagaaaatgcagtttgatgttatctttttttaagtggaaaactttgatgtaagaaactaagcctatgatattttatacagagttgtaatttgtacagggttcttcttggaggtatcaatctcctttaattatataagaagcagctcaggaattttcttaaagtgtcagatttcaatgatattgtaaattaagaatactgctgtagttattcctaaatcatcaaaaaattttaatctttaatataaatgagccaggtgcggtggtactcatctgtcatgcctgctacttaggagcctggggtgggaggattgcttgcttggtttgagtccaacctgggcaacagtcaagatcacttgatcctgactctcctgccccaaagactttaatataaatgtactataattaatcatttaatctagagccttacaatttctttaaataattaattttactcttacaaagctctacaaatattttcacatatattatttcagctcagtcttgaaacaacccatggaagatattttaataatttatttaaattttagctccttgatatttatttttttcttccagaattagtaaaattttcaactttaaaagtgcttcttttattccttgaaaatttttccatgcagtctttcaggaataattcatgaactcaatgtttaactttaagattaaaaagccaatatatacacaaaccttttctcctttaggtcctggcaatccagagggtcctggttggccctgatggccctacgaaaggacaagtagacatttatacatgctctacctagatattagatattgcattattctgaaaggaaaaataggattcactgtctaggaggatgagacctaaatatgttagaaaggtttatcagagagatttcatcttaatttgaatatttgggatatcatctttaataaaaatgttttcatgtgaatatattttttcaattataaatacttaccctgtaccctggaattcctggttctccatcaggtcccatcaatcctaaatgtccctgaaaaacaaagtaaatattagtgagagagagaaagtaaagaattgtttaaatcattagacttctactcctattgtttaaattgttacctttagatttttcatggttgaaatttacctagtttgaaataggaaagcaaaaaataaccccccaacttttgtctatttttttttctgaaacacaaaaagttctgcaacaaatgtctttttggtttacttctgatataaatatccttaatcatattaaaaaaaatactttcagttgtcagaatcctgctgctccctaacgaattattggaaatgtggtttacatctgtcaaagtttgtgccagatgtgggtcactgaatattagagagtgcaacctgagagtttttgacattgtcactacgggatccagaactccatactcattgttagtttcagatgctatgatgaatatggttttagtcctggtcaaagttattaaaagggaaatggttgacaacttacatgtaatagttaccctatgattactcttattatcaatattttatagatggtgaaaccatgtaagccaaagactaatcagcaaatgcccttagcctactgaatagattgctcagacaattgaaaaagtaaaacaaacaaacaaacaaaaaaaacctgaaaaagtcctatatttcatattagcaaaaagattccatattgactctcctatttgagtctcaaaacaaatagaagatgggaaaattaaggcacagaataggtatgtgacttgccaaatgtcatactagaactaagtctcttgattctgcatatatagtatttcccatttaatcatagtgcttcactatatttgatgatttctttaaattcccagctctaaaaatgttcacattgcaactattaaccattgattagtaaatttagactcatccagataagaacaagtttcagtctaaaaaaggaattgcacaaaattaattttaaaacatcaataagaattcagccattacctaggtgaataatctagaatagaatgtaactactcagtattcattagctcaagatggctgaatgacatatgcttgcttcaatagtctcatccaacaaaaaagagagagagaaaagaaaggtatttatttgtaataacaacactggaaaataagtaaacatcatcagtggaccaaaattttgtaatttgagacagaaaattagggctgaaaatatgcaaagaaaaaaatcattgcagatgtgcaagtagtctcaaggaaatttcaaatgctgaaatcaagacattgaaggggcaggataggttcaggtgactaactggggaaaggagtcaggtattcctattctacttgtgctgggtaactgatgattgcatttgcctagaagataagtgaatgcgtgtggaaactgttgccccaaaagcaggcaatgctaaaggctgctgctgactcaagtgactctagagccaacataacaagaaataaaatatgcaattcataaaagaaaaaatgaaccttaatgtacctaaaatatatatgcaaaatatgtaacctcccaaaaataagtggggagaaaatgtgatgaacagatctcaaaatctgttttcagaaatcaatgactcaaatagcaagaaaaaaaacagtaagaaagctataaggatttaagtagcttagctaacaacttgatttaacagaaatacttaggactgtttattagccccaaaaaaggaaaagaaagaaagaaagaaaagaaaagagaaaaaggaatcttttgacaaaatttgaatatagtagtcctcaaagaaaattttagtaaatttcctcaaagcagaaatcatataggtcacatcctctggctataatgcaatgtaattaaaaatgagcaataaaaattaaaaatctacttaaaaagaaagatcctttaagataactcttgttcaggagaaaataaactctgaaattgcaagctatttataagtaaatgatggtaaaaacacaaacataaaaatacgggaatatggccaaagtggcactcaaaagggaacaggtagcttcataatgcatttattaaataaataaaataaatgggccagacatttaattcaagaagagattaatactgaagcagaaattagtgaatcagaaaaccattttaaaaagttgagtgaaaaacaaagtagacactttgaactgactaataaaagagcaaaatatttggcaaatctgatcaccgcaaagagtaaacacgataaaacaacattagaaacaagaagaacataaccaaaggaaaaaaaattaattataagaaaatagtcatttcaagtttcacttactaaatatgaaaatctagttgaaattgatactttttgagaaaaaatttcaaaaatttattccagaagatacaaaatttgaaaagaaagccaaagatctactgctaataaaataacatttggctcagattgttttaatagcaagttttataaaacctttggagaacagacacaatatctatgttccatactgttacagagcacagaaaaatatgaaaaatttaccaacccattttatatgacttgcttaacacttatgcctaaatccaatcaatgatagcatacattaaaaaaggatggaatgaagaacgatggaatgaagaaataggcctactttgcttacaaatacaaatgcaaaactcttaaggtaaactacattcaataagctaaaataaaactcttaaataaaatgttaaaaaatgaaatctatttgcattaaaataataatataattaaacctaagtaagatttatcctaggaactcatggttgattcaacttttggaaatctatgaaggaattttcttatatttacaaacaaaggagagaaagcatgggtttatctaaacaaatgttgtaaaaggatttgataaaattcaacatctactatgggattatctaaaaaaatgttgtaaaaggatttgataaaattcaacatctactcttggtcaaaactctcatttaagaatgaaaataaatttctttaaacaaataaatggtatatctaaaaaacaactgtaaacaacacttgatattataagcattagaagcattttcactaaagacaggcccacaagacaaggttttcttcatcatgacttctattcactgctatagtagaagttctaatcaatgtagtaattcagagaagcaaataaggggaggcaatattatttacctgaagaatccctatgagaatcatctacattcgttaaagtggatataagatcaaaatataatagcaccaacagcaccactaagttgatgtaacagaaaaaggattatattaacactgagaataaaactcaaaagcaaagcaaaacaaaaaaacaaaaatactaagaataaacttaacaagaaagattaaagaacagagataagggaaatattttattgatgaatatgtaagcagatttgagtaaataaaaagacatatggtgtttatagaaagattcagcattgaaggaaattgaaagttcacatgaaagaggaaatcatagcaagagtcaaacttttttgtaaaatgaattatgaagtatttgccctaacagaaggtatcacaatagtatagtaagtaaaatagtgtggtattgacccagaaatagactactagattcagagaataaagtagaagaaaaacagactaatgaatatttgagaattcagtttatggtaagggaagcatttcagaaaagcagaaaacagactgaccactcaataaatagaattggaacaactgtctataagtttggaaaaaataaacttagtcttctacaccttatataaaaaaatacccacaaaaaaaccaaaaacctccatacatcttaaagagttaaggtaaaaataaagttataaaagtattagaagaatatggaagaatattcttatatactttaggtaggggaggcatttctaataaaataaacacagaaactgaaagggaaaagactgacaagtttgactatataaaaattaaaatgatctatacagcaaaagatatacaaaattaaaagataaattgcagaaagaaaagcatttgtaatatattttgtaacatatttaacaaaaatatattaatattttaagcatataaggagtgattgcaaatcaataagaaaaaggcaacaatctaatgtgcagtatatatgaacaggcaacttccataagaaaaaagtgcaattgggaaagtgtaaatagaaaaaatgcaatacacattctcacttatcagattggcaaacatcaaaagaagtaatatgaaatgttgatggtgggagtgcaaatttgatgaaacctcttgggaaggtaggttgggaacgtgtcaaattaaaaaattaataacattataaaatgtttttgtatacaggtcaaagacagagaaatgctagtaatttaaatgaaagaaagtaagaaaggcctagatcccagtaaggaatagaataccgaaaataagcctgaggcaaactttcctcagacaacaaatggattatgcaatgatctctaaaaagccttagtgaaaagtctagcacttgtgacatttaaatggagactacactaaatggaaatacgcatgcattttgtaaaaaagcctatgaaacagaagactcaattagataatcttttaaatattttgcatctctttcatgctgactttcagaacaggtctaaatacattcgcaatataattttcctaatataagagttcataagtatcatgctacacttgttcctaacatcatgcaaagttcctgagaaagatgaaagataaaattagatgttagatttatcacaattggttagaaaaataatatccaaataaagcaggtttgtttccaaccagagaaagaaaatccatttcaagtaaacctaattttcaaagcaatttgtcaaccatgacagcatagttttatacagatactaaatcccaattttaagtgctggccatataaaatttcctagtttggttaggagttataatcttactttttaaaacctcatttcatattttatttccattttcatttttttctctttcctttttcatgtccagaaaccactaagccgtttaagtactgtggaatgcttacaattctccacatcccatggaggtagattattttcaatggaactattgctttgtctgtaaagctaatcaagggatgaaactttaagggcatggatacgtttctttcccatccacagtgactcaattctggaagcaagtcaaatactgaccacagcacctctagttcctctggcacccttaggaccacttttcccaatttttccaggaggacctctgcttccaacttctcctgtgggtcctatttgtcctttatcaccctgtggatgacattattaagagagaaaagcaagaaaaaaatttatacttagattaattaactatatcatattcctgaatagctcctgaggattatctggttaacagtattacagatcactattaacaacaataacataccatcactatataagttattttaaaaataaaagtaattttggaaaaagataaaataaaaattttgaccaaacaagcagggggcatctggtgctcatgttgaatccaaataaccgttttttacttttgaattttgctatatatgtatgtaagtatgcatgtatgtgttgttactataagaaatcataagctctttggaaagtctgtttctatagagaatttcaatgcaacaaggtctgttcaatacaaaaagagctccagtgtgcagttctgtacattcaggatcatcactcattggcttggagtatgccttgaaaaatctgcaacatttttacatcactttacatctttcagaaaactaattatcttctgttttctattagacacactgacctttcttttttgttgttgttttttttgagaccaagtctcactatatcacctaggctggaatgcagtggcaagatctcagttcactgcaacctctgcctcctggattcaagcgattctcctgcctcagcctcccaagtagctgggattacaggcacccatcaacacgtccagttaatttttgtagttttagcagagacagggtttcaccatgttggccaggctggtttcgatctcctgacttcaagcgatccgcccacctcggcctcccaaagtgctgggattacaggtgtgagccactgcgcccagccaacaaactgacctttctttagcaccaaaatatagctgttcttaaacaacattgtgttattcttcattttcctaagtgagaaccaacctgttctattattgataaacaagaagatacaaagaaaaactactgtgaacacagttggacaggaaatttttgggattcataacagctaagaggctttattttatttttccaggggtgcaggttgttattatacaaagacttgcactgtctcactatgaatgttgattttagtaaaatatttttagtaaaatataaagtaagcaaataaaaatattcttgatttgtagttcttcatatatggaaaaaataaaaccaacttagaaaaacacattgacaacaaataattatagttacattctcttccctcaaatactttactaaagttgtcattgaaaagcacaaatggtatagtattttccttttatctttcttcttgcccatggtctactaaaagaatttttggcaaacaagagaaagaaggaaaagccaagattttttacaaactacaaaatggaaaatttgccttcaaataatcacgataataagtactcctaactgaaattaaatattaatttatataaatgtatcttttaaagcaacatttataattctttactactttactatctagtccaaattaaaaacattacagcagtctatggagttctgggcacatcagaagaaagaaaacctgcataagaagatgtaaaaaattaccttttttcctggacgacctctttgccctggaattcccacaattccttcaggtccctaaaatattcaatataaaaaaggaaataaatggttaaagaaaagatgagatggagtatttgaatacttctatcagataatcactggattggattggacgagaagtaaaaatgagggttaattttcacattattaggtttgtatcatttaaaaagaggtcacaatgacttagaggtgtagctgttattagctataaagttcacatgcacaaactggccaagagagtcttaattacactgttcattattctaggtggaacattacttagattcagtatacccattttaattagagagaatgtaattaaagttaacccatgccttctacgtcacaggctgtaaaacacgtttaactaaaataaaaaagtataaacccaaaggcatccatctcagcatttctatcagctactgggagctcagcatcttgtggaaagtacaggacttctgcctatccaatgaagtctccacacacatatgaaagaaagtacagagtataaaatacatctagtacatggtcaaggaaaatttcaatgtgtctagtacgtggtcaaagaaaatctcaaaatctcactggagtagaaagagttaaagagatattcgttgatctgtgggaaaaaaagaaggaaatacagagagaaaaaggaggtaatcatataaaacttaaaaataatattttcatttcaatttgtcctttgtgtagctaaaagtatattaaaagttttcaatatacacttttttttaagtaaaagtggggcactatatgaattttcaggtaaacaatggttaggcttaagtgagttccacagtaagccaggttgcaagttctaaaatggctaataattaatcacaacattccctgcattcgctggaaatgaaaatagaaatctcaaatttgtgtcccaaaagcttggcaaattgcaaaaatgatgtagacaagaaataacttgtggtttaccactgtgctatgtaggctctagataaatatttgttgaacgaataaacagatacctaaggaaatgactcataccctatgctcctgagaaaatgctcttctagcctcagaaaatcactgaatttagaggccaaagctgttgtgctctattgctgtagttatagctgcatccagaggtagaaatggtagttgcactaacctgaggacttctttgaagttaatgaggcctttcaaaaagaggctgattaatcttcatagagattaaaggtgtgagcttttaaaagtcagactgctcccatttcatattctggctctggcacctaacacctacctatacagccgtaggtagattatttaatttctaaaggcctcagattcctgttaaataaaagaggtataaaagaacatcttcaaagactaagagcaaataagagaatgcatgtaaactttagaaaggactagacttatgatgaagagctcaaaatatgctagtcgttattaacttctgctgtttattaaaagtgtattacacaatatttaagtacatgtaaagatgttaaaaggtacaatgaaagcccgtttacctacatctactttaagaaatagaaccaatatatgtgtatgtctatgtgtgtgtgtgtgtgtatatatatatatatatatctacatatatatatacatataattgaagccccacattaaacatatacttatccaaactcatcaccctttttccctactcaggtgcaatcattgtcttgaattttattgttcctacacatttcttaataattttactccatttgtatccccaagtaatatgtattttgtatctttaaaaatttttaaaaagcagtatcatactttatgtgttctcctgaaacttctttttaacacatttttgttttgaaattactgtgtctttaattcatttacttaaaaaaatgctacaggattccatgttattatcaaaccacaacttaagtatttttcccgttggttaatgttttggtggctttcttttgctattacagacaatgctggaataaacactctgtacttgtctctatgtgctcatgtcaagagtttttatagggtatgtaccctggaattgaattgctgggttgtaggatacatgcatcttcaagcatatcagatattgtcaaattgttctccaaagtgattttgccaatttacatcctcaatggcaatgtttaagagttccacttacttcatatttcctataatgcttgatcgtatgagacttaaaatgggtgcagaatgatgttatcatttcaatttatgttattggttattatggaaaaacgtatagctactcataaagttatcggacatctatatctctatgtgaatttctggttcctatcttgtgcccgttattctactgggctgtcttatttagttacatgtatatgtttttatacatacttatattttgttcattccatatatcacaaatctcttctcccagcttgtatcttattttctcaccttgtttattacgactttggactaacacaagtttgcaattttaatgcagtcaaagtcattaatattttctttctgtttcttttagtgctttgttttaagaaatctttactgcttcccctttccttataaggtcataaaatattatcttaaatgttctcccaagagttttaagattttgattttaacagttaagcctttaatcaattggaatgtaattttgcggggtgtgtgtttgtgtgtgtgcgcgcacgtgcgcatttgtgtgagggagagtattttttttttcatttggataaccaattgtactggtatcatttattaaattgttcatttccttatagatctgtagtgcataatcaatttatcaaaaatcaagtttcaaaatatacttatatctgattctacattatcttcaatttccattggtctgtttgtttatttgtgaatgagtatggcactaactaacttaattactctagcttcaataataagttatatcagataggtcagattctctcttccacctcctccacaaccatcccacctctgcacaacttattctttaaagttgtcttaatattggccctttggttttccacacaaatttttaaatcactttttatcaatcaagttttattaaaaatcccattgggattttggttgaaattgtattaagtgtattcattaatataggagaagattgataattttataatattgagttttcctatcatgaatataaaataactgtccatttatttagttctttaataaatgattataatttctttaattgcaaaaattttccacaccatttttacaaatattttgtttagatgtattgctaggtacttaattttgtggctaattgtgttggaaattgcatttaaaaatatctaactgctcattgctggtgaaaaagaatggaacctatttttgtatattacttttatttatttatttagagacattgtcttgctatgttgcccaggcgggacttgaactcctaggatcaagcaatccactcacctcagcctctcgagttactggaagtacaggcgcatgccacagtaaccacagtattatgttttattttttctatctaacttttattttaggttcaaggggtacatgtgcaggtttgttatgtggataaattatgtgtcacatggatttggtgtacagataattttgtcacctaggtaattggcataatatctgataggcagtttttcagtcctcaccctcctcccacccttcactctcaagtaggtcctgatgttaattgttcctttctttgtgtccatgtgtactcaaggtttagctccaacttaaagagaacatgtggtatttggttttctgttcccacattaatttgcttaggataatggcctccagctgcatccatgttgctggttaaggacatgatcttgttctttttctatggctgcataggattccatggtgtatacataccacttttttttttatccagtccactgttgatggagatctaggctgattccatgtctttgctattgtgaatggtgctgcgctgaagataaatgcgcatgcatctttatggtagaacagtttatattcctttgggtatatacccagtaatgggactgctgggttgaatggtagttcttttaaagttctttgagaaatctccagactattttccacagtggctgagctaatttacattcccactagcagtgtataagtgttcacttttctctgcaacttcaccagcatgttattttttgactttttaataaaagccattctgactggtatgagatggtatctcattgtggttttgatttgcatttctctaatgattagcaacattgagcattttttcatctacttgatggccaaatgtatgtctttttttgagaagtgtatgttcaagtcctttacccatttttaatgggtttgtttgttttttgcttattgatttaagttctttatagattctggatattagacctttgttggatgcataatttgcaaaaactatctcctgttcttaggttgtctgtttactcttttgacagtttcttttgctgtgcagaaactctttagtttaattaggttcatttgtcaagttttgtttttgatgcaattgcttttggaatctttgtcatgaagtctttgcaagggctgatgtccagaatagtattccctaagttctcttctaaggtttttatagttttaggttttatatttaagcatttaatccatcttaaattgatttttgcatgtggtaaaaggtaggggtccagcttcaatcttctgcatatggctagccagttatcccagcaccatctactgaatagggtaaactttccccattgcttgttattatcggctttgtcaaaggtcagatagctgtagttgtgtggctttatttctcggttctctaacctgtttcattggtctgtgtaactgtttttgtaccagtacaatattgttttagttactgtagccttgtagtatagtttgaagtcaggtacttgtgatgcctccagctctattcttcttgcttaggattactttggctacttgggctcttttttgattccataagaattttagaatggcttttgctaatgctgtgaaaaacgttcttggtaatctgataggactggcattgagtctttaaattgcttttgagaagtatggccattttaccaatattgattcttcctatccatgagcatagaaggtttttacatttgtttgtgttgcctctgatttctttcagcagtgtcttgtaattctaattgtagagatctttcacctccctggttactgtattcctaggtttttgttttttttttttgagataaagtctcgctctgtcaccaggctggagtgtagtggtgtgatcacagctcactgcaacctcacctcctgggttcaagcgattctcccgcctcagcctcctgagtagctgggactacaggtgtgcaccaccacgctcagctaatttttgtatttttagtagagaaggggtttcaccatgttggccgggatggtcttgatctcttgacagcgtgttccacctgcctcggcctcccaaatattcctaggtattttattctttttgtggctattatgagtggcattaaactcttgatttgtttctcagctgggatgttattggtgtatagaaatgctattaatttttgtacgttgattttgtattctgaaactttgctgaagttgtttatcagatctaggagcctttgaacagagactatagggttttctaggtacagaatcatataatctgcaaaaagagtttgacttcctcttttcctatttggatgccttttatttctttcttttgtctgactgctgtgactgagagttccagtactatattaagtaggagtggtgagagttccatctctcaaggggaatgcttccagcttttgcctattaggtataacattggctgtgggtttgtcatagatgacagttattattttgaggtatgtactttcaatgtcaagtttgttgagggttaacattgaggcacgttgaattttattgaaagctttttctgtacctattgagatgatcatgtgttttttgtttttagttatatttatgtgatggatcacatttattgatttacatatgttgaaccaatcttgcatcccaggaataaagcctacttgatcatgatggattagctttttgatgtgctgctaaattcagtttgctagtattttgttatcgattcttgcatctatgttcaacagggatattgacctgaagtcttctttttttgttgttgtatatcagaatgatgctggcctcatgcaatgaataagggaggaatccctcctattcaattttttggaatggtttcagtaggattggtaccagctcttctttatagctctggtagattatggctgtcaatctggtcctgggcttttctggttggtaggtttctaagtcactgattcaatttcagaactcattattggtctgctcagggtttcagtttcttcctggttcaatcttgggaggttgtatgtttccaggaatttatgaatttcttctaggttttctggtttgtgtgcagagaggtgttcataatagtctctgagggttttttgtatttccgtggtattgatggtaacatcccctttgtcatttctgaatgtgtttatttggatcatctccctgcctgtttttctttattagtctagctaatggtctataaatcttatttattctttcaataaatgaagttttggttttgttgaccttttgtatgttttattctcatctccattttgttcagttcagctttgattttggttatttcagcttttgggtttgttttgctcctgtttttctagttcctctaggtgtgatgttatgctgttaattagatatttttctaactttttaatgtaggtaggtatttagtgctataaacttccctcttaacactgctttagctgtatcccagagattcttgtatgttgtatcactgttttcattagtttcaaagaatttcttgatttctgctttaatttcattgtttacccaaaagtctttcaggagcagactgattaatttccatttaatggtatagttttgagaaatttgtattctaatgattccctaattatatcacctgttctcactccatcactgactttctgattaccctacctaatgatagctctttgcatttgtatttggtatgttaaactttacgcgtccaaaaccaaagtctctaaatccctcctcctaaccctaaactgctttcctcctactcttccccacctccactgtaataaggcaaaatttgaaaattagtaaaatggttttctttcttgcctctttgaatatgaggagtttgcctgttcagcctcaggtgtctgtacgcccaaaggctgaatgccttaaaataatatttttctgttttccttgtttccaacttttaacatttcatgagttgagtctggagcacctagcacacaaagctgtcctgtgatagagaagacactttccatgtattaccataaggcttttactagatgatagaaggatgaggatatgacataggggaagtaaagagaagcatggaggttttgtttgtctgtttgttttggctccaggagaatgtgggaaggcaaaggaggagagagagacatattttcctttttctgagttttgtcagagagagatcttttttgcaattactcatttggaatttgaaaggtatcttttgtagatatcacctggtgggtagccctgtcaatatggttactcaacaacaaagtcaaaatgaggaagaccatatggttaaattttcctgagctactcttcgattcctatatgatgtagatggcaactcagaaacagctgggaagtttgtggcagggacagggtgatcactactctaggaatatatagctctacaataagggctggagagcaggtttccttggctagtactgaataaggaccacaacagacctcagagacatctatagaaattagtgggacctgatgtgagaccagttcagcaagggaaccctcttctccaaaaaaaaaaaaaaagaaaaaaaaaaagacaaagaaaaaaatgaaaattactagatgtaaacatcatcagcagaaaccatcagggtaggcggtgagggaagattaccctgtcccaattagcacaaataacacctgcatcaatatccaaggcatcctcatccttgcaatcacaagacacacagactcaatgttggaaaggagtaaaagagagaggtcaaggactgatacacttgagagactaagcatcttgatagtctgagcacctgaagaaactactactttatatgattagattaagtttaagcattcaactgagtcagattttaaattttctctttgcctgctgccatcccccgcaaccccaatgcattccactaatcagtaagtaggagcttgtgaggaaaaccagatgagccagaaataaagaagttacatatttgcacatctgtaagtacaaatttgttgctctgttacacatttaatggcatgattatccactcagttgctcaggctaaaatctagggtttattatttattactttatcccatcttctcaacatctaaaccaggagcaaattcagttagctatgcctctaaaatatgtcttgaatctgatcattattcactatcactgtgttttctcattccaagccaccaacatttttcatctagactactgccaaagctttataagtggtttggtccacttttaaccccatagctcacttcttcacaatagcccaaataatcactaacaattttaatcatacccttctgcctgttcaaaaccttccaaatgactgtccattgcaatgagaataatcaccaaacctcttatcatggtctataattccctatgatctggctcctaccatttctctgacatcatgttttccaattatttactataatctagatacagggctctttttcatttttttcttttctttttaaaaccccttctgccttagggcctttgcgttagatattccctctatttagaaatctcttttcctcagataatcacataggtggctttctctatgcttaggtgcctggctcaatgcagcctcaggtagtacttctgtgaccaccctaaataggtaacccctttacctggtcactccacatcccaataacatattttctccttattttctccctccttccttccttccttccttccttccttccttccttccttccttccttccttccttccctccgtccttcttccctccctccgtccctgcttcccttctttccttctttccctttcctttccttcttttcttttcttttcggacggtcttgctttgtcacctacgctggagtgcagtggcatgatcatggctcactgcagccccgaccttccagcaatctcaagcagatcctcccaccctagtagctgggaccacaggtgtaagccaccacacccagcaaattttacaaaatttttggtagcgatgggggttctttatgttgcccaggctggtcttgaactccacggcccaagtggtcctcccgtctcagcctcccaaatgctgggattataggcatgaatcactgcactcaatctttatttccttcacagcacttatcactaccagaattatcactcatgttgaaattgtcttcccacattagaatacaaattcctacaaatttcatgacagcatgaaccttgtctgttttgttcactgctgtaacattaacattcataactgtgcctggcttaataaatatttaatgaatgaataaatgaatgacagaatgtatgcccaaaattgaaaataattagccctaatcagacagtaaggtagtctattaggtattcacttgtaagaaaataacattttaaagaacatgcattaaatgttgaaagtaaaaccaaagtttatgagtaaaaggcaaagtagagtgagagattttcataatattttttagcttctagggaacagaacatatgaatctattaggaattttttgcacagtaaacttctgcacatatttaaagaacccattatatgtgagaaaaggggttgcgttattctatattgtattttcttgttattataatcagaaaggtcccccctggttatttgttcagtatttttctcttcaaggatatgttgttgttatattttttttaggaggaagtgtaaatttccactgctagtaggctggtttattttagtgcttttcctgaaatgtgtaagtaatattttgctccaaaatgttggcttttaaaagttaacattgcccactgcaacccatttgtgtatctagaggtttgcagggcatataggaaaaatagcaacttttttttactatgtacatgttaaaatggatttattcaataattacagaaagaagaatgctatttttttggtgtgtgcctatagtcccagctatttgggaggctgaggcaggagaattccttgggtccaggagtttaagtccagcctgagcaacatagcaagaccgcatctctttaaaaatgctattttatacaatttatatatgtcatttatctatgtcatgttgattgagaatagtcagcttggtgttgcttactaataaaatagaggaaccagttgggattccctattttagactttgtgaaagtagctattttgtctcagaagtatcacatcatatctatttttaaaacagatttattgaggaataattaacatttacatatgtgatagttacatgatactatatactcatacatgatatccacgtatcatgtatatgaattatgtgcccatttaatgtgtacaattagatgatttttagtatattcacatagttgtgtaaccatcaccaaaatcaattttagaacattttcgtcacttccccccaaaatctcattatcataagaagtcactccccatttctttccaacccctctagccctaggcaaccactaatccactttctgtatgtatagatttgcctatttaggacatttcatataaaagtacaatatgtgggccaggcacagtggctcacgcctgtaatcccagcagtttgggaggcagaggcgggcagatcacgaggtcaggagattgagatcaacctggctaacacggtgaaatcccatctctactaaaaatacaaaaaattagccaggcgtggtggtgggtgcctgtagttccagctactcgggaggctgaggcaggagaatggcgtgaacctggcaggtggagcttgcagtgagccaagatcgtgccactgcactctagcctgggcgacagagcaagactctgtctcaaaaacaaaaagaaataaacaaaaaacaattcaatatgtggtttctagtgaattgcttctttcatttagcataatgttttcgaggttaatccatgctgcaccatgtactcgtacaccattcctttttattgtcaaataatatttcgcatgttatttattaattcatcaggtgatgcccatttgggttgtttctactttttcgctcttataaatcatgtgctgtgaaaattcatgtacaagcttttgtttaaatgcaattctcttggacatacgtacctagaagtggaattgctgggtcatatggtaagtccatgtttaacattttgcagaaccgccaaactggtttacgaagaaactgcagattttatatctcatcagcaatgtataagggttccaatttctctatatcctcattaacactaaccatcctagtaggtatgaagtggtatctcattgtggttttgatttgcattttcctgatatttgtaatgatattgagcatcttttcatgcacttattagtcatttgtatatcttctttggagatatttaagtctgtccatttttcacttatgttaattatcttattatcagattgttaatatattctggatacgagtcccttatcatatatgattttcaaatattttctcctattatgtgggttgatcttttactttcttgattgtgtcctatgaaccaacaatcttttaattttaatgaagtccaatttatcttagaagacgtactcccatgttttcttctaagacttttacagttttagctcttacatttaggtctatgactcatttggagttcatttttttctgcagtagaaggaagggttcaactttattcttttgcatgtggttatccagttgttccagcactatttggtgaaaagaccattctttctctcactgaattgtcttggcgtatgatgtgcttttctaagtgaaatttattttgttcttttcctgtaattcgtttcatttcttgagatagccaataacactaaccacactttgaataaaacccaaatttcttatcatagcttaaaaagtccttcatgatctacttcctacctatttcttcaagctcatctcaaacaacttttcactatttattatgctgcagctgtaatacccttttagttttctaaaaatactcagctcattctcacctctatatcttggccattgctgcttcatctatcttgaaggatcttcccacagttctttgcttgatgggttcctttttactctccatgtctcaatgtaattgtcccctattcagagaagccttctctcactaccctagctgatatatgttctctatctttaactagttggcttttctacccataatcagttattctctttcattagtatgtttatttccattattgcattatcacaatctgcagtgatcttttaatctttcagtcttcttcattagattataacatttgaggatcaggaaacttggtagtcttgttccccactgtatccctaatgtttagcagagttcttggctcatagaaggtactcaaaaacttcatcgaattcacaaatgaacacaaatattttatagaatcacagtctgtaaggctgaataaaagtttagaaaatctaagacaatgaatttttttaaagccttagaacctttacttccaaagaaaatctacgttaaaaatctatgttaaaaagacatacaaggaccattcctgactgatacaggaatagaaaaaatggggccctgctaacttagcatccctcctgacacaatcatcttgggaagttctgcatagctccaacccgtttgttttgtgtcatgtgtgaacatataaatcaaagaatgactcactcaacaatgtacagctctttagtgggagatgagggacacagtggtcagtgcagggcttgctatttgtgttgctttatgatgaaactgttcagaataaacaagcctaacaccagagtcacagaaaccattcagatgataaagagttagataatcatttactccataatgccacttaatgctgaccctaaattcccaactgattgtttccaaggaaactatgttagaaacaagaaacacttctgtgaagaaagtcaatggtagcttgatggggatggcattgaatctataaattaccttgggcaatatggccattttcatgatactgattcttcctatccatgagcatggaatgttcttccatttgtttgtgtcctcttttatttcattaagcagtggtttgtagttctccttgaagaggtccttcacatcccttgtaagttggatttctagatatttgattatctttgaagcaattgtgaatgggagttcactcatgatttagctctctgtttgtctgttattggtgcataagaatgcttgtgatttttgcacattgattttgtatgctgagactttgctgaagttgcttatcagcttaaggagattttgggctgagacgatggggttttctaaatatacaatcatgtcatccacaaacagggacaatttgacttcctcttttcctaattgaataccctttatttctttctcctgcctgattgccctggccagaacttccaacactatgttgagtaggagtggtgagagagggtatccttgtcttgtgccagttttcaaagggaatgctagacttcaatgttagatctaaaaccataaaaaccctagaagaaaacctaggcaataccattcaggacataggcatgggcaaggacttcatgtctaaaacacaaaaagcaatagcaacaaaagccaaaattgacaaatgggatctaattaaactaaagagcttctgcacagaaaaagaaactaccatcagagtgaacaggcaacctatagaatgggagaaaatttttgcaatctactcatctgacaaagggctaatatccagaatctacaaagaactcaaacaaacttacaagaaaaaaacaaacaaccccatcaacaagtgggcaaagtgaacagacacttctcaaaagaagacatctatgcagccaacagacagatgaaacaatgctcatcatcactggccatcagagaaatgcaaatcaaaaccacaatgagataccatctcacaccacttagaatggcaatcattaaaaagtcaggaaacaacaagtgggggagagaaggatgtagagaaataggaacacttttacactgttggtgggactgtaacctagttcaacaattgtggaaatcagtgtggcgattcctcaaggatctagaactagaaataccatttgacccagcaatcccattacgggtatatacccaaaggattataaatcaagctgctataaaaacacatgcacacgtgggtttattgcagcactattcacaatagcaaagacttggaaccaacccaaatgtccatcaatgatagactggattaagaaaatgtggcatgaacacaccatggaatactatgcagccataaaaaaggatgagttcatgtcctttgttgagacatggatgaagctggaagctatcattctcagcaaactatcgcaaggacaaaaaaccaaacaccgcatgttctcactcataggtgggaattgcacaatgagaacacttggacacaggaaggggaacatcacacactgtcgtgggatgggggaggggggagggatagcattaggtgatatatctaatgtaaatgactagttaatgggtgcagcacaccaacatggcacatgtatacatatgtaacaaacctgcacgttgtgtacatgtaccctagaacttaaagtatatatataaaaaatagacattataaacatttgctattaaaaaaagaaacaagaaacatatatcttatcattcttttctaactattgataatcttctcatctttatgacttcacttttaagatcttatttaaaaaacttattggagaaggtcactttatttcattttatcttcccttaagatatttacctctacctaatatcataccaccttaaacagatagtaaaaaccacatttcaataaatccaaccaaattttgtcctaaacatataaaacaggacaatttcattttaatacatccaactttggagtttatagttgcaaatctgttcagatcttagataacacagtggtagattttttagcatagataacagaccgtaagtcaggcagatgtttcctttcagatgcttcccaattcttttctcatgcagagttatgcatttaggcaactgaacattttagcacaagattcaagcataaaatatacaatttttttttctgtttaaagaaatctaactcctggatttggaattcattactgatgcttcccttgctttatttttcaatccagatctcattctgcagtcctctaggaagtaaggagatcttttcttttcttgaaaaaaaaaaaagttttatttctttctctcactctctttcttatttattttgtaggaatccaaggtagcatctttgtgacactgtctaaggaagaatttttaaagtgcaaaaataaatccagcattagggtgcctgattaagcaatagttccttggattgcaaaattcttttgaaaaaatatgccatggtatttttattgagtttacaagctgaaagccatttaaaattccaaggagaacaacaaaaagaataaaaaaacacacatgtggtgttactaaaaaaaggcaccaaagatgtgtactaggcatgatttttcctgggaaaaattatgaagcagatgaaatctgtgtttatcatttttccatgccttgttttgagtcccatttccatctctgctctactcgtcaccagctgtcatactgtatcattcctctttgggattccttgctgtggtattctacggtatatgtttagactttcccttttcttaattctgttttttccctctctacaaactcttaggattctgctagagaactatgctagttgattttttaaatatacatactaaagtatgaataactgttggtggttttttaacctgaaaacaaatttgacaagaatgatcaggaagataatcacactttcttggcatttgttacttggcttctctgtgggtccaggcctgacactaatggaagagggatgagtcctctaacaaagatgaaaattattaagaactctagaaaggaaaaatatggggccaaagctggttaacccatgggtaagcgaggcttagaaaataaagaaatttctttaatggctgggtgtagcggctcatgcctgtaatcccagcactttgggaggccaaagtagggggatcacttgagttcaggagtttgagaacagcctggccaacatggtgaaaccccatttctactaaaaatacagaaattaggtgggcatggtggtgggtgcctgtactcccagctacttgggaggctgaggcaggagaatcacttgaacccgggaggcagaggttgcagtgagccaagatcgtgccactgcacttctgggtgagagtgagactctgcctaaaagaaaagattctttattaataatttctttagtgattattctttagtaaataaataaagcagtgccatctgctatattatcttgtacaaatctcttagctttttctaagttttttcccagttgtaaaatagggaataataacatctataggttattgggaggattctatgacagtatataagtgaaattatattgtttaatgtttggactaatgatgtttaagataattttgggagctgggcatggaggcttacacatgtaatcccagcactttggaaggccgagtccggtggatcacttgaggtcaggagtttgagaccagcctgacccacatggtaaaaccccgtctctactaaaaatataaaaattagcctggcatggtggtgcgtgcctgtagtcccagctactctggaggcagaggtaacagaatctcttgaacccgggaggtggaggttgcagtgagcctagatcatgccattgcactccagcctgggtgacagagtgagactctatctcataaataaataaataaataagataagtttttgggattcctaagtactttgtatttgctgtgctggaacacccatcacagttctccaggtctgagggaaggacagagaagaaatgggcacttaccactgctgtaaaactgaaaagaaaaaagttgccatttgccagtgctcaaaaataatcttatacttctggtttatcttcattcttcaaatgttactttgaaatatgctattatttgggggtagatgtgttataatattattttaattgctgctaaaggaattatagtcattgataaaaatgaatggtaagacagctagtttgtgtttcatttaagatatttgttgttttcttccagatagagctttcctcttagtcctgcaaacctaattgagctgattggggcagggcccattcaatgatctgcaggttagaaaccagaggaaaagagaaggacagaaaaaaaagctgaaaattataaacactgtaaaccactactttgtcttccagcctgcctgcatgatcagtttactcataattagttcctcagtctttactgagccccaatgtggaaatactggagcacagaagcactgtggtttatgggaaggagtaaagacagagcatctggttttgaagagctatgttttctcttggggaagagacccacatgcttaaatgctgtaatctttaaaaggcagaataaaactgccagagtacagaagaaagagaaaccattttctggtagggtcaaaagggatgactcccaagataggacaatacctccaaaggcatgaacatttacagaagtaaagacaataactttgaggagaacccacgtttaaagatatgagacaagaaaaagggaacagtaaaatgaaacaatagaatgaccagataggctgtatctggaagactataataaattaagcatttaagcaaaaaagatgctattttctctctctcagtctgtctctctctctctttttgagatggagtctcactctgtctcccaggctggagtgtagtgacacgatcttggctcactgtaacctctgcctcctgggttcaagcgattctcctgcctcagcctcctgagtagctgggattacaagcacgcaccatggtgcccagctaatttttgtatttttggtggagaaggggtttcaccatgttggccaggctggtctctaactcctgacctcaggtgatccacccacttcagcttcccaaagtgctgggattacaggcctggccattactcttattatttattcacatcttccacttgtcttgaggtgagagaatttgttcaaaatgatgtttagaacttcctttgaagtaataacaaaattcaggatcagatctgatagctcatattatgcttgcaaagaatttcttgtttcatcctggagctgcgatattactctacaacaataatgtcagttataggaataaagatccaaaatatttaatcaaactcagtttgagacaacataaaacattcctttataaatgctttatgacagaagttacatggcttatggaaaaagtatctttcctctttggatcttaggagggctgataatcagtccttgacttttccttctctctagccacagtttcacatatacaattatccactggatatataaggaggtcagagtgtgtgtaggtttgtgcatgtgtacacatacaggcagtgaattcacttagtatttgaaagtgaacccagcagtacttaccggaaggcctgtttggcctgatctacccaagggtcctataattcctggtaagcccatctctcctttttctccatcctctccaggaagtccccttcctcctggtactccctgtaatgcaataaaaaagttttctataaaggaatacagtgaaataattatgccaataataaacaggtttttgtcacacaaaaacaatgatgtctaatattttaaagattttacaaaacatctattttatatataatcttaaaagtataatttacctttaacccatcttttccctggagaccttcttctccaggagctcctggttcaccctattttgtagcagaaagagtatgattgagtttttttttgctatatcatttatcttattttatttttagcccatagtatatatggaaaatagcaaatttgtgttcacttatttctactactttatttctaaagaggatttgacagtaaaatgagaatgatttaatttgccttgaatagctctgaagatgatttcatgattcagagtgtcataaattcaaatataagatgattccagaatattaataaattttagataattaaagtaatatatatccatttggtagctctagaattttacatagctagacttgtgtttctgagttcaagaaatgtaaatactgcatctcataaagttatagtgctttgctatattgtatttacatgggttaataaaacttgattcagttatgaccactctaccagatttttagagtttccatattttctccctttaagtagagaggtaaagattaaggctctgcaacgtacaaattcaggaaatacagagaacaccacaaagatactccttgagaagagcaactccaagacacataattgtcagattcaccaaagttgaaaagaaggaaaaaatgttaagggcagccagagagaaaggtcgggttaaccacaaaggaaagcccatcagactaacagcggatctcttggcagaaactctagaagccagaagagagtgggggccaacattcaacattcctaaagaaaagaattttcaacccagaatttcatattcagccaaactaagcttcataagtgaaggagaaataaaatcctttaaggacaaacaaatgctgagagattttgtcaccaccaggcctgccctacaagagctcctgaaggaagcactaaacacggaaaggaacaaccaggaccagccactgcaaaaacatgccaaattgtaaagaccatcgatgctaggaagaaactgcatcaactaatgagcaaaacaaccagctaacatcataatgacaggatcatattcacacacaacgatattaaccttagatgtaaatgggctaaatgctccaactaaaagacacagactggcaaactggataaagagtcaagacccatcagtgtgctgtattcaggaaacccatctcatgtgcagagacacacgatggctcaaaataaagggatggaggaagatctaccaagcaaatggaaaacaaaaaaaggcaggggttgcaatcctagtcactgataaaaagactttaaaccaacaaagatcaaaagagacaaagagggccattacataatggtaaaaggatcaattcaacaagaagagctaactatcctaaatatacatgcacccaatacaggagcacccagattcataaagcaagtcctcagagacctacaaagagacttagactcccacacaataataatgggagactttaacaccccattgtcaacattagacagatcaatgagacagaaagttaacaaggatatccaggaattgaactcagctctgcaccaagcagacctaatagacatctacagaactttccaccccaaatcaacagaatatacattcttctcagcaccatatcacacttattccaaaattgaccacatagttggaagtaaagcactcctcagcaagtgtaaaagaacagaaattataacaaactgtctctcagaccacagtgcaatcaaactagaactcaggattaagaaactcactcaacactgctcaaccacatggaaactgaacaacctgctcctgaatgactactgggtacataacgaaatgaaggcagaaataaagatgttctttgaaaccaatgagaacaaagacacaacacaccagaatctctgggacacatttaaagcagtatgtagagggaaagttatagcactaaatgctcacaagagaaagcaggaaagatctaaaattaacaccctaacatcacaattaaaagaactagaaaagcaagagcaaacacattcaaaagcacaccgaaggcaagaaacaactaagatcagagcagaactgaaggagatagagacagaaaaaacccttcaaaaaatcaatgaatccaagagctggtgttttgaaaagatcaacaaaattgatagaccgctagcaatactaataaagaagaaaagagagaagaatcaaatagatgcaataaaaaatgataaaggggttatcaccaccgatcccacagaaatacaaactaccatcagagaatactacaaacacccctatgcatataaactagaaaatctagaagaaattgataaattcctggacacacacaccctcccaagactaagccaggaagaagttgaatccctgaatagaccaataataggctctaaattgagtcaataattaatagcctaccaaccaaaaaaagtccaggaccagatggattcacagccgaattctaccagaggtgcaaggaggagctggtaccattccttctgaaactattccaatcaacagaaaaagaggaatcctccctaactctttttatgaggccagcatcatcctgataccaaagcctggcagagacacaacaaaaaaagagaattttagaccaatatccctgatgaacttcagtggaaaaatccttgataaaatactagcaaattaaatccagcagcacatcaaaaagcttatccaccatgatcaagtgggcttcatccctgggatgcaaggctggttcaacatatgcgaatcaataaatgtaatctagcatataaacagaaccaaagataaaaaccacatgattatatcaacagatgcagaaaaggcctttgacaaaattcaacagcccttcatgctaaaaactctccattaattaggtattgatgggacatatctcaaaataataagagctatttatgacaaacccacagccaatatcatactgaatgggcaaaaaactggaagcattccctttgaaaactggcacaagacagggatgccctctctcaccactcctgttcaacatggtgttggaagttctggccagggcaatcaggcaggagaaagaaataaagggtattcaattaggaaaagaggaagtcaaattgtccctgtttgcagatgacatgattgtatatttagaaaaccccatcgtttcagccccaaatctccttaagctgataagcaacttcagcaaagtatcaggatacaaaatcaatgtgcaaaaatcacaagcattcttatacaccaataacagacaaacagccaaatcatgagtgaactcccattcacaattgcttcaaagagaataaaatacctaggaatccagcttacaagggatgtgaaggacctcttcaaggagaactacaaaccactgctcaacgaaataaaagaggacacaaacaaatggaagaacattccatgctcatggataggaagaatcaatattgtcaaaatggccatattgcccaaggtagtttatagattcaataccatccccatcaagctaccaatgactttcttcacagaattggaaaaaactactttaaagttcatatggaaacaaaaaagagcctgcattaccaagacaatcctaagccaaaagaacaaagctggaggcatcacactacctgacttcaaactataccagaaggctactgtaaccaaaacagctggtaccaaaacagagatatataccaatggaacagaacagagccctcagaaataacaccacatctctacaaccatctgatctttgacaaacctgacaaaaacaagaaatagggaaaggattccctatttagtaaatggtgttaagaaaactggctagccatatgtagaaagctgaaaacggatccctttcttacaccttatacaaaaattaattcaagatggattaaagacttaaatgttacacttaaaaccataaaaaccctagaagaaaacctaggcattaccattcaggacataggcatgggcaaggacttcatgtctaaaacacaaaaagcaatggcaacaaaagccaaaattgacaaatgggatctaattaaactaaagagcttctgcacagaaaaagaaactaccatcagagtgaacaggcaacctacagaatgggagaaaatttttgcaatctacccatctttcaaagggctaatatccagaatctacaaagaactcaaacaaacttacaagaaaaaaacaagcccatcaacaagtgggtgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaaatgctggagaggaggatgtgtagaaataggaacacttttacactgttggtgggactgtaaactagttcaaccattgtggaagacagtgtggcgattcctcaaggatctagaattagaaataccatttgacccagcaatcccattactgggtgtatacccaaaggattataaatcatgctgctataaagacacatgcacatgtatgtttattgtggcactattcactatagcaaagacttggaaccaacccaaatgtccatcaatgatagactggattaagaaaatgtggcacatatacaccatggaatactatgcagccataaaaaaggatgagttcatgttctttgttgggacatggatgaagctggaaaccatcattctcagcaaattatcacaaggagaaaataccaaacactgcatgttctcacttataggtgggaaataaacaatgagaacacttggacacaggaaggggaacatcacacactgtcgtggggtaggggagggggaagggatagcattaggagatatatctaatgtaaatgagaagttaatgggtgcagcacaccaacatggcacatgtatacatatgtaacaaacctgcacgttgtgcacatgtaccctagaacttaaaatacataaaaaaaaaagactaaggctccggtacattaattagttgtcttttagatatggaacttgcagaaatgtagagccatactttatgaagctattaaagtaggactggctctcttgatactaaaattatttaaaagtaaattaattagtgcatatttatagttgctccatctttcccattcaccccaccccacccaaaaaagagaaagtaaaaaggaagaagccagatgcaaaatatatctccctactttgccttttagtgaataaatgtctgttaaaattatcttgggccctattatcttaggaaaaaactccttaccacagctcaaaataaaggctgtctatattagcataacgtctcaaagctatctaattgcaacaatttacaattatgtccttgcatcttgttaactttgcatgatcataggtttggtttttttttagagcaagttaaatctataaattagatttcaatcttgttaggtcaggaactattctgagagttgttcactggtatttgtgaatttcttcttaatgctaacattagtgacaatcacagtgactccacatttttggtaagggttctgcaaagtatacctgattttgagaaaaggacatatgaggttaagactgtaaatactactaaattagaatagggacaaggtttgggatgcagcttttgaaagtatgaaatgaaaccaaacattttctataatgtatcagaaaggtttattatccaattttttgagtgtttcgaataataagttttgagcctctgaaagaagtgggttagtgtattaaaagagtttcaagggggcactcacccgtaaacctggttccccagttcctccaacactgccagcagttccaacatctccctgaagaaacaaagggaaagattaaactcttttctactaagactgcatggctaattatggagggcatgccatacggcacagttccccaacgcctgggccgtagagggtacctgtccaaggcctgttaggaaatgggctgcaaaacagcaggtgagcagctggtgagccagcattactgtctgagctccacctcctgtcagatcagtggcagcattagattctcatagaaacacgaaccctattgtcaactgtgcattcgagggatctgggttgctcagtccttatgagaatctaatgcttgatgatccgaggtaggacagtttcatcctgaaaccatcccctgctctgcttccatctgtggaaaaactgtcttccatgaaacttgtccctggtgccagccaaataggttggggactgctgtcataaggaataggagttccaaaacatttcctgtttttatctgggggcttccacctgctttcaagttagcaaatataggggattcaatggtagcaaatgtagggggttcaatggtgaaagtttagagattctcctttattttttagaaggttacctttgcacctggttcaccttgcagaccagactctccctcagtgcctggaggtccctacaagagaataatttaacacattacaaaggcaatagcaatctcatgagaagatggtggtaacactgaactcaagggtgagatacctgtgtccaaaagggcataattgctgtccctttataaacttcatagcataagagcagattctttctgacaccctttaattgtttaaatgtcaagacaacttcgtctaaaattaggacttttaagatccatttcttctaatcctttctctcatcctttaaacctcatctaaagggatttgttcttcctttccctttctgtagtgccttcaggaatctacttacttaaaaaattcacttttccttattggtttcataaaaatatcatgcaaataagagataaatttattcacattataaaagacacacacacacacacacacacacacacacacacacacacacacacacacagagcttcttttccagccttctttcatggtgggtccatttttgttgggaagctttcagttttctttactttgagaacatagaagttcttgcaacctctggctatttccaggcctaaagttcctactattgcttgatgttacaactatttttgtctccaagagatatttaccttatttataaacatgctatgtgtgcccctcccttccctttagggaagagaagagttttattggggacacgggtgaacaggtctgcagaaattaaatcatgtaaaccattacttatcatgttaagaaattggcattttatcctaaaggccatgagagctcttgaaacatttaaaggaaacgaatgatataagaatgataaaccggcaacaagtagaagatggaattataggagttggaggagacatggcatgagagtgtaggggctattacactggcaatagggataaaaaggaaagggtagatttaagagagaatgggcaggggcaggcctattcaaaaggaaatggtcactgatttgagaggattaggtagaagaaggagtctaggatgactcttagttttgggttattgggtataagggatatctttcattgagatgggaattaaacagaggaagaacagtgggacagtaatggatttggtttagatattttgaattgtagatgtctgtgggatatctaggtggatgtttaaaaagataacaggaaatcaataattggatctgaggagagaggtataaaatacagctaccaagttgagagctatcagagtaatattggtacttaaagtcactgtgataatatgatcactaagccaaggaagtaaaagggcaacttcaggtcaagactgagaaaggctaatgagaaggtgaagtgacaacaggagagagcagtttcacagcagccaaggaaggaaagaatttgatttatttagtgctaaagttacaaacaatggaaataaaataattggatatttataacaaatttggcttataattccaaaatatatcccaaattgggtaatgtctcagtattcttctatacagggcatataatatcttaggatgaaaggttatcaagtcaactttaaatcagtgaagggaaagctctatctactttttgttctgtcatttcaatgaggtaattattagagtagaactttatatgtataaaattagacatataataatcatctctgcttttaatggaattttagtttttttctgaatatgaaacaatactatagaattattcctcatagtatatatttaattattaattttaccttagagtcttacaaaaagtagaatatttatgaagaagaactagccacaaaaaatttacctccatgcccatttctccaggaggtccaacatcaccttgcagtcctcgcagtccctatattaaaataaaatttaagatatgagaataaaagtttactctatgtcagtaaatgtattcatctggatatgggttttataatataacacataacacatgattatgtaaatacataatacatttatcagcatattactttactctgtataaacaaaattatatctttaattgattcatgtatgtgtgtgtgtttttgtttttgagactgagtttcactctggttgcccaggctgaagtgcaatggtgcagtctccactcactgcaacctccgcctcccaggttcaagcgattctcctccctctgcctcccaagtagctgggattacaggcaattgccaccacgcatggctaattttcatatttgtagtagagatgggatttcactatgttgaccaggctggtcatgaactcctgacctcaggtgatccacctgcctcagcctcccaaagtgccgggattacaggcatgagccactgcgcccagcttcatgtgtgtttttaaaataaatttactaagctatgcttatattaaaaagaaaagagtggcattcattcttttattctttaatgcactcattcattcaacatttattaagcacctcataagtatcatatattgtgctaagcattttgacaaggtatcttatctaatgtatgtgatagtcattcatctacttaaaattcctagcaaatatgtgacaaacaaatttgcatcttaaagaagtaaatatatgatctttttttttactgactgtacagttttacccctcaagagtgtcatatagttggaatcatacagcatgtaaccttttcatactgacttctttaacttagcagtatgcatttaaagttcctttatacatttttgtggcttgatagctcatttatttttaatgctgaataatattccattgtatggatataccacagtttgtttatccatttattcattggacattgttttagttcactcaggattctataacaaaatagtataaattaatagcttataaaccacacaaatttatttcccacagttctggaggctggaaagtccaagatcaaggtgctggcagattcagtgtctggtgaaggcccacttgctgcttcatagatggtgccttctagttgtgtcctcacatgttagaagaaatgagctagctctctcgtgcatcttttacaaagacactactcccaatcatgagggcacagcacctcaaagatcctgccctataataccattaccttgggaattgggatttcaacatatgaattttggggaaacacggtccaattatagcagacatattggttcatattggttgcttcaaattttttgcacctataaataaagctgctataaacattcttgtacaggtttttgtgtggacataagttttcaactcatttgggtaaacactaaggattgtgatcactggatcatatgttaagagtatgcctagcttcttaaaaaactgccatactgtcttccaaattggctgtaccattttgcattctcaccagcaatgaatgagagctcctgttgctccacatccttgccaacctgtggcattatcaaagttttagatttcagccattctaacagatgtatagtggtatgtcattattgttttaatttgtaatttactaatgacatatgatgttgagcatatttttacattcttctatgccatttctatatcttctttggtgtggtgtctgttcagatttttgccaacattttaactggtttttaaagaaaattgttgagttttaatttttttttctatattttggatacaagtcttttatcagatatatgttttgaaaatattttctcccagtctgtggactgtctcttcattctcttaacagtgttttttcaaggcagatttaaaaagatgttaatgaagtccaacttaccagttttttctttcatgggttgtgcttttggtgatatagctaaaaactcatcaacaaacctcaggtcacatagattttctctatgtttatattttaggagttttatggctttgttttttacatttaagtctatgattcattttgagggtgtgtgtgtgtgtgtgtgtgtgtgtgtgtgtaaggtgtaagatctgcatctagattcacgttttgcatgtggatatctatttgttccagcataatttgttgaaaagactatccattgtattgcctttgctcctttgtcacagatcacttgattttatttgtgactatatgttgtgtatattgtgtagaacaaagagtataactgttctatttctgggcttaccactctgttccaatgatctacagtcgacacttaaaacaacataagggttacagtgccaacctcctgcagagttaaaaatctgagtacaacttttgactcctccaaaatgtaaccacttatagcctactgttgactggatgccttactaataacataagcagctgtttaacacatattttatatgttatatgtattgtatactgtattttaaagtaagctagaataaagaatactgtattcttaagtggaagtagagcatcatcaagatcttcatcctcattgtctccatgctgagtaggctgaggaggtggaagaagggaaggggttgttctcactgtctcaggggtagcggaggtgaaagaaaatccacaaataagaggacctttgcagttcaaacccgtgttgttcaagggtcaatcgtacttgtctattcttttgccaatatcacactgtcttgattactgtagttttacagtaaatcttgaagtcagtgtcagttctccaagtttgttcttcaatattgtattggctattctgggtcttttgcctttccataggaacttcagaatctgttaatatctacaatgtaacttgcttggattttgattagaattgaattgacttgatagatccatttgtgaagaactaatatctcaacaatattgagtctttctacccataaccatgaaatatccttccatttatgtagatctttaatttctttgataaaagtttacctcatatagatcttgtatatattttgttagagttacaactatttctttctctcttttttggtgctaatgtaaatagtattgtgtttttcattttaaattccaattgctcattgctgttaatatagaaaagcaattgacttttgtatattaacttataccctgttatgctacaatctcattataactgcttattagtttcgggagtttaaaaaatcagttcttgaagattttttacacagacagccatgccatatacaaagaaagacagttttatttcttctttccaaatttgtatactttttcttttcttttcttattgcactagctaggacttccagaactatgctgaataggagtcaaaatttaacaaaggaggaacatgttttccttattcccttgttcttaaaagaaaagtatctagttttctcaccagtaagtataatgttggctataaggttttttaaaaaatatgtttttcaaaaagctgaggaagtgcccctttattccaagtttgagagttttttttttatcttgaattgttgttggattttgtcaaattatttttctgcatcttttcatattacattttcatttagcttattgaggtgatggattacattaattgacattctactgttaaaccagccttgtatacctggaaaaaattccactgggttatgatgcataattctgtttatacattgtttgattcaatttgctaatattttgttgaggattttacatctatgttcatgaatgatattggtctatagttttcttgtgatgtgtttgtctggttttgtttttaaggtaatgctcacataatggcctcatgtgtgtggcctcacataattaggaaatattctattgtttctattttctggaacagcttgtacataattggtatcatatgttctttaaatgtttagttgaattcaccaatgagataacctggaaccagtactttctgttttagaaggttattagtgattgattctatttctttatcaatacaggttgaggaagatattgatggatatcaaatcaaatcaaatcaaatcaaatcaaacctattcaggttatccctttctgtttatatgagttttggtaaaatacgtcttttaaggaattggtctatttcatttaagttatcaaatttgtggaaatattgggaggccgaggcgggccgatcacgaggtcaggagtttgagaccagcctgaccaacctggtgaaaccccatttctactaaaaatacaaaaaaaaaaaaattagccaggtgtggtggtacgcacctgtaatcccagctacccaggaggctgaggcaggagaatcacttgaacccaggaggtggaggttgcagtgagctgagatcacgccactgcattccagcctgggtgacagaacgagactctgtctcaaaacagaaaaaaaaatttgtgaaaatagaattgctcataatatccatttattgtcattttaatgttaatgagatcagtagtgatggcctctctttcacttctgatattagtaatttgtattttctcctttttttccccttggttagcctggcctgaggttgattaattttggttgcattgatgttctctattgttttcctgttttcaatttcactgatttctgctgatttttattacttattttcttctgcttactttgtatttaatttgcttttcttttatagtttcctaggatggaagcttagattactaatcttaagtatttcttctttcctcttattcagtgctataaatttccctctaggcactgcatcccacgaattttgacaaactatattttcatttagttcaaaatatttttaaattattcctgaaactccttctttgaccaataagttattaaaagtgtattatttaatctccaaatgttttgggattttccagccattttctgttactgtggtgtgagagcaaacattgtatgatgtctagtcttttaaatttgttgttggccgggcgcagtggctcacgcttgtaatcccagcactttgggaggctgaggcgggcggttcacgaggtcaggagatcgagaccacggtgaaacccgtctctactaaaaatacaaaaaattagccgggcatggtggcgggcgcctgtagtcccagctacttggagaggctgaggaaggagaatggcgcgaacccgggaggcggagcttgcagtgagccgagatcggccactgcactccagcctgggcgacagagcaagactccgtctcaaaaaacaaaaaacaaaaaacaaaaaacacacgaataaaaaaatttgttaaggtgttttatggcccagaatttggtctatcttggtgagtgttccatgtcagtttgtgaagcatgtgcattctactgttgttggataacatattttataaatgtaaattagatctagttgacttacggtactaactctctcttgactaattttctgcctgctgggtctctcaattactgatagaggggtgttattgtctccaactataataatagagtcatctatttttccttgaaaattatctcagcatttgcttcatgtattttgatgctccgtcgtcaggtgcattaagtactgttatcctagcttggagaaatgaccctgctatcattgcaccatgtctctctttaccctgacaattttccttgttctgaagtctgctttctctgaaatataaatatttccagctttcctttgaatagcgttagcatggtatactttccttcatatttcacatggatttcttgaagacaacatacaattgggttttgctttcctattcactttggcaatctcttatttcttaagtggtatacttaaaccattgacatttaagtgactatgatatcattgagttagtatatatcaactgtggactgcgttagttttcatttgttgtctttattctttattgcttcttcttctttcgtcttcttcttcttctttttaatgtttttggcttctcattttattttattttaatttttatgtctatttcttttttgagatagagtctcactctgtcatccaggctggagtgtagtggcatgatctcggtgcactgcaaactctgcctcctgggttcaagagattctcccacttcagccccctgagtagctgggactacaggagagtcccaccatgtccaactaatttttgcgttttttggtagagatggggttttaccatgttgtccaggctggtctcaaactcctgaccacaagcaatctacctgcctcggcctcctaaagtgctaggattataggcatgagccactgtgcccagtctggcctctcattttaattaagcgttttatatgatttcattttctttcctggtttagcatacaaactatactacttttaaaactttttaaagtggccactctagagtttgcaatacatatttacaattaacccaagtccattttctttctttttttaaaaaccctacagcacgtggtattcctaggccatctccaatccctgtactaaccagtcctgaccctgtttagcatccaagatcagatgagattgagaacattcagggtgctatggccattgatcaagtccattttcaaataacactataccacttcatgagtagtgccaatactttataacaattcctccctcttgttccttataacatttgacttatccatgagatacaataccgaatacactgttgctattattattttgtacaaattgtctgttagatcaattaagaattataaaaatattttattttacctttatttattccttcgccaacactcctttcctagatgagtttcttacctatgccacttttcttctctctgaagaacttcttttaacatttcttgctggtctgctagtgacaaattctttaaatttttgtttgagaaagactttatttctctttcactttgaaattcccagtttcataattccaaaatgtctgctatccctgagtctgtttctgcttgtctctgtagactgtttttgccttttaccttgccttataattttttttgaaagccagacatgatgtaaatgtaaatgaaaccaaggtgaataggcctttaatgtgatatttgatattatctggctgggggttaggctgtgtttactggttgttgtagctatggtgtctcaggctaaaatgtcctctaatgtcattgttttttactcccctgttttatttagcctttctgagggactctttaaatagggtttgtggcacagttcctttagctataatctgttattgcacaggaaccccactgatttgattgtaaggtatgagtgtaggaagggcattctatagttctacaattaggtctcagtcttttagtgagtctgaattggatattacccttcttccacatcaaaggccagagggggctggagtggaatatttctcttcctccagctgaaggctagagggaggtgaaattaggttttcctttcccaaaggtcagttagtctttggtaaaacaccagtttattctctgataaataatttccctggagggcaagaactgttaaggagatcagagaattctaggtgtttttcaaaatgcttactatccctctccctctgctggaagtcagagggaatttttctctatctttaaagtaagaacctgttagggctctgggaggaagtaaaactcaggaacatgtaggggcctcccaaagactgggccctctctgagttttttaacactcaagctggtctacactgagtctccagtaatttgctaattatagtttaaagtgtccctactgtcccggtgtgggctatgtagttgcctgtctgtctctccattttgggggcagtagtttgtcttgtaaccttaattctctgacagatctaagaagagttgttgattttcagtatgtccatctttttttcttgttttgaggatgggagtgatgacttccaaattccttacatttcataccagaaaacacatttatttatttacttatttagaggcagagtcttgttccgtcacccaggctggagtgcagtggcgcgatctcggctcactgcaacctccgcctcccaggttcaagtaattctcctacctcaggttcctgagcagctgggattacaggcacccaccaccatggctggctaatttttgtgtgtatatatatatatatatatattttttttttaagtagaaactaaatgttggccaggctgatctcaaactcctgacctcaggtgatccacctgctttggcctcccaaagtgctgggtttacaggtgtgagccaccgtgcccaactcagaaaacactttactattgtcaacctaaatgacaaagagaaagaggctctctaaaataaataacgaatttattttggaatagagcattgcaatgggaatatgcatgccatagtaagctatgcacatattcagggagataaaggaaggtaatggtttttaaaggaaaaatgaggattatataattgttttgaaatgattatccttggctaaaaatatcaacaacaatggtgacaccagtccaaggctggacaggctgttgctgggcagatgtcttttcagaagtattttttgtatatgggtgcaaatgtcctttgggcaaggttgtgatttttgcaattttttgtgatagtttttgttatcaggcatctaagaatgagaactctgtctttatggccttcagctctatttgtcaggtttttcttttattttcttaacatcagtgactccattttgattctgacaactttcacattatgatttttaaatcttttttaggggggagactggattcagctagaagccaaattgtgttccacacacaataactttttttttttttgagatggaatctcactctatcacccaggttggagtgcagttgtgcgatcttggcttgcctcctgggttaaagcaattctgcctcagcctctcgagtagctgggactacaggtgtgcaccaccacatctggctaatcttttgtatttttagtagaggtggggtttcactatattggtcagactggtcttgaactcctgacctcaagtgatccatctgcctcggcctcccaaagtgctgggattacaggcgtgagccaccgtgcttggcccccatgcgatgatttttaaagaatcaaaaatggttggctggatgtggtggctcacacctgtaatcccagcactttgggaggcagaggcgggtggatcacaaggtcaggagatcaagaccatcctggctaacacggtgaaatcctgtctctactaaaaatacaaaaaattattggggcgtggtggcatgcacctgtagtcccagctactcgggaggctgaggtaggagaatcgcttgaacctgggaggcggaggttgcagtgagccaagattgcaccactgtactctagcctgggcgacagagcgagactctgtcttaaaaaagaaaaaaaaaatggttgctaaattttagactacttgcttttgtatttctcattatatctgtgatatattaatagatttcttaataacaaacttttccttgattgtaattcttccttttacttcattaaggtggataattctttatatacatggttaaattttacttaattttttgtttagatttttacaattacatttgtaagtgaaattcatctgccactttattttggctgctctctttgtctgactgagatgctgatatagagtactcttatcttttgtttccgagactgttgccactttatctttacaagtgatctaatgaggaactgagtgaagttttattatacacttttagttaacttgagaatcctgttaactattttttgaggtaagtggaaatgacttctggtatctaagaaagagtagctagaaaataatattttaaaatttacaaggggatattataaagcaagcttatgaagagttaattttagagtacagcattccccttgttccctctttaaagtcagttttcaataattaacagatattaactatatttatttaggtcaggagattttttttcaacttgtcttctgaaacggaagaataaatgaacaaaataataaaagagagaatggacaaatatcaccattctcctcttattgaaggcgattgggtacagttgtgcaggttgaacactacataaaccaagggacattatttgttacaaggtttgcattgattagacattttctttctgtacgtgtgtgattaaaatctacatcaggggtcagcaaactttttttttttttcaagggcaagacagtaagtattttaggcttgtgggtcatgtggtctctgtcaaaacttttaaactttgctgttatagtatgaaagcagccatccatacataagggaatcgttgtggctgtgtttcaataaaatttgatttacagaagtataactggactgagggctgtagtttacctatcctactttatgcctacgtacttctaaggggatctaatattatcatgaagattttaagatgggttatgtttatggctgaaactcctaacttacatgtctgattttcctcttattctctcagtttcttgtgcagtttcaaccttttctgccagcgttttgtaaatgttgtagttctttaagcctcagccttagatctttttcttttctcacttctatactctttccataggcaatgaatccaacattttttaacttcagtgtattcctctactctgaagccaactgccaacttcatgtttctcaaagacacctgaaattcaacagttaaactgaatttataatcttccattctcaaacctacttttccgtgtttttttttgtttcagtgaatagtatcatcaactctttaatacaataagccagaaatttaagaattatacttcacatacagagtctttattacctattggttttatctccttttgaattagtctgtccacttcttttccctgctcataaaaaaggtcctgccattttttatctggattattgcaacagccagccattcttggctccctccattttgtaatttgactgatgtttacaaaatagatatcagataataaactaaataatctgataataaagctagcccgagccctttaataacatcctttgttctaaggataaaaattaaaaatgttggcaatagccctcataaatctatgagtgttttgtcacctgcctcatttctatccctatctggcacttacttatatataccagacattataccaggaaaggggattacaaagataaaagaaatggtctctgatttcaagcagtgtacagactttttaggggatatacttaagtaaataatgctaaagagagttgcattattttaggtcagataaatatcagaattgaaatggcaggttaagatatacataatagggagaaaaccaagaaggatttagcttaaaaaatcaacaacatatctaagattctttatttggaaagaactataaatactgtcaaatcttcacttattgtttgagagcttatatcacagattaagtatataaatgaggaaaaagctaaggtaagaatagctcttttagtgttagaattttccatttgctactaactaaatgaattatacaaaagccacctgtaaacctttgtgtcaaccgataataaaatcaatgcagttgtttgaaagactatattgtattgtacatcttagaagcacattatagcacattacatctgacactattaaccagaagaatgacttcattggcaaaaaagaataaattgtaagaaagtaggtgtgacaggtctttccttttcacaacgtaccgtccatggaaactccataattgaatcatatttatgaaactatttcataatgatttcataagtttttgtattgatgcaagcttttgtactgttgatgtaactgcatttctgtcatgtttgcacattttggcccatcagatgtaaaatttggcttctctctgtatggtcttctaattatagaaattgcctcataaatgtgattgtgcgtgtgtggcaacataataattataagaacagcaagccattcagaaagagaatttctgagattcaataaaacagagttttatttgttgaaaatagaaatatgctcagatttaacagctccagaaaaacagcaccatatttgactatatgcaaccagaaaggcactataaactattatttttcattctatgtgattagtctatggtgtctatgataaatgctgctttctaaaacataccagtcacagcacagcagagcaataatggaaatgtaaatgtattttatgagaaagacacaattagaaaagtataaagataaacttactggctctcctggaagtcctctgtcacctgtacttccaggcaatccctgtaaaccctggacaaataaaggcaatacttgtaggaaaagtggtgtgtgaagatgttttagacactttccttaccttagctttcctatggatccttccacccaacttttctgtctattgctattctttttttttttttgcttttgtggtaagatacacacaacataaaatttactattttaaccatttttaaatgtaaagtttgtggcagtaagtgcattcacaatgttgtgtaaccgttaccagaactttttcatcttcccaaactgaaactctgtacccattaaatactagctccccatcacccctttttttctatttcctggcaaccaccattctattttctgtctccatgaatttgactaccctaagtacctcatattagtgagatcatacaatatctgtctttctgtgactggcttatttcacttagcataatgtcttcaaggttcatccctgttgtagcatgtgtcaaaacttcctgctttttaagattgggtccactgtatgcatattccacattttgtttacctattcatctatcaaagaacatggatcacttccaacttttggctattgtgaataatgcggctattaacatgggtatgcgagtatctgtatgagtcccttttttcaattatttgggtatctacctagaagtggaactgatagatcatatggtaattctctgtttaacttcttgacaaaccaccaaactgttttccacagcagttcccctattttatatttgtaccagtaatgcacaagggttctaattcctccacatccttggccacacaaattttctttttttttttttagaacagcattctaatgtttgtgaaatagtatcccatggtggtttgattttcatttccctaatgactagtgatgttgagtatcttttcatgtgcttactggccatttgtatatcttctttggagaaatgtctattcaagtcctttgctcatttttccatcaggttgtttttttattcttgagttgtaggagttctttatatctacccctatttttatttaatcctcactcctatattgtgacaaataattatccaaaattattttaaatctgaatttctttatagttttaatattcatataaagtttcctttttccaaaaataataatccttgtgatgtgttaataagtatgacttttgcctttaaaccctggcaaggcacaggagtcttggaacctagataactggaaataaccatactggacctgtaacttccttttttccccatctttacactctttgtagtaccataaaagagcatctcagatatgaagtagatagaacactaaaccaaattctgagtcttctctgactcagtcaaagatttattgagcatttactgtgtgcgaggcactgatgaccactgacaatacataacatgttgatccttttgtaaattgcatctttttttcttttttttttttgagacggagtctcattctgtcacccagactagagtgcagcagcatgatcttggctcactgcaacctccacatcctgggttcacgccgttctcctgcctcggcctcccgagtagctgggactacaggcgcccgccaccacgcccggctaattttttttttttttttttttgtatttttggtagagacagagtttcaccgtgttaaccaggatggtatcaatctcctgacctcgtgatccacccgccttggcctcccaaagtgctgggattacaggcgtgagcctctgcgcccggccgtaagttgcatcttctacattattgatctcaggaaagctgataactatacagctaatcacaaataccattttaccttaaaaactaaaaggtataaaaatatgacattaaattagaagtaaagatattcaaagttcttagcaacacactatcttctaagttataatctttaatgctatgttcagtttttctggctagggaaagggaaatatgtaaaattatggactcccatctggttgaggccctgtttcagtcatgtaaatgatatggtgcctatttactccaggatccttaattaagagagaggatcattataaggaatctctctgtgcctagtacaccaactgaaatatacagaaaacttcagaactttaaataatgtctgcccaattttctttgtaaagtatgtttagacataatatcaagcttatcatgtacttttaatgctgttgatactgcataaaagctcttttgcaaagctacgaaataatttaagtggactctgtttttattggggataaagaggaaaagcacaagctggaataaaataaaaattatctttaaggcttttcagaactcccttctctatgacttcaacccagtaactatgataatgatgaccatgaggataataatgactattttggttgttatttattagagcctgtgccaggaacataataaatatcatttgttatacatttattatgactatgaaagatttcctatatcaaagatagagaaactgaagcccagagaagttaagtaatttgtacaaagtcaagactgctagtaagtggcaaaaccaatatatgacttccaatatgattgattccaataaaatataatgatacattatatgcaagggattaattttatatatatataactgtggactacttatcagaaataccagcggccaaaagaaaatggcaagttatctttatagtgctgaatgaaaacaaaaaatcccccaaaagactctgtcaacctaaaatctgatatccggtgaaagtatacttcaaaagtaaaggaaaaataaagacattttataaacaaaaactaagagaaatatgtactagcagactttactacaagaaatataaaggatgttctataggttacaggaaaatgacaccatttggaaacacaaatcttcagaaaggaatgaataacatcagaaatggcaaatatgtgggtaaatgataaacattttttccccattaaacatctctaaagtatgtatttcatttacatcatgaaaatattttatttatattaaagcaaaaatcataactttgcaatgcgtagtttaaaatatatgtagatgtaatacataaaataattatagcataaaaaatattagtaaatggacctatattgttggcaagtttcttacacttgtgttaagtatttacataaaatacttattttgtggcacttcacaataaaagtttgctgtcccttgacctagaataaccatggaaaattatgagaagaaatagagctaaaaatccaacagacagattaaaatagaattctcaaaattattcaatgccaacagaagacattgaacaataacaataaaaaggacacaaagaaaaacagatcattaaatgggagacccaaatctaaccacatcaattacgtatcaataattacattaaattgaaattgaacaaatgctcaaattaaaaggcagaaattgtcagaatgaataaaacacaaggtccaactataagatattcactttaaatatcaagacacagataggttgaaagtaaattaaggaacaagatatgccatgtaagcagcaagcataagaaagctggagaaactttatgtgagtattaatatcagataacatatacttcacaacaaatagtattaccaggagtaaaaagtattaccagagataaacaagaatattttttaacaaaaaaaggatcaattgatcaggaagacataataattataaatgtgaataaacttacaatagaatttaaaaatacataaagaaaaattagaaagaattaaagggagaaatagagaaacacaaaaattatagttgaagaatttttacacccatctcacaaactgatagactatctagataaaaaaaacctcagtaacgtatgagttatgatagtttttatattatttagagaacctaaaatagtgatccaggccttaacaccttaataacacaatggattgtggtctttcttcctgattttcttttgagtcagatgtatgggaggcaagtattgtataggaaacagtgttggtccacggacaaatatacttttactagttatctggattaccagagcactatatgttgccagttttcatttaattcctggcttaaaattatgaaaatttagagatggagagggtcttagagctcttatcccaaccattttttaaaattcattttaaaaataaaaaatatgtatttttagagatgggggtctcactacattgccctagctggtcttgaactcccaggctcaagagatccttctgcctctgcctcccaaagtgctgggattacaggcatgagccaccatgcccaggcctaaccaatttaaacaaagttatatggtttttaggagcatacactagaccaaaggacaatctgacctcgaatttatctttctaatatacagcactgcctgtttgttgatagtgcataaatgactaaaaacgctaagactgtgctgaaggatcaagtgaacctttggggcttgtctggcttttttcagttgacttttcccagcttctccaagatgtcaatccaatcccatcatgtcaatccaatcaaggagaaggagacaatgtaggtatagagctaagtaaacctcaacaactattataaattcatatttaatgtccaaccatgtcatacactaaggtaatttaattcttccaggagtctatgagacatgtttgccaggtaaggttacaaaccagggtaaggttacagaatgattctagtatcttttatttaattgagaaagtcaaacatgaaatatcatgtttatacaggcatacattgatgggctgaaaatgaaggtaaaattctagggaaggtcaacaatgaatgacctatatttttacctttattttcagctcatcaatgaatacaaaatgaataagtaattttatttctctgggtctcattttttttttaaatgagagggatgaacttgacctccaaacttttccactcactgcaatgtatcagcactgtataaagtatatcaaagtagtcataatctatacaaacaccatttatatcaatataatagaaactcaggtgatgaatattaaaactcaagtaatattctttgaggataacgttaatcaataatacaatgccacacacaagttctttcctagacatagtcatttgttttctgtcttaggtctctggtattttaggttggatcactgttaaatacaatgttattgtgggaaacagcgggcagggggcagcagatttcaaaaaggaacaagcaaatgcagtgacatttactacatagacaattattaatactgtagcggctaaaacatttttattctatccttttctgtctcccgagctgcaatctatttatattatctatttttataactttatattatacatatatgtgtatataacaaatcaaaatgtcatcattaaaaattaaaattctgaatgaaagtaaaaatatccatatacttaagcttatgtgctcacatacatgtactatcttacatgtctatgtgtaagtatgcatgtgtgggtaaatctttaacatttttttcctcttacttagtgatgataaccatagaacttgttgcctctcagggaaaaaaatgtataattctggtaagatttttgatggtaggaaaataactagtattataaaatattaacaactcttaagcagtgccatgggaaggcatgaagacacacacagctctatactccaaaggcctaaaaggaattcaagttgagttaaaagaaaactaggcaagaggcctgaaaaaagttagttattatgttagctttattaatgtctcattatatttatatgtcacaccattttattttgaaatgggttttacagtaaaagtaatttatcataactagagtgaagtaaaagtaacagttataaccaccagttatggataggtacaacccaggcccagaatgggtaagcaacttgctcaaataaaacaatgacccaatgattaaaggagaaaaagaacttatattcttttagtccaacatattgaatactaaacaatagttgtattagagaataaagcagataaaggtaatcagctcataatttatacatatatcaaaatatcacattgtatactgcaaatatatataatttttatgtgtcaaaaaatcccccaaacattgtttgagcagcccctttcccccaaaaatgcagataaaaatttttcatagcatgattttttaaattacttactggtttcccttgaaatcctctttctccagggtttccagtcttaccctacatgagaaagaaaattcttgagtcaagtagtcccctccaaaaagattaatcatactaagaaaaacaaaaaagacttaaaatgttcatctttaatgtgaaatgttttattacttacaataagaccatgaggccctctttttccttgatctcctttttcaccctaacaaagtatcaaagccaggtgagttagtaagaatgtgaattatggtcttactatgctagcatatgctagcatacactcacatacaaaaaagacagtaagtatatagttcattattgaaaagaaaacatctctgcctgtgtagtaaaaactttatgcgtttcatacttagacaaagagaaaacttagaaccatacttttgtagggaaatatattgttttttagactagtaggacatatgatctcaataaaatttaactacatatgaaatgagaaaaatcaatgattaccttggcaccttgtataccttgttcccctaagagaccatctggtcctcttgatccctagaggtgaaaaaaatatcctgttgttaatttgaaatgttcctttttttttcttaacagttatgtgtcctcacagatgaacatgttgatgattttttttttttgagacggagtctcactctgtcgcccaggctggagtgcagtggcgcgtctcggctcactgcaagctccgcctcccaggttcacgccattctcctgcctcagcctccccctgagtagctgggactacaggcgctcgccaccacgcctggctaatttttttgtatttttagtacagacggggtttcactgtgttagccaggatggtcttgatctcctgacctcgtgatccacccgcctcggcctcccacagtgctgggattacaggcgtgagccaccacccaccgcgcacggccaagatgttgattttatgccctgacaacagaaaataatacagctgggtatatggctcaacctatctgcatgggagaatcagcccatgtttttaagatttaatgacaaatagtaagtcaaatgagcacaaaaatagctaacacagtagttgaggtggttataatataggtgtgttatttgggtatttcgttcactttataatttactcagcagccagccagaatttgttcttaatcaactctaaattaaaagtggctggatttgtttctctaagcagtctccttaagtttaatatttttaaatggtgctcttctcttcacattattagaaaatgatagcaatgcaggaacagaaaaccaaacaccgcattttctcacttataagtgggagctgaatgatgataacacatggacacatggtgaggaacaacacacactggggcctgtcagggggcctcgggggagggagtgtatcaggaagaatagctaatggatgctgggctttataactaagtgatgggatgatctgtgcagcaaaccaccatgtcacatgtttacctatgtaacaaacctgcacctcctgtacacgtacccctgaacttaaaataaaaattgaagaaaaaaaaagaaataaagtttagctggaataaaaaaaaaaagaaagaaagaaaatgagtgctgactgcattgtacctgctatgcaactgcttgtcaggaattactgggagatggcaggggcacagaaaaggtagagaaaatactactgaaaatattcgtgtaaatttaaaacttctcagtgttcattcaataattagttgcaaaaaagccgttgcaaaagtcattctataagaaaatgacagaatagtcttccattaaattataactttctttggaagatcttaaagtccttgttcagggacttgattcaattctacagactctaactgaatacctgtggaaaaggaattatgttaagtgttacagtgatttataattgagagaaagtttctctactatacaaatatacaaaagacaataatatacagagagataagacatgccaaggaccaaaacaagaattcaaagagggagacaaacttcacatttgtaatgggaaataaagatatttttagcagctggaggtcaagttctcatagacttattcaaaatagaagaaactctacaatgagggatagtatgtgaaaaaaatatagaggcatgaaaacagatactcaaagaataaaaaagtagtttgtttggttaggctattgattacatgttgagaaatattaagatgtaagtgtggaaaagaagactgggacttataaggtgaaggtctgaagttcacttacaaataatttggcagaaaactgatgctaaagatttctatacagaacggtgatacaaatctcccaggacaacatacagatttgaaggagtcctttaggcttcagaatcttctcttgtatcccatctgagataagctttggtttagctttatattattaaaagctatttactataataggactctcttcttgggaactcttagggtaactgcattccttgatcctctgaggcacattcagggatttggacagaacacacacttcatggaggatctgtagctccactgatcctgataaagccatagctccggccctacaatttctaagtctatattcaaggtactccataatctattcccaactttctttctgctctattttccaatgaaggactgaaaaactgaactacagtcttactgtgcaagaccttgaagatcaagttgaggagcatggacttaatttcatagatcagtattttttaacatgtgttattcattcagcagatgtataccgagtgcctactataagccagcattgttttaggtccagaggacatggtagagagaagagacaaatccctgaattcataaacaagcaaataagtacgtaaaactaaattataaaatgaaaatatgtagttaagtataatgaagaaaaacaaagaactagagagtatccaaggtggggaggactatttcagatagggtggcctgaaaagtctctctaaagtgacatgtgggtagacacctaaaagaggtaagattgcaagctatacaaataatttggggaagatcactgtagcagaaaaaacagcaagtgcaaagttctgatgaggggtcatgcttagaatattcaataattgagtagccgaagatgaaaaaagaacagtgttcaaaggatgactcaagttttaagcatgaaggtccctcaggaatttgctctaataatcaccctcaaccctcaagatgatcttgaaattttagccgtctctattgattctttttctctagcaccttcaatgcctaattcttctctttttgctccaaaagaaacacagctaatttttttttgagtaacaaaagaagaaggccaaaagactgtgaaaaggaatgagtggtcaacattctaaaatactataaaaaacaagtaaggtctaaattgaaaatgtgtccactggtaattaattgggcccttaaaactcctttacaacctagaattactatgtatttctttgatattttattactgagtaattggtagaagataacagcatcaatagaaaacaaattagaaatgtaggtttgcttagggtggagagggaggagtagtggaagataaggagtttgactctagatgatcaagcccaatgaagtagatatctccaaggctagtgatagagagttagaaagttagaagtcattctaagtttacgtggtggcagccataagcattaagcttcaaaaggcccctggacacatagttgtatatttagaattttatttaaaaagattgtttggtccaaagatagaaaatacatttcatttcttggataaaatcagattaagtggctgcctagatacacgtagaaaaggctgcatctagctggagtaagtctcataattaattgccagtttcttgtttgggcacagaaatcacctactgccatagctgaactagtccaaatcccactttttaagatgaagaaactgaagtctgtagatgttaggtgagtagcctgactcccacgatgtctaactgtacaaagactgaacgactgtgctttattaagtttataatattttttcaaatgttaaaaagaaatgaggttaatcccgtcagcaagtgaattcagactggaagagaggacctgaaatttagaagtttacaaaatgaatattaaacattcacaagtaaagtgctgattggtattgcaaatcaaggaactccctctaaaattaaggaatacatatagtaataataaccactcattttatgttttacatttaaaaaatacttttactactcaaagcaatctagagattcagtgcaatccctatcaaaataccaatgtcatttttcacagagatagaaaaaaaatcctaagattcatatgtaacacaaaaaagaggctaaatagccaaagtaatcctaagcagaaagaataaagctggaagcaccacactacatgactttaaagtacactactgggctgagtatggtggctcatacctgtaatccaacattttgggaagctgaggagggaggatcacttgagcccaggagttcaagatcagcctgggtaagatggcaagaccctgtctctacaaaaaatttaaaaattagccaggcatggtggaatatgcctgtagaaccagctacttgggaggttgaggcagtgggatcatgtgagcccaggaatttgaggcagcaatgtgatatgatcgcgtcactgcactccagcctgggtgacagagttacaccccatctttaaaagataaaataaaataaaatatactacaaaactatagttaccaaaacagcatggtactagtataaaaacagacacatagacaaatagaacagaaaagagagcccagaaataaatctacacgtttatagccagctgatttttgacaaaggtgccaagagcacacaatggggaatggatggcctcttcaataaatgatgttaggaaaactgtatatccagatgcagaagaattaaacccttatttagcaccatatacaaaaatcaacccaaaatgtattaaagacttaaatatgaagacttggaactataaaacttccagaagaaaaaggggaaaagctccatgacattggtctgggcaataatttttgggttaaaacctcaaaagcacaggaaacaaaaccaaaaatagacaaatgggactatggtaaacaaaaaagcttccatacaacataagaaacaatcaacagtgtgaagagacaacctgttgaatgagagaacatatttgcaaactattcatctgacaaggaactatatatccagaatacacaaggaactcaaacaactcagtagttaaaaaataattctattaaaaattggggaaagaacctgagcagacatttcttaaaagacagacaaatggccaacagacacatgaaaaaatgctcaacatcactaattatcaggaaaatggaaatcaaaaccacaataagatatcatcatatcacaggaagaatgactattattaaaaaaacaaaaatcaatagctattggccaggatgcacagcaaagggaactcttatatgctgttggtgagaatgtgaattattactaattccatagccactatggaaaagagtatggagatttctcataaaactaaaaatggagcctgggtgtggtggctcatgcctgtaatcccagcactttgggaggccaaggcgggtgggatcacctgaggtcaggagtttgagaccagcctggccaacatggtgaaaccccatctctactaaaaatataaaattagctgggcatggtggctgagtagcctgtaatcccagctactcaggagtctgagacaggagaattgcttgaacctgggaggcacaggttgcagtgagccgagatcatgccactgcattccagcctgggcaacagggtgagacaacaggatgagactccgtctcaaaaaaaaaaaaaaaaaaaaaaaaagaactaccatacaatccaggaatcccactactgggtatttatccaaaggaaaataaatcacatatcgaagggacttttgcacctatgtttattgcagcactattcacaatagcaaagatatggaatcaactaagtgtccttcaatggacaaatggataaataaagtgtggtatatgtacacaatggaataatttgtaggaacatggatggaactggaggtcattatattaagtgaaataacccaggcacagaaagacaaatgccacatgttctcacttgaaggaatgaaggacataccatcccaaaatatgtcatgaaaacactggagaaattgtagtttccaaaagggtgagctgatctgtctccttctgcatgcagcaagcaataaagatccctctgggagggctaccttctccataccagtatgagaaaatagcccttatcaccagagtcttacaattgaaggctgcaatggacctgaataaacacactttaatgaagtaactcatatcttccacctgttttacaccccctcgccaatatatctcttagtgacttccctagaaatgtttaccactttagctagattttctttgtcctgtcactttttctcaaatgtatcactctttgtctaagaagtataaaagcatcttgtttggggcacttcagacttcactctcttgtaaagatccccatatacacacaaaactaatataatttgtaacttgtctcttgttaatctgcctggtgtcaatctggtttccagatcctgctgaagagcccactgagggctaaaatgggggctggaggtgatctctggctgccctacacactcatatgtgggagctaaaaaagttcatttcatggaggtagagagtaggacgataaataccaaaggctgggaagggtgtatggatgggagagggagataaagggaggttagtgggtacaaacatgcaatgaaatagaaataagttcttttgttcaataacagagtagggtgactatagttagcaataatttattgtatatttcaaaataaccagaagagtggacttgaaatgttcccagcacatagaaatgataaatgctaaaggtaatgaatgaaataccctaaataccctgacttgcttactattcattctatgcatgtaacaaaatatcacacccaccccataaatacgtacaaatacgtatcaataaaaaagaatgcttccttaaaaaaacccattacttagaaaaatacttttactttattatttcattttataagtcaagacaacacagggaatgaagaaagagaagttctgtgcccacagtgatgataaccacatttagtttaaaaaacaacctgaaggtgtaagtaatgcagttatattaattaaaggtaataaagcctaaagttgctagttaagagtttaaggctggcagaagaactctaggaaagcttggtactctctctgtttaaagcaagagtaagctaattaactgaaagcttagctttatcaacatctttaaatttcacgctgatattggttatagaagttatcccatgggttactgtatatgtctgctttgacttctaagacaaaataagctttacgacaggctgtaagaaagtcaaatagcattataataggcacctaaatttggcatagttatatattaaaataaccgtttaaaaatatctcatggatattctcttagagtaactatgctggctaaagagaaaatctaatatttacattcttaggaaaattaaagttggctgcactgagctgtattagtaagttctcatagcagaaataaaaatttgatagcttagctacataaactaagcatgttttataaaataaatactgcttgaattatgggcaataactaaattcataaatgatcaatttacagaaccactacttcgtatgatgttaacattactcatgtgcctaactaattaggcctagcagtcttttctggctcttgatttacacagctgaaacaaaacgttctattaaacaaaaactaacattatcagtgattttaaggaaaaaaatattttgattctattcttgttataaactatttcaggagaagaaaccacagaggagctctgccttatcatttggagtgcttcaggtattgaatctagctttgaatctaaatgcgaaaattgaggactgcttccccctatatggtaagcatttccttgaaagggacaaatttcagaatttctataggcagatcaattttacttcctccatagaaaaccttaaaacattacatatttttaatagagttattttaatctttccctcccatttaaatcttaagcagcatagtctgaataaaaatgctcagttgtatgcctctatactgcccctctagagaaagagtgcaaacttaaacatgtctcatgatccttgccaattcataatcaagaaaaaagatgaggttaacttcgctctgtgtcatctctcctgtttgggtagctggacacagaggcgtataatggagtaataccaagggatcagttgcctagttctgaagagttccatgtgcagctgatgttgtgctgatttctagtgacccaagaggctaaaccactatctttctggtactgaattagagaatctgctagcttatattgtctacacaagggacatgattttgtatattatactaattagctttggtatgttaaactatttcattttatttaattattcttcagctaaacatgcaggtagaaacaaagcttagagtatgtaggataaataataatactttaaagtttatgccatgtttcttatctaagaatctctgtaagaatgatatttttagtcaatcctgttatctttttcagctatataaaaggcaaggttacttatttcttgagatggtaggacattattatttgtttggggttttcctgtcctttggaaaaatttcaatactgcatggtacttcaaaagccatcagactgtaaaatctatgcagtttagatgtaagagataattaagtctagaatcctccatggtattaatagtgtttgacaggttgcagggaatcagtaaatgttagatagctgtaaggtggatggatgggcaggagagaagcagatagtaagcagactctttggagtagtcctacccttcatgatggtcatatggccatatgttaacagcatcaatcacagtcagaacagcaagagagtataactaccagttccataatgaaaattctctgtgtggtctctgtgcaaatgtacttagggcagagcttccctccaacatgctatgacacgtattttccacaaagagattacaggtatgctgaaaatagtgccctcctcagcctttggggtggcaaggaaaagccagacacaggaatctgcagctaggtccccttttcatttatctcagtaggctggaccaatattctcattttttgtgagtgaaaaacattgggaagaatgggtctagagtattgggattacagccctagtggggaatggattgaagagagaagagagtaaaaataggaatatatcagtggctaccagaagggaacttcccaatgctattttctttctcaaatattctggtcttcggtatgttttctgtatgcccaatgtccattgtttacctaaaatagtagttcagtaaagaaggctctctctctctctctccctcttttaaagcccttgtttctaaacaaatcttccttgtctggatactgggtaaaaattttaaaaatgatgaggagccatttcgggagagaatcagtaaaatgtatttgaaggatgtgaggaaaatagatccttggggaggtaggaattgatgacaaagtgacaaatcaggaaacagtaataggatcatggtgaagttagaaaactgcagaacaaacgaactttccatatgacttaatgagacagcacaaagtggtttaggaaaagactgtgcttagatacacagcttgtgcttaaggactcaaattacttaattaacaaaaggaacaagtaagtatttcttctttttttcatctgtcacaaattggttgaactttcccattatgacttatacaaagttgaataaacacatttgacctaactaaatattgaatgctggcagggtactaaccactaaatggcagtttgggtacaaatcatctatcatcattttttattttattttaaatctcatttgggctaatatattagagatgtgaccatagagtataaatctgtaacccaggaaggaaaatagtttttcagaaaggaaacattaataaaggcaaatctgctctctttcttcaagcttcaccgaaaacacaggatatgactttgaagtcattacttcaaactgggaattcattaacaattttctcccatttgccaactggaaaactgcaaggtctttttttttttttaccatggttaggtagaggatatttttagaattttaaaatattttcttcataagctctaaaacttaaatcaaagtaaggtcaaggcataacacagaatccttaaagcccacatatccaaattaatttaaaaaatactccctgatattccatatggtattgaatagcatgggctttggagtcagacacactaaggtttgaatactgcttgtgccatttctgtgtgtctatagaggccgtatacttaaactttgagagccctggttccctcaactataatagctaagatataatatttttctctctctagtggttttgagtattgagataatatatgaaagagtgcctggcatgtgacaggcatgcaataaatagtggctcttatttctttaaaaaggatttaatgtttaagatacaacttaaagagatgaagatttattatttaattctgtatacatgattattagacaatgatgattataataactttgatttacaattaataagctcttattcatcttgtgtatctttgttccacttcttattgcttttattttgtcatgatgttatttttccttgctatgtaagtctgtagagaaataattcatttaaagatcttcacatttaccattctctcaaagaatggaattggaggctgggaataagaaacaagaattctatatgagttagtgatacatgtaaaaattaaaatggaaaaatgtgattttataactacaaaagattatgagttgtatttcaattaacatagggcattcatctaatataatgaaaatagaaaaaacctgacaagatctaagcagaattctagaaggtatgatgctatttttgttgcacattttccactatttatgaagtaattttgggggggttaatgtacttttttccttagattacttactctttgtcctttaggaccttgactcccaggtggtcctcttgcccccacatgaccctatatgttgtaaatttaaagtcagttgtagaatttacaagaatactatcagaataatagccataatctttcttataacatatatccttctcccaggacatttttacaattgattagtcttccttaaaaatatgctttaatcacactgccctctaccaatattctgcttttgaaatattctactatttggacaaatttaatgtctgggtgtttacaccctgaataaaaaatggagaagcttttaatattcactgaccaagtcgttttcagaaggaacacatatggagtgatggaggaaggagatatccattgagctagacagaccggtctaatctgcctggcccatcaaaaaagcaatggctatcatggtaatatttctttactattattctagatatttatgccaatcccatcacataaaaatagtttttttgttataaaaatgccacaaaatgttccaaattactatgctataaaaatagcctgcaatggagattaagttgctatttattattaagtcaattataatgaattatttttatagctatagtctttaattaagactcaactggaaaacaaaatttatttatctattaacccaaggtagataaaaatgaagtaaactttagtatttcaaatttatttattattttatgtgactaaagatattagtaactgttcttgagactactcttcctaattttaaaagccaacaacatatttgcaaatatactagaaaattgggcttatttttaaaacagaagcttcacaaataataaaagtcttcactgataagaaaagttctgctcaggggatcctaaaggccgatcttgttcatattttaagttcataatagctgtcagattctgataagcaaaattaatttaggggaaacacttcatcatctttttgtaaacaaatggaatattttcaatactacaatttttgtttaataaatacatatttttatgaattttatctggttgtgataatatttacaaatttctgagaaaaatatgttgaagcttacacttgtaatttatttatccaattggtctcacttctaatcttaataatcctgtttccttatatgtggttattcaaaagaaacttcaaagcattttagtttaggttgcagaactgaaattgattgtataccaagtagaggtgaggcagttcaagatatcatgacaaattcaagagtgttttgtatagttgggagagaagcagtctccactagtttacacatgacttactttgaataaaaaccaacaataaagcataacaatttatgagtttaaattaaagtaaacattccggaaggaatcataaagtctttcctgtacttacaggtaatcccaatggaccgataggtcctggaaccccaggaggacctggatatccctataatttaaggaaaatataaaagaagtaaaatattcatgactttaaattattttcattgaagacaagccagtaaattataaacaataataaaaagggataatttgacacaatgtttcttttgtaaccaagatatgaaaggccacaggaaatattctgcagatagaccatagaaataaaaaaaaattttctgtagttttatttacatagaaactatatatccatttattagaaggtttttgcctagagaagaaaattgctagctagaatcacatactacagcctatttataagagaacattcatttcatttttctgaagatcatgttatcttatccatggatatatgttgtgttatataggttatgaaactatatccttttcggagaggtccaggagctctctaattaagcaatgtaaatgtgtacaaatattctagcatttcaaactttagaaggaccacacactttatggtattaacactgattcaaaaaatgcgttaggaggtaatgattcttgaagttgattagtcttacaggcatgctaaatttcctagctgacagcaactggaaattgcatagcttaaaaaacaaaacaaaacaaaacacttataggacttttctgataatatagaagttagttaaaatcaatttgtagacagtattatgtgccaccagatccattacaaggcattttctgtatggaatatccttttattgataataattattcactccagttcctgccatacttagaaaactatttagtaagttaaaaagatgtaacccaaatataaaatttgtcagctatttcctatattaaaagtgtaagagaataagatgaattctggattctaagctctcatatgtcaaaaaactacatcatgaccacaaactcatggaagaatggcagtgctgatatgtgtcatatcaacaataggctgtagaagaataagtagaactctaattttaaaaggtgaaagatttatacaatccgaagagaaatcacagtatgtagaattctaattgaattttcttctttatcttttttagcaaattgtggtggtcaaattcctttcctaaaactagaatcatttgactaagccatctcatttacatgcttttgagtaccttagtatcacatagcattctgggagataaaccatttaaaaataaaattctatgggaaatttaacattttttactcagttaaattccagcccaggcaattccatctctggaacgacttgcttttattgcattctttggaaacatatttttcaaatcactgagctcttaccataacacctttttctccctgcggacctagtgggcctggacttccacgttctcccttttaagagaacaaagaaaaaagagtaacatagaggcatattaattagtcatgactgagctaagcctagaaagaaaaactgtcatccagaatcatgtcttacatgcatacatcatttttatttccaataatttttaaatttacaaatttggcgctttatcttaaaattattagacttttaataaaatagaattatcttaagatgttttttggagaaaaatattaaagtccttattaaaatgaagaaaatagaaattatggataaacaagacttaaaagtgagcacacatcatatgttaaagttttgtaagaaatgcttactattttatgagacatacaaaatatgagaatagtgaaagtatcaaagcatattaaaatgtaacaaatctgtgtaaccatttaagaaaattttattttatagtctgcctaccacaattaagtgccataagaaataagtctggaagatcatgataatcaaatctgtcatagcagcttaaaaagactaaactgattcacattaaaattctcaagagtatcaacattttagtacagaagatttaactcagcacagaaataactaattgggtgaaaaaaattataatgcaaaattttttaactgcactcattttgttacattgttagtaaaaaatcaataagtatatattaagtatgtagtatttaagtaattgagaatgtagtacatgagagttagaagagatatttaaaaaactaaacttagattctaccctcagtaactgcagacactgcagacatgatattaacagagatgaaacaaccagagagtaagtaaattttgactatgtggtactattctaagtccaagaagtgaagaaattaggaaggatgagaggagtctgtggacttcatagaggagatgggaattcagctgagtccaacagtttggttttgaagaaacagagggaaggagagaggatattttagttcaagaaaatagtaagaatggaaataggaacaagctcaagcacaagatggggagagagaaaggtaaaatggtaacttattcttctttttcaaaaactgctttctttcaagcctctcatagaaggcttgctctcatgaagtcgatttacataatattttctagtcagaaatctagactgttccatcttttctcttcagatcacatctttataatcaaaagggtactctgccctttaaaaattagaaacctacatgctgttagctatatttcaatatatttaagatattcagtataggtaatgtgctaaagttataagtgatttctaattaacataaaagatcatatgaaagtctgccttttgaatttagcctagatttcttcctataaaacaaaataattcttaaaaaattaccttttcgccaatgcttccagtcatcccaacttctccaggtaagccaacaggtcccttttaggaaaaaaaaataacagaaaatacacacatattgtattgctattgtagtgcctgggtcttaaatcacctgtaatcactatgtttctttctaacttatcctaaatgttatcttggagtaaaattcctccttgtatagctatgcagtctgtgacttcatatcagaattaatttattcagtcagtcaacaaaaatatatcagtgcctaaaatataacaggcactacgctgggaggcaatgagtttcaaatccacagtcgctgtccatgtggaactgacatgctactagattttataaaacccctgacgttttcatacctgtttgatgtggatatattcgtttaagaaatcatttctgtaactaccttttttgaaagcccctcaatacacaagcggacagaacatgcctatcattcattcatccactcaagaaatatttggtgcctactctgtgccaggcactgtgatggttgctaagatttcattactgaggaagacaaatctagaccctgccctcttgaggcaaaaagtctcataacagggagacaaaagcaactaaattaaaagttaaataattataaattctgacataagctcataaaggaaacaataatattgctgaagaggagaataaaagagaagacctattttagcacagatggtcagggaagactgaggcctgacatttaatatgaaatctgaataataataagaggccagccagccaaagaagggaggaagaatattctaggtagagtaaatagcttgagtaaggaatgaatttgatttgctagaagatgttaaagaaggtaatcagttacaccatttcagagtgaacacgtctcagggtttttccatctttgtctttacggattctcaattatttctccttcaaacagtacagaaagcaaaaagaataacacagaacaagcttgacaagaacataatctctttcttgtcttaaatcataagcagttactttctacttttatttaaagacaaatgaaacttttttcaatagctaccatgcaaagaccttgtttagatagattctcatacgatagtatacattagcatacagaaagcactgactcatgaaaaatgacttgtcatttatctaatgcattgagcatgattttacccttacagatctctatctatctaatgatcccatatatataacatatattaagtgttttctatgtgcctgatttaatcttcacaaccagcagatatagtattatcatcattcccctttgacagatgaggcagatgaattaaacagtttgctgacacagatgaggttaaatggtatggatgagtttaagtggctattgagcacttgaaatgtggttagtgcaaattgacacatactgtaaatgtaaaagacaccagattttgaagacttatagaaagaatgtaaaatagctaactaatgattgcttacatcgattacgtattaaaatgatactgatttgatatattggtgtaaatgaaatattactaaaatcagttcacctctttctttttatcttttttaatgtggctactagaaaatttaaaattatatatgtggcttataattttgacttgcattgtatgtctattggacagccctgatgtatacttttaggcactatgctaatattattgcttaaatctagttggaagtgatttaataatttgtttctgtggtttttaagtgtaagagactgaacactttcattctgagacaatctattatcaatgttcatgtgcatggaattcactggtctcactgtgttctccaccattctgagacagctggtttgataaaacggtgaaatggcatttttaagactcagttacaaggccagctaggtgacaatactttgcagggttggggcaagactttccagaaggctatatatgctctgaatcagtgtccaatatatggtgctgtttctcctataactagtattttggggtccaggaatcaaggggtggaaatgggagtggtactactcactattacccctagtcatccactagaaaattttttgtttctgcccatgctctgctggactaaaggtcttagttccagagggaggaatgcttccaccaggagacacaacgatgattccactgaactagaagttaagactgccatccggccactttgggcttcttatgcccctgaatcaacagccaaagaagggagttactgtgttggctatgttgcttaattctgccttccatagggaaatgggaccttcacaatggaggtaaggaagagtgtgaataaaatacaggagatcccttaggatacgtcttaatatcaccatgctctgtgattaaggtcaatggaaaattacaacaacccagttcaggcaggactacttactagtgacccaaattcttccggaatgaaggtttgggtcaccccatgtcttagtccatccaggctactataacaaaaatattgtaggctgggtgactttaacaacaaatatttatttcccacagtgttggaggcttagaagtctaagatcaaggcaccagtagattcagtatctagtgagggcctgctccctggttcatagatggcagagccctcatgacctaatcatctcccaaggtctacaccacctcataccttacattggtcattagaatttcaacatatgaattttgcagaggataaaaacattcagttcataataccccaccaagtacagatcccaactagctgaggtgcttgctgatggcaaacggaataaagaatgggtagcggagaaggtagttttaaatacctgctatggccatgtgaccagttacagaaacgaagactataattgtcatgagtatttcatcgttattttgtcatgaatgtgtgtgtgtgtgtgtgtgtgtgtgtgtgtgtgtgtgtgcagcaaatatctttggttcttttcttctcatttctttttttcttttcttttttttttttttcttgagatggagtctcactctgtcacccagcttggagtgcaatggcgcgatcctggctcacagcaacctctgcctcctggcttcaagcgattctcctgcctcagcctcctgaatggctgggattacaggcgtgcaccaccatgcctgattaaatttggtattttcagtagagacagggtttcaccattttggacaggctggtcttgaactcttgacctcaagtgatctgcccaccttggcctcccaaagtattgggattacaggtgtaagccactgctcctgccctctcatttctttatcatataacataagacgtattgaccttataacagtatctaagtatggttaattttacatcatagtatttaagttacaggttataaaggagaagagtaaacatcactcaaggactttacatcctcttctggaaaagaggttagtgagtttttggttacatgcaggataatgatatcatgttaggcagaattatgatcttattattgtctttatttgaaggttaagtatggtttaaagagatgcatttgggggcaaacttgacaatggggagggctgtcacggttaattttatgtgtcaaggtcactgggttacagagtgctcagatatttggctaaacattatttctgagtgtatgttgtttctaggtgagattaacatttaaataggtaaactgactaaagcagattgcctttcccaatgtgggtgggcactgtccaatctgttgaggatctgaataaaacaaaaaggcaaaggaaaggaaacttttctctccatctgactgcttaggctgggacattagtcttctcctgcctttgaactaggacagcattgactcctagttctcaggcctttggacttggagtagaatttaaataatcagtgctgtaggtctcaggcctgtggactctgatagaacttacactgtcaattcttgtggttctcaggcctttgaactcggactggaactatactggatttctaggatctcctgtttgtggatggaagactgtgagatttttttttagccccccacaatcatgtgagccaattctttataataaatcaatctatctatatctatatcctgttggttctgtttctctggaaaaccctaactaatgctgtcaatcaaatctgagcaggaaaaatgaaatagagctatctgttgtgagacagtaaacaaaataacagaaactgaacacagactagtcaaactattcggaaaaaatcatttttctttttgagacagagtctcgctgtgtcgcctgggctggagtgcagtggtatgatcttggttcactgcaacttcagcctcctgggttcatgcaattctcctgcctcagcctcctgagtagctgggactacaggcacagagcaccgtgcccggctaattttttgtttttgtttttagcagagatggggtttcaccatgttggccaggctagtctcgaactccagacttcaagtgatccacccgccttggcctcccaaagtgataaatcctttttctaagacatatgatctaggggagtgaatgcagtaggctcgtttagcttatcccatgtgcaccagaacaatataacctacaaatgtattctgcttagcctatagcatttactaaactgaactaggtaaaaacatttaaaaatctggagattttacatataaatactttatatataaagatttataaaattattagcttcagatgacctagcaaatgtagacaaactttctcaaaggcaaatattggacagaactaagtaactgttgtactgttgagatccagatgcactctttactttgctattccctattgtctcttatacatggcccattttacttatttatactatctgcctggtcccaatagggcatctgagttttttacttcatgtaagtattaaaaggtgcagtcagtcaaaagggcataattggaagatagaggttctcactaaaaagtagatagttcacagggttccggccatgcccatggatatctttaataaaacttaaagttggagaacataaattaaaaatggtttccttgcagcctaggcaacatagggagatcacatctctataaataatctatacataataataataaaattagctgggtgtggcaacatgttcctgtagtcccagctactcatgaagctgaggtgtgaggatcgcttggactcaggaggtcaaggttgcagtaagcctgagtgacagagcaagaccctgtctccaaaatacataaaaagaaaaacgtactatttcagtaccttaaaaagtctaaccaaaacatatgtcaaatctgataataccacaagtgttggctagaatgtaaggaaagaagaactcatacatacacagcaggaaatagcaggaaatagtataaattggtacaatcactttggagaacaatttattatatatagtaaaattgaagatgcccctaacttacaactcagcacttctagttgttcacatggaattctactttcacatgtatgtactaggagacatatagaaagacgttcattgctgtattatttaagtacaaaagtagaatcatcggcattatcagtatggacacagattaactaaaatgcattcatacaataaagaaaactcttgaatgaccaatactgagaaataaacagaaaacctcaacaccagctaaaattaatagaccagatctatatgtatcaacatggataaacattttaggaatataatgttgactgagaaaacagcataaatccttttcaaaaggatacatcattatgtgttttgtgcaaaattttaaaacgcatacaataatctaatttcttactggcagaagacacatgggaattatacacacaactttaggataagggctaatgtctgtatatagagtagtggctcattatttttttattttgaatttctctgataactagtttctctgagtctgaacttctcttcatttatgtgttcatgttttggactttttctgcttagttcttatccatgtcctttgctcaacttattttttcccattaagatttcctaaattttcttgatgattttcaggaatttttatatatttgaagtataaacttcttattggttttattttattttatttattcatgttttgggctttttctgtgtaattcttttccatgtctttgctcaatttattttttcccattaagatttcctatattttcttgatgattttcaggaatttttatatatttaaagtataaacttcttattggttttatttatttatttatttatttgagatggagtcttgctctgtcgcccaggctggagtgcagtggcatgatctctgctcattgtaacctttgcctcccaggttcagcttgatcctgccacctcagcctcctacctcagcctcctgagcagctgggactacaggcatgcaccacgacgcccagctaatttttttgtagtttttagtagagacggggttccaccatgttggccaagctggtctcgaactcctgacctcaggtgatctgcccgccttggccttccaaagtgctgggattacaggcatgagataccgtgcccaaaccttattggttttagatgttctaaattccttcttgtgataaatcacctgtgaaattatttttgatatctttcattgacaagaagtccttaatttttatgtggccatatccagtgtggtttttgtttttttttttggccttatgatttgtattttctggatcttgtttaagaaagctttccttatttctatgtcattaaataatgggcattcttttctattgctgttaacttttctatctagaaaagtttctttaatccatctggagttcaattttcacgtggtataagatagggatccagttttaattttttgcatacagggacccagttttccaaatgctatatattcagcactatttcttacccacctattggtttatggtgccattcttgtcttatacatggcttatttctaagctttctagtctatcttatgatgatttgtctgtttttctccctttgcaaatttctctcactccatttttctaatgtttttatggttgtctctactacagactgaaaataagcatgccaacaaaggtttatatcagtggtaaggaatgtgaacatacaggctttaaatctattcagtctttaagtctatattactctttgaaactgtgtacacacttggaaataatagatgaattagacaaaggtatttaaagctgaggtctgccaaatttcatggaatctaagatatcatggattgtaagatacaccaatattttttaaatctctgaatagagaaaaaaatctcccaagcaattgtaatttaccactgatcatgagaaatatctcaatttttaaaatgtgaaaatgtgaaaagaaaaaatggtatagcagattgttttactgtttgaaatattcactgctcctttctgtggaaggattatacctccctatgctactgatgtcagacttggccatataatttggagtgcccgtcaccatgggaggaatatacccctgcatcttattaatgtcattcttctctatgtaacttcaaataaatagaaagtgatatgtaccactttttttttaagtcagtttcttttttccttttgccatgagactaaacatgttccacacaggcactgctccttaagcctgagtctccgaatgcagataacatgtaacagagtcacagccaacccacagtgtatagagtgcaagtaagaaataaacttttattattgtaaaccactaatatattcaggctgtttctttctgcagcataatttagcctaaactgactgatgcaatatgtccttttaagctgatatgacatggcaattattaacaggagaagcatgtggttttctctaattttatcccaagtgctaatgaccctaagagatagatggagccacaagaaagagggggcctgggccaggcatggtggctcatgcctgtaatcccagcactttgggaggttaaggcaggaggattgcttgaagccaggagttcaagaccagcctgggcaacaaagtgagaccctgtctctacaaaaaagaaaaattaaaaattagctaggtttggtggcccgtgtctgtagtcccagctactcagaagactgaggcgggaggcttgagcccaggagttggaggctgcagtggagcaatgattgcatcactgcactccagtctgggtgacacagtgagaccctgtctcttaaaaaataaaaacaacaacaacaaaaaccaagagagagcacctggttttcttaatcaacttgtaggggagagctacttaggaacaccttcaccagacaattaacatgggcaaaaataactttctgttgtgttaaaacaacataaaatatttaggtttacttattatggcagttagtgttatcctaaaaatacagtgaatttacgtattaacataaaattgaaaaactgtgaaatctaactcaattagtttatttgaaagttaatctcacagaaagtgcactgaatcaatttccagtttagtacagttgcaaatcaatttcttcaataaatgcaaaatgaggtgaagaaaataaaattaagcatatttatttgttcatgtaacagatcctgtgctaagatttagctggagaggatatagagatgagtaaaatatactaaggagttcaaaatccagtaaattggaataaggtaaacgtatattttctaaaagttaatagaagaagaagtaaaataatatctaacacaaaggcagaagagattatatctggttgaaaacatgagaaaagactttacagagaaggcagcatctcaggtatggttacatgttgacatgatgaaatggtgaaagtgtattccaagcagagggaatgttttgagctaaagatgggagggagcaaatgataaaacatttgcaaacacaaagttaatccacattgtctgggacacagaatatgtgtaggggaataggctgggatagatacattggttatatactatagacggctttgaataccaagtgagaaatttgtgtttgtggtatctgcagaagagtgtgtgcttgtagaagaatcactattggttttcagtaaaggaggaatataatcatatctagacttgaatgggtggtaatttaacatcactgtgtttaatgtgtagaaatgggaaaaatagaaaataggacaaacaaatcattataatagtccacattaaatgtaatgactggtatgaggacaatatcatcattaaaaaaaaacagtaagctcaggagaaaagccactgttagaggaaaagtgacgaagtaagccaacagacagttgtgcttgtaaagaatctatcttgaaatactgatttgtgtctccatagaacaatcaattgttgaaataataagaatgatgtagtacatacgctgatgataaaccaggaacaagaagggaatctaatgaagattcattggaggcaagaggtagaaaaaaaaaaacaaaaacaaaagaaagagtcacaaaagaaagagtcaaatagtcatgttccaagatggccaaataggaacagctctgatctgcagctctcagcatgatctgcatttccaactgaggtacctggctcatctcattgggactggttggacagtgggtgcagcccatggagggtgaaccaaatcagggtggggcatcgcctcacctgggaagtgcaaggggttgggggacttccctttcctagccaagggaagccatgacagaatacacctggaaaatcgggacactcctgcccaaatactgcagttttccaacagtcttagcaaatggcacaccaggagattatatcctgtgcctggcttggcaggtcccatgcccatggagccttgctcactgctagagcagcagtctgagatcgacctgtgaggcagcagcctggcagggggaggggcatctgccattgctgaggcttcagtaggtaaacaaagtggccaagtatacaggcaggtgcccctctgggatgaagcttccagaggaaggatcaggcaaaaatatttgctgttctgcagcctccactggtgatacctaggcaaacatggtctggagtggacctccagcaaactccaacagacctgcagctgagggacctgactcttagaaggaaaactaacagaaaggaatagcatcaacatcaacgaaaaggacatccacacaaaaaccccacctgtaggtcaccatcatcaaagaccaaaggtagataaaaccacaaagatggggagaaaccagagcagaaaagctaaaaattccacagagtgcctcttcccctccaaaggatcacagcttctcagcagcaactgaacaaagctgggcagagaatgactttgatgagctgatagaagtaggcttcagaaggtcagtaataacaaacttctccgagctaaaggaggatgttggaactcatcgcaagtaagctaaaagccttgaaaaatgattagatgaatggccaactagaataaacaatgtagagaagaccttaagtgacccgagggagctgaaaaccatggcatgagaactacgtgacgcatgcacaagcttcaatagctgattcgatctagtggaagaaagagtatcagtgattgaagatcaaattaatgaaataaagcaagaggagaagtttagagaaaaaataataaaaagaaacgaacaaagcctccaagaaatatgggattatgcgaaaagaccaaatctacatttcattggtgtacctgaaagtgatggggagaatggaaccaagttggaaaacactcttcagggtattatccatgagaacttccccaacctagcaaggtaggccaacattcaaattcaggaaatacagagaattccacaaagatactccttgagaagagcaactccaagacacacaattgtcagattcaccaaggttgaaatgaaggaaaaaatgttaagggcagccagagagaaaggtcaggttaaccacaaagggaagcccatcagactaatagcggatctcttggcagaaactctataagccagaagagagtggggggccaatattcaacattcttaaagaaaagaattttcaatccagaatttcatatccagccaaactaagcttcataggtgaaggagaaataaaatcctttacagacaagcaaatgctgagagattttgtcaccaccaggcctgtcttacaagaactgaaggaagcactaaacatggaaaggaataactggtaccagctgctgcaaaaaacatgccaaattgtaaagaccatcaatgctaggaagaaactgcatcaactaacgggcaaaataaccagctaacatcataatgacaggatcaaattcacacataacaatattaaccttaaatgtaaatgggctaaatgccccaattaaaagacacggactggcaaattggataaagagtcaagacccatcagtgtgctgtattcaggagacccatctcacatgcagagatacacataggctcaaaataaatggatggaggaagatctaccaagcaaatggagaacaaaaaaaaaagcaggggttgtaatcctagtctctgatgaaacagactttaaaccaacaaagatcaaaagagacaaagaaggccattacataatggtaaagggatcaattccacaagaagagctaactatcctaaatatatatgcaaccaatacaagagcacccagattcataaagcaagtccttagggatctacaaacagacttagactccaacacaataataatgggaaactttaacaccccattgtcaatattagacagatcaacaagacagaaggttaaaaaggatatccaggacttgaactcagctctgcaccaagtggatctaatagacatctacaggactctgcacctcaaattaacagaatatacagccttctcagcaacacatcacacttattccaaaattgaccacatagttggaagtaaagcactcctcagcaaatgtaaaagaacagaaatcacaataaactctctctcagaccacagtgcaatcaaattagaactcaggattaagaaactcactcaaaactgtacaactacatggaaactgaacaaccagctcctgaatgactactgggcaaacaacaaaatgaaagcagaaataaagatgttctttgaaaccaatgagaacaaagacacaacgtaccggaatctctgggacatattaaaagcagtgtgtagagggaaatttagagcactaaatgcccacaagagaaagcaggaaagatctaaaattaacaccctaacataacaattgaaagaactatagaagcaagggcaaacaaattcaaaagctagcagaaggcaagacataactaatatcagagcagaactgaaggagatggagacacaaaaacccttcaaaaaatcaatgaatccatgagctggttttttgaaatgatcaaaaaaattgatagactgctagcaagactaataaagaagaaaagagagaagaatcaaacagacgcaataaaaaatgataaaggagatatcatcacggatctcacagaaatacaaactaccatcagagaatactataaacacctctaggcaaataaactagaaaatctagaagaaattgataaattcctggacacatacaccctccaaagactaaaccaggaagaagttgaatctgtaaataggccaataacaagttctgaaattgaggcaataattaatagcctaccaaccaaaaaaagtcaaggaccagacggattcacagccaaattctaccagaggtacaaagaggagctgataccattccttctgaaactattccaagcaatagaaaaagagggactcctccttaacttattttatgaggccagcatcatcctgatacgaaagcctggcagagacacaacaaaaaaagagaattttagaccaatatccctgatgaacattgatgcaaaaatcctcaataaaatactttcaaattgaatccagcagcacatcaaaaagcttatccaccattaccaagttggcttcatccctgggatgcaaggctggttcaacatacacaaatcaataaacataatccatcacataaacagaaccaacaacaaaaaccacatgattatctcaatagatgcagaaaaggcctttgacaaaactcaacagcccttcatgctaaaaactctcaataaactaggtattgatggaacatatctcaaaataataagagctatttatgacaaacccgcagccaatatcatactgaatgggcaaaaaactggaagcattccctttgaaaactggcacaagacagagatgccctctctcaccactcttattcagcatagtgttggaagttctggtcagggcaatcaggcaagagaaagaaataaagggtattcaattaggaaaagaggaagtgaaattgtccatgtttgcagaggacatgattgtatacttagaaaactccatcgtctcagccccaaatctccttaagctgataagcaacttcagcaaagtcttaggatacaaaatcaatgtgcaaatatcacaagcattcctatacaccaataacagacaaacagagagccaaatcatgagtgaactctcattcacaattgcttcaaagagaataaaatacctaggaatccaacttacaagggatgtgaaggacctcttcaaggagaactacaaaccactgaacaatgaaataaaagaggacacaaacaaatggaagaacattccatgctcatggacaggaagaatcaatatcatggtaatggccatactgcccaaggtaatttatagattcaatgccatccccatgaagctaccaatgactttcttcacggaattggaaaaaactattgtaaagttcatatggaaccaaaaaagagcccgcattgccaagtcaatcctaagccaaaagaacaaagctggaggcatcacactacctgacttcaaactatactacaaggctacagtaaccaaaacagcatggtactgttaccaaaacagagctatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacctaaatgttagacttaaaaccataaaaaccctagaagaaaacctaagcattaccatccaggccataggcatgggcaaggacttcatgactaaaacaccaaaagcaaaggcaacaaaagccaaaatagacaaatgggatctagttaaactaaagagcttctgcacagaaaaagaaactaccatcagagtgaacaggcaacctacagaatgggagaaaatttttgcaatctacccatctgacaaagggctaatatccagaaactacaaagaacttaaacaaatttacaagaaaaaaacaaacaaccccatcaacaagtgggcaaaggatatgaacagacacttctcaaaagaagacatttatgcagccaacagacacatgaaaaaaatgctcatcatcactggccatcagagaaatgcaaatcaaaaccacaatgagataccagctcaccccagttagaatggcgatcattaaaaagtcaggaaacaacagatgctggagaggatgtggaaaaataggaacgcttttacactgctggtgggagtgtaaactagttcaaccattgtggaagacagtgtggcaattcctcaaggatctagaactagaaataccatttgacccagcaatcccattactgggtatatacccaaaggattgtaagtcatgctactataaagacacatgcacacgtatgtttattgcggcacaatagccaaaacttggaaccaacccaaatgtccatcaatgacagactggattaagaatatgtggcacatatacaccatggaatactatgcagccataaaaagggtgagttcatgtcctttgcagggacatggatgaagctggaaaccatcattctgagccaactatcacaaggacataagaccaaacactgcatgttctcactcataggtgggaattgaacaatgagtacacttggacacagggcggggaacatcacacacgggggcctgtcatggggtgaggggcagggggagggatagaattaggagaaatacctaatgtaaatgacaagttaatgggtgtagcaaaccaacatggcgcatgtatacctatgtaacaaacctgcacgttgtgcacatgtaccctagaacttaaagtataataataataattataataataataaaaagagtcaaaaaggaggagaaccaggaatgcacaaagaaagatacagaaaataaaagtttcaagaagagagaaatctgtgtgatgtgggaaggtttaagaaggatgaacattaagacaaattcatagaatttagcaatcaccaggttgatggtaacctgtaggaacaatttcagtagcttttgtgtgtttggatatgtttgccaaagggttaagaatgtgtgtagggggaggaggagccaagacggccgaataggaacagctccggtctacagctcccagcgtgagcgacgcagaagacgggtgatttctgcacttccatctgaggtaccgggttcatctcactagggagtgccagacagtgggcggaggccagtgtgtgtgcgcaccgtgcgcgagccgaagcagggcaaggcattgcctcacctgggaagcgcaaggagtcagggagttccctttccgagtcaaagaaaggggtgacggacggcacctggaaaatcgggtcactcccacccgaatattgcgcttttcagaccggcttaagaaacggcgcaccacgagactatatcccacacctggctcagagggtcctacgcccacggaatctcactgattgctagcacagcagtctgagatcaaactgcaaggcggcaacgaggctgggggaggggcgcccgccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtattccaacagacctgcagctgagggtcctgtctgttagaaggaaaactaaaaaccagaaaggacatctacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagttacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaaccctccaagaaatatgggactatgtgaaaagaccaaatctacatctgattggtgtacctgaaagtgatgtggagaatggaaccaagttggaaaacactctgcaggatattatccaggagaacgtccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaatagcggatctcttggcagaaactctataagccagaagagagtgggggccaatattcaacattcttaaaggaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagctgctgcaaaatcatgccaaaatgtaaagaccatcgagactaggaagaaactgcatcaactaatgagcaaaatcaccagctaacatcataatgacaggatcaaattcacacataacaatagtaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaatgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcagtcaaagccgctcaactacatggaaactgaacaacctgtacctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatgaatgaatccaggagctggttttttgaaaggatcaacaaaattgatagactgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcagtaatcaacagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatacagcatataaacagagccaaagacaaaaaccacatgattatctcaatagatgcagcaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagatgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactataccacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaaccaaagccaaaattgacaaatgggatctaattaaactaaagagcttctgcacagcaaaagaaactaccatcagagtgaacaggcaacctacaacatgggagaaaattttcgcaagctactcatctgacaaagggctaatatccagaatctacaatgaactcaaacaaatttacaagaaaaaaacaaacaaccccatcaaaaagtgggcaaaggacatgaacagacacttctcaaaagaagacatttatgcaaccaaaaaacacgtgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagtccaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagattggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagtattgggagatatacctaatgctagatgacacattagtgggtgcagcgcaccagcatggcacatgtatacatatgtaactaacctgcacaatgtgcacatgtaccctaaaacttagagtataataaaaaaaaaaaaaagaaagaaagaaaaaaaaaagaatgtgtgtaggtgaagagaaaatgtaaaaaacttgtatagtttagatgattattttaataagttggcagcaaaaatgaggaggcatgaaaactgctaaaggatgtggttgcaaaattactctattcagtatctaatttttgctgtcagccaaatagagttcatcggcaatagaaaatgtacccttctgaacagaaataaattacattaaaaacctacgtttttgctgtgtttcacagaataattttttttaacacactattattatggcctaatctatcacgattggttgggaaccaacacactgtaacaggagagaagatgctggcaggattaatcttctcccaaagactatttcctagccagctccctacttctagatagctttcctacacttggaatgctccatccagggaaggcatgtattgtgcaaaggtgccatataacctcttccttcttaacagaagtactttctgaaaggcagactaaggtgctgtgacttattctcatttttttccatgaaacttcaagtatcatatatgctagtgagaatcagacaaatgcaagtgagaatcaagggcaaaattatattttcaattgtaaagttgtcaaaggcaaattatgtgcatgtggaaatggtcataatttatttatatttactactatagctctttaaaatagagacatgggtgaattctggtttgttcctatttattcttcttcattttaaaacaaatgttgaaatattatgtattactattttagttgtctactgctgcaagacaaattacccccaaaagttagtggttaaaataataaacatgtattatctcacagtttctgtgagtcagaaattcaaaggtggcttaaatggttagttctggctgaggatctttcatgaagttgcagtcaagatttggcattggctgcagtcatctgaaggcctgactgaccagaaaatccatttccaagaaagcttatttcctcaatccatagacctgaggacatagtagttggcttcccccagattaagtgatgcaagaaagagagtgagaaaggaagaagctgcagtgcctttatgatctagcacacattgacttctgccatatcctactcattagaaatgcataactgagtccatcctgcattcaaaaagagccaaagtagactgcacacttcagatggaggaatagaaaagaatttgtagatatatttttaaacaatcacaatgatttaaattctattcttggcttgatttgatattttattaagactttgactcctcccaatagttttctttagtttcttgcatgtatttttaagttatacacttctttgtgaacactctaaattagtgttgttggaataatgtacattttcctacagatgaaatgcataacatttcattcttattagttattatctatcatgaataaggtactatagtagtcaatttagacatcactaataactaaaatataaagtagatagccaaaaatgccagaagatgaactactatagaatagcagataaaacaggaatgagcaatctatggctctgatggctggctgcctgttttgtaaatagtttcattggaacacagacttgcccatttgtttacttattatctgtgactatttccacattatgcaggcagaactgagtaatttcaacagagaccatatggcccacaaagcccaagtcatttctgctggatatttaaagaaaacacaaaacagtcactgagccatagccagaattattgtcaatatataccaagaatttacattaaaaatatttcaaaacactgattccacatctaacacacaattaaaaaaaaaacaccaagcatttagctagaatatgctgtgtttcaagatccagacaaccatataataattgaaaacatttcacttttggcaaaatagtatattttgcaaaatggtctataaaaactttaaaactctctcctaatattttttaaagtaactatatcctatttattaactaaagactgatttaaattagaatatttcctgtttgaaactaaaaaatttttaaacatttatttaaaagttcttatgcttagatgagtcaccaaagagaatatgtagaacaaaaagaggaaaaggctacgaacaataacatttagagagttggttcggaaaaagaaaacttaaagttgactatgcataggaacaaagtgaactgtcaataggagaatactgtctatttttttccatagtgtttcttcagaccttttcattggagggtaatactatgacttgacaagtaggaatgaacactttctgtttatttataaatacatcactgtttccaaatagctaacctttggatcacttcactcctattttcaaatgaaatctgtaagctaagtatttatttgacagcatgacttgtagcaagttactttagctcactgtacttcatcctgtaccatttaggaagatgtgactttaagttcattggtctatatgctctgtaaagcagggatgatgtctgtattatcttctgtatcccaggcagtaggcataagggatacagtatcagactgaagtcatctgaaggcttgactgacagtttattaattcgggagcactttccaagtatcagactgtatcccttatgcctactgcctgggatacataagataacatacgtagaatgaatgagtgaacaacttagagcagtagtggtggaaacagaggtgagccacccacattccctttttatgacatatcttattaaccctgcaataagctccttcaagatttaggccttagcagagaggcctatatccaaagcctgattaaggcggggtataaaagtctggccatttgggcccaatgtctgactactctgatggtccaaacatttggttggtctcttccctccttctgggggattgcagagaagattgggtaaaagccaggatttaaaatcaaagtgaccaaattccagagaaggtccaactcctaaccaagacaagtctgttatgccaaagtcagggtcttggttagaaaaaaaaaaatggaactctgatacttgtgaaaacagtatctgggcagaggtccctgaagattttgaactgctagtctctgaactctaccagcttacacaagtggcctacttcttattataatttagcattctcccctaacataacctctcccctgtaagaaaacgtaacccagttaggattcccaccacctcctcttctagccattatgccaataactagggttaaatcacagcataacttgctgcacctgatataggcagaagggactatgacccaaggggataaaagatctcgtcagtatgtactggtaggagaagggggcatatatgtggatctgattgcacaggtatttgatcaagagaaccataatataacataaataacataaaattagatacggaaaagtttattaatttgggagcactttccaagatagaggaattaacactctggcaaggaccccaggaggttgcacaagctcctacagtgggtccaagctgtgaggcaagcagtcctgtactttgggccacatgacctggcagaccctacggtattagaggaatcaatggtggaaaaataagttatgcaaagcctatgttaagccttgatgggaagatcacagtgcaggctcctgagattttgtatcaaggctctgccacctgcagcagagatttaaacacattttgaaaaatgaattccagcataccggtagccttagtagagtctgggcacttaatcacaggacaccaaatgactacacatctgaatctcctataagctgagttccatcagattcatcaagtcataaggccaaccagttccagtgcattctgggaaggaatatgagcaacacagaggcacaagcagactgcataagcaagttgtccatattcccagccagtacctcttctttagctgacacctttgctctctgggggatcccttacgaccagctgtcagaaggagaaagcccaaacttggtttatggatagtaggcttcttacgtaggtgcaaactgaagatggatggcagctgagctacagcttcacccagaagtgccttaaaaggcagtaacagggaacatcttctaatgagcaagtctcaggcagtgtaccagatcattcactttgtgagcaagagaggttgcttgaggttagaataggtacagactaatggaaatttgtgagtgacctggctggttgattaggcacctaaaaggaagaatattgtaagactggggccaagaagatgtgagaaacaggaatatgggaggacatactggagtaggcacgaagtgtgaagatctttgtatcacatgtcaatatttaccagagggtcaaacatgaaagagtatctgcaggtagatttaatgactcagaaagctgacatcagcaagccttgatcatcagtcacttcagtgctggatgatggatatatgaatggaatggacatggtagaagagatggaaggtatgcatgagtctgacatcatagggtgcaattcaacaaggctaatataaatactgcttccactgaatatccaaactgccaacaacagagaaccatattaagcccacaacatggtaccattctttgagaagcccaaccagctagttggaggcaagttcattctggaaaggccaaagatttattctagcagaaatgacatatgctttgaaaatgggtggccttccccacactgaggcctcaattagtaccagtatttagtagcttaaaaagtgtctaatttaccatatgggatccccaaaatattatgtcagagcaggggactcattttatgcaaacagtgcagaagtgggcctatgaccatgagatctaattgtcatattacatcacatcaagaattttccaacttgagagagcattggaatagcctgctaaaggtacaaactaaagtgccagctaggaggtgatgctttatgaggatgaggcactatcctataggatgaagtatatacactgactcaaagacatttatatggtactgggtctctaataggaaatatggatgggtctgaaaccaaagtgtggaagcagaattagttccacttactatcactctcaatgtcccagtggaggactctgtgctttccattcccacaaaatgtgagctctgcagacatggaggccctcgtcctcaaagggaacacattttcaccaagtgacacagtgagagtctcactgaactataagctatggcaatctcttgagcccttcaatttccctgtgtccacaccccagcaggcaaaaataagtcaccatcttggcacagttaattcaccctgatcatcagaagagggagaagattaatatcactgaagtcttaaaatcagctgcagtgctaggggctgtaatttgtatgactgattcctcttctaagcttccctcaggaagagaatccactagaatcctaggacagcatctccctaaaaggatatgaagaagtagatccaagcagaacaaggagtagactgtggtgaacaccaagatatgcttccaaggtactccttcaaggaagaacttgtgtggcccaagctgtcagtagcttcatggtttgccttagttccagagagccttcttgaccaaaggtacatatacctttcccaggttggtccatatacagtgactgcttggagtaaactataaaagcccagttacttaagcctagcatgggactactcagatgggtcataaaggatttagagcttcttgcgggggtggttgaaacttagtagggtctgtgtcacagattgacttcttcctctacccaatcctgtttcttccctgactctttctacaactgttgcttcctaataaataccctgtagcgaaatgccatctcagcagtttgcctctagaaaatccaatgtgtgctcacagtttttctctaactgtggaactcaatccattgagggccatggaaatactgaaaagtgtcaccaaggttatatacagccactcagagtagactagatacataaaacgtatctaccgtaaatgatcctcattcttgagaacattggaaacaactaagatagaatctcttcttaaccaaaatctgtggttatggaaaaaatggaatttatacctttattcaatgttcacttatgcttgatggacacaacaactatcatacctagcagtgtggctcctaatgttcactgtagtttcaatgtctgggtaagaactgttgctatccttaggaaacacagaatgttttatcctgccttcctataaggaagaaaattgttcattacatatatatggtttctggggattggctcccaagtccaaagtgtaagaaaatagcatttggtatgtatcccaaatccaacctaatggagattctctgagacagcatctggagtgagatactcattcctccttttccttcatactaagtaataaatcttttcctgatgattggctggaggagaaaacttatagagctcaccaaagactgaagacactttgacagcaaaagctatagctttttataagttttttttggaatatttaccaaaaaatttctttaagtctatttctgtttcattatgtgcagtgtgcttatattatgtacttgcagaattttactatgccagtatctagtgcctaaggagttcaaataaaccagatgaggaaatgatgtagcacagagattatactgaatcatatctgttactgaacataggatatatactgccctcttaatttcttttctggcatgaagtagtagtataaataaataaaaataatgactactcacctgtgctatctacttactgagtcagtctttgaaactaagactgtgcctagtatgtcttattaaggtttccaaaagttgaagataaactatctacaaacactggggatgaattgaagaaaaagcaattttatacaaaccctgcattcattaacacttttaaaaagtgccataagggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaagtgccataagatatattcagccatttatttagtcaagaaacatatttgagagcataatacatgcaaggcatgctaaataatgtaaaatgttttatattatcgattacatttagaatataagacaagcacttcatgattatggaggttcctgattagacaatagtctactttggagtcacagttcctccacttcagacatttggatacataaagttttataaaactgaatggtctgcttagtatccaaatagggatttcagcttctaacgtttccctaacaactatttgactcttggatcaaaaatgtagtaataaaataaaagttcagaacaaagttttgcccgaggaaggtctggcagtgatcaagagaatatgcctggaatgtctactcaacagatgcttttactctcacatttatgttatggtaaactcaagaatagaaaggcaacttgtgctgtactccctgcactaaatttgcctggcaatgttgttcacatagcctgcccttttgaatgagtctcttggtaataaatcaaaggtgataatgtgaatatcatccacctaacttggttgaacttaaggtgttattagtttcaaaaaaagtaacttggatgagaaataagaggaattctcttgctatgacacttgtattgcaaaacatctgaattgcaaactcttcccaagactctaataactagcaggaatgttaagagaatgttcagagaatatatgcttatatgcagaacattattttcacatgtaaattgttaaattagttctatatttcttccatgcagacctcataggtgttgtgttttctgaggattatatctaaagacaaactcagagtaagaaaatctaccatccgatgcctccccccactgtcaatattcccttcccctcaaatcactctaactacaaatgaggaaaatagcagcatggtatggaggattattagtctaaagacatgaattccagcttagatcttcaattctgaagcaagtctttgaaccaatttgggtttcaccttcctaattcaaaaaacaaaaaggatgggctagataattctgttcatatttttagctctaaaactctacgattttaacaataagagatatgaaaagcattcagttatttagagggtatttaaaatctctggacaggtaagaacgagacatgtacttttttttaaaaaaatggaatccttttattatttcatagtgaagaaggtgtttccagcattctgaatcctcagtaccactaagaaactatttcctgacatatctacaggaagcaggctttgtgaccactcagagcttactttattttttcattaatcctaaaaacttgtctaatcttttaaacttacttgatcttctaaactcatgtgtgctcttttgagtgtaggggctgtgctccattaattgtgatgttcatctcaatgctcatctcattgtctagcagcatactgggcacatagtaggtgttcagtaaagatatatagagtgattgcacagcataaattagatgctggtttctaaattaatatattgaaattacagaagttcccacagtgtacttaaacataggaacgttaaagtatttacttgtttaagttatgaaaaaataaagaaggaaaagtggagatcatatagggaaaaagatgttttcaagagactgcctttcttctctctttaggcaataataaatctttttgaagttctctgccagctagttagactatggttttttgaaataccatttgatagacacatatgacatttttagagctcaagtacaggatagcatctttgagatatgctgcagaaaaacctagaaagttttcctgagtggtgaagacatcattggtcggaatgaaatgacagagggtcacatttctcatttctttcttgtattgtgatttcctcttgtattacttattcctgctggttttgagtatctatcctatatggtttttgcctaagtgattggtctttccttggctttatactgtgccttccaagttagtattattggttatttggagttcttgaattttggctttgctacattgtagaatacgctaggtaaattagtaatctcattacattagttagtgccaatcataatccccaaagacacagtcctgaatgtcataatctggaatgttgaaatccaaaagatcaaaatcacaaaagttcaaaattcctaaagtctaaaattccaaaaatcaaaatcctcaacattaaaatccctaatgttgaaatcctgaaagttgaagacacctggagaagggattagtgtgtcttcagttgcatgcaggataattgcatcacgttagttacatcacattacagtggaactactgctttgttactgtctttatttggaaattatagatggtgtgaggggatgcttatgggtgccaaattgatgaggggtagactcgacttaattttaggtgtcaatttgactggtataaggaatacctaggaacctggtaaagcattactttgggtgtgtctaccagggtgtttccaaaggagattagaatgtaaccctgagtggactactagctggagaagatctgccctcaatgttagcagggagtatccaatctctcagggcctggagagaaccaatacagaagaaaaattggttgctctctgagagctggtacagacttttcttctgttgccttggacattagaattccagggcatgccagcttttggactccaggacttacaccagtacccgctatgtcctgtggctttcagcctcagactgagttacatcattggcttccatggtcctgaggcctttgtacttggacagagccaagctactggcatcccagggtctccagtttgcagatggcctattgtgataattctcagccaccataatcatgtgagccaattctcttagtaagtcctttctcatatatctgtatataaccttatggttctgtccctctgaagaatcctgactaacacaaatttggtatgggaaagctgagtatcattctttcatactgtattccttacaacacaatgaaagagatctgtgaaattgttctcccaccaaaaagttgtgataagttaagtgaatgaggctactgaatagtgaaagagaaaagtttaaaagttaattactactgatactgtgaaagcagaaaatcacttaattgcaacagttgagcaataatgaggctttcgaatagacaacatatgtttataaaatgtgtagacaacaaccactctttaaatacgagtgcagcaggtgtttcaaagattacagaagtgaaaatgcaggttgaaagtccaagaaatctgtccttccaaattatgcaataatgtgtgacttctaccccttcacacatagcaccaatttgctgcgctatgtatttcagcttcatatcattccagactggaagtataaattatgaaaagacttttagaaagttctaattcattttacgcatttttttgcaaatttgactccatgaaagtgcattgtcacaatgctgacagtgtgtgcaggcactgtgtgtatatgttaaaacattgaactttcccagtaaatgaagagatgtcctttttgtacattcgcatttgtgaaagataaaatttctacagatctcagctctttggaaaagattatatggctatgtgcatatgtagtagtgactcactgcagcttttgtattgatcttgtcaaaagacttatgttctctattacagtatttcagatgagtgcagttataaagctgggtatagacaattaccaaccataggtgacataagtttttatatatttcactttttgacctatttatttatgaatattgttcatctgcttataactgatatgcaactgtcactagaatatttgagtgtttatgcttgcaaaaatatgtatgttatcattgcctattttattaaagtagcctaggaagtgttctgttgtgttttttatgtttctcaaatacagcttattttaacaatgtaaataaatcttttttaaaaaaattttaaattattctttccagaattatattttcggatttgatcttatgagatcatagccgaaatccctcattagtacttcacaggtaggacagacacttcctctgtgtagagaagagactcttttttttttattattattatactttaagttttagggtaaatgtgcacaatgtgcaggttagttacgtatgtatacatgtgccatgatggtgtgctgcacccattaactcatcatttagcattaggtatatctcctaatgctatccctcccccattccccgaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgtgtttttttttttttttttttttttttttttttttgagacagagtttccctctgttgcccaggctggagggcagtggcacaatctcggctcactgcaacctctgcctcccaggttcaagcaattctcctgcctcagcctcctgagtagctgggactacaggtgtgtgccaccatgcctggctaattttttgtatttttagtagagatggggtttcaccgtgttagccaggatggtctccatctcctgacctcatgatccgcccacctcccggcctcccaaagtgctgggattacaggtgtgagccactgcgcccggccgagaagagattcttaaatataataatacataacaacattgtactgaaaatcctgaagcttaaggatgccctgactgactgaaaagttgaaacaattttattaaaaaattatatgtgacttcttcagttaaaccttgagtgtggttttgtatgacctttctcttgtactggagttctgtagcatatagagcagaaagcaagcatatattctcatccttgagaatactgatgactgagaccttaagaccatcaccaactgacctgctaactactgccacagatgccagataggttggtctaattatgtggcaactagatacatactaagctagatcttggagtggggtgagtggcgggtgcttccaatttcaggtggttctggattttaagagtgagatgaagggacccaccttcagacttcctataggcaacttaagtgactatctacatctttcagtctctgaaatgttcttgagaggaatattaatatagttctttatgacttatttggtaaattactggttacttggaagatacgatataattcctcaaataatgtctcctatgaacatttcatctgcacatctgggcaaaaagagttaagagagcaggcttgagtttgccatctttaaaatggcctgcttacaagactggctcttggctgatgtctggggaatttggatttggggacagttcccagcatttccaaaactggcaagagtggttcattgtgcctcaactgtttgtgcaaacaatatagtttatgctaaacacttgttttccctctgagagtttggaattttgctacatgatagccagagggtagctatgtgatcaacccccagtaaaaatcatgaatactgagtctgtaatgagctttcctggtagataatatttaacatgttatagctcacttccgagttgagggtattaagcgcatactgtgtgactccaccgggaaaggactctgggacaccgcaccgggtttccgcgggacttcacaccatgtgccttttgcctttgctgatgctctgtatgctttcactgtaatgaatcttactcatgggtaagattcattcatatgctgagtcatgtgagtcttactagtcaataattgaacctgggagtgacttggggaccctcaacacagtgtcctaaggtatctccatgagaaacctggggagaaggagaaatgtaactgccttgttatccttctctttgtgcagtagtagcagtagtacaataaatacaaccatcaccatttcttaagcaccttctatgtgtcagcttcatccaaggcagttcttattttctacccctgacaataaacacggttaaaaggcatttaccctaagtggaagtagaattagaaatccaggatcagaattcaaatatatcttacctcaaaacccatgtactttctaaaataacacattcattccttctccttcttatgtaacaactatttaatgaaaagcacctcatttttatatggcagtttgtttaattttcaatattcaaactgaaacagaactactattctgttgaaattcttaactgttctgtgttctatatatacaccgactagccaatatgggaaattagtgactacaaaaagaaagaaatccagtcagtgtgtacttcatgctttttgcacaggacaaaagggataattctgagtttcgaaaccttaggattagatgagatattaaatgtaaaataattagcacatggcatgaacagatgcttaataagtattagtcccaattttcttatgggttacaaattattttggcaattaaatcaatgccttaacatccttgtccccattcccctatgtactgttttagatttacctactaaaactagatgagcacaaagtggtcttgacaaatacatgtagaactcaactgatcctagttgctaccagattgacaagtatttcaatccaagacttattcactaaatttctgccatatgccaggaatgtgtcagataatcaggaaacaaaggtgaacccccatttacaatctagtgtccgcagtccagtggaagaaatgcaggttagttataggtgacatggagaagggaaattgaaaccaactaaattgccttattcggaacatgcatattctttcagtttcatctatgctattctaactagaaacttaatgaaaataagttactattgcacatattttcatgttggacttctcctgtaagtatatctattgataccagtgagaaaaaaataactgatactttaacaataaagagcctctgataattctgttatgggcaacaaaatatttgttttaaaaagctgacttaaaaaaatcagtgtaactgattgaacttcaagtggcatgtatcacattacgaagactttacactatactacttcctaaaatataacattctaatccaggctaataactatttgtaatttttttctcatattattaaaatgagaataattttaaggatagttcatttctgtcagcagtacatggaagcccctcaacccccgacaatttctccaccacagaagttttatggaatttggcagccatgcatgtatgctataagaatttatttcattatgttttcccctcaggccattgtatttctttgaaatacattcaatttctttgaaattggtatttttgaaacagtttattccttttttccctgcatccatcactttctgtactgttaagatatcaattactccatgaagtctcatgcatatctcctgatgaaaacaatcaacttattcttactttgtaagggatagatcaagtctcaacttttttcaagaaggcttcttgactattttaaaccactataagctctcattacccttatcctctttagtaactaaattatttaccatgaactttttggtaactaaagaaaccattaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaagaaaccattaactcttatcctgtttcttatattataaatatttactttttgagatttgatgatccttaaggagagcaatgtcatcatgtgtttctgtataccaacacaacttagcaacaccaaggagtcaaaaaactatatttttgaatgactcctccctaactcattctatgaggccagtatcatcctgataccaaaacctggcagagatacaacaaaaaaagaaatcttcaagccaatatctttgatgaacattgatgcaagcacatgtaccctagaacttaaagtataataaaaaatatatatatattaaaaaaaatcctcaacaaaatactggcaagctgaatctaacagcccatcaaaaagagatgtacaacattaaaaaatacaaagaattgccaattacttaatctttttgaggttttctgaaacttttgcttaacattctttcctgacatacttttgacaatttttcatcttttcagtatcggttatcgtgacatattggtatcttctactatactatgaaagcaatctggtctcacagtccttactcttacccgttttgttatattattctaagatattttgtttccaaaatcatagttagacatgattgtcactttttcattcaacaaatatttattgaacaactgataagtgaaagagtcttgtgctaggcagtatgaggaatataaataggaagggaaacacagattcttccctaagacatttataatcaaagagcctagggatataaatatctaatacacaggaagaaagtgctaaaaattacaaaagactacattttatcaaatttaacaagagataaagtttattttcagcttggatatttagggaagatacaaggaatagataaaatttggatatatatacagagatggaagtctagggcatttcaaaagagaactgaaatcaagttgatccaaatcattaatctttgaacaaatgtttattgaatatatattatgtgccaggtactgtatataagatatagtccttgagtttatggagcttttactctatttcctaaatatcttttataactttccccttcattgctgcccaagttgaagcatttcgctgtcatttctccttaatattactgcaataactttgttattggtctccctttatctccaattcatcttttatcttgcagctgcaagatatttctaactggcaatatgactgtttcaaaatattactataaattcaatgatctccttacgctacaggatacaatgttaatgactgtagatggcatatatacagggttcctcattatttcatcattgtctactccttgttcagaccctttctttcctccctcctcccttttactgtatgatccagtggtataaaactaactgttattcagtatatattggttctctcatgattctcagcctctgtacatgttctgttacctagagtgatgcctaaggccttcttacatttttaggaaaactcctccacattattcaaggtcctgctcaagagctgactcttcttcaaagccctcccctggttatcccacaaaaaaaatgctgtgctcttttattatagccataaaatattgtatcataatggatttttacttgtctctcacgaacacataaaaagcaagaattttttttaactatttatctgtaacacctaacggttatgtctgacaaacaattggtatccaaacaatatttgtggaatagtgacagactcaaaaagccagtggattaaggttgtaaagaatggatgcaaaacatattacggatgtagaatttataaaagtaactcactgaaagtaagtacaaaggaaaagagggaatataagaaaaaaatactgagctttcatcacctggtaactggagagtgtggtaccaattacagaaaatactaagaggagggggtgaattgaattttagaagaaaggtgataagtgtgggtttgaacccagtaagtattaggcttgaaaacctgaaaacagcctcaaacaatggcataaataagttttaactttactaaaaactacagatcaggggaagtgttcagatttaacttcatctgtcattgatttcacaaacagaagttacccttcatgatttagtttttgcttcacgaatcatggcgcttaaaggacttaaggtccagaagggaaaagacatattcaaataaaaaatggcaagaagtggtaatagaaacatgtataaaatacagaggatacttgatgtgaagtatagaagtgatactggcattgacttgtagaaaaaaaagtatttgtaaactcaagaagttgggtgggacattacaggcaactagtagaagccaggtgagctgtgactcattgtgccttacctacctccagctatcatgaactgcttacagtacagttctgcaaacgctccaggtcatttcatgccttcatgttttattctcatgctgttgttcccattgaaatgtccttccttattccgactgcttcacaagaatctgtcgcattttcagacttagattaagcacactaatgtcctctgaatatacagacagtagcaaataaattttaaaaattacctttcatttcttaatttatcatagttcaacatacacatagtgtcaatgtacaaaaataaggcatgtggtcactgctgtagaagagctttctgtatggatagttcaagtaaaaaagttactgtgatatcaaacaatgaatgctaagaaccgtaatagtgtagatgaaagtgctgaaaaggctaaagtaggaagaaacggaatctaactgggcgtggagattagaaaagacttcatggttgagaaggtaatttaagatggatcttgaaagttgatgcttggtggacaatgagggtgggaaagcgaaggtctttagaggtgacagaaacagcctgaaacaaaggcataaataagtgagtgatgtttaatgaatattgagtggccagatcatagggagtaagttggaaagtgtaggaataacaactgtaaaggtaggtgaggaatatattgtgggtgatcttaaaagtcagaataaaaattttttacaatttatattcttaaagcctctacagactcattttcccccttataatctactatgtcccattcccctagcattttttggaggcatttatatcatcttggtcttttctgattttagtgacagcaaattgattttatcaacataccagaaaaacatagattccaaaactcattaatcagaaaagtgctgagcataacaaccttgtatctcagctgttactatttttccatttttaactgaaaatgaaaaggttatatacttacaaaaagttttctacaaaacacaaaggtggctatatttgtggttaaaataaaatccagatttcaatcaattatttttcttacagtcaaaagtagagcattcatatatttgtggtcaaaaaatgcaatgctgctcccctcatcgggctgcttagtacaattaatgaaaaaagagacatttcataaacagaagatagagtccaaattcaaaatatctcaacctgataggaaatataagtttaatgacattctctgataactttttcaaaataataaaatgaaaagtcactaaaacttaaaatgtagaaatgctttgatctgtaaagcaagacttcaaaaaacatgtaaagtgttcagaaaaatgtttctagtgaacatgcgcacataaagaacagatttcactcctcttgaaaatattttctggtaagattcttaagtgtttgttaaggaaaaaaaatgatacattccataaaagtattttagacatacatgtggtgtacatgtaaatgcaaattaattcattatgttcacactacacaaaataaatatgtgagagcaacacaatttgtctgctaatttgaatctgttttctgatttgagagtaagagttgaagaaatcatcacatttgtgtttaatgtttcttaatgataaaagacaaattaggcagaatcacatatggtagattcatttaacaaaatcttgtacatctcaaataaagtataaccttccaggacaggaaagggcaaactacagcccgtaggctacctcctgccagctgtctgtttttgtaaataaagttactgggaacagagccaggctcaatcatttatgtattctcgatggctgctttcatactacaacagttgagcagctatgataaagaccgtatggcctgaaagtctaaaatatatactccctggccctttataaaaaagtttcctgaccactattctataatgtttgtaacttttaagttttaaaatttagtatattgattacatagtccttaatatttttttagaaaaatcagaaccacaatgatttttcactatttttactctcagattataattcagccatcaccttctctaagagtggtattgtcaacaggtggcccaaagcaatgcctttacctttgccccttccattatttccatcagtccttcccattctttaataccaacaagcaatgtattctccatttgatatatcctgaccataaaagtatcattagaaccctttgctatttttactgatttgtaaataaaaataagacagagcactactaataaatgcaaacagtatagtttttatgcaaactagcttcaggggaagtcccttgacagcctcttccaaccaaaatgccacccctcgaccccttctatatagaaagttagagctgccatttcctcgaaagttgtgattaacactttataatatccctacctaagagaatagtaacatgtttttagcaaaataaagccagagtttctctatcaacacctatgtccttatgatagctgccaaaacaatttttacttctttttcttagagtatcttatgaaagaggactaatgttttggcaaaattatgtgtataattcttttctcattttctagatcgtatactacttaaagatcaagtcttactttactgttatctctagcacacattaagtgttcagtaagtgtcttctgaatgctagaataaataaatgagaaaaatactagtttttaactgtatctttcttttgtttggctataaaaatcacagtatccttctaaagcacagaaacataagtacacgatgaagaaaaacatgagacacacatatttgtagacaatgaatttacttcaagtcacagaataatgtttaaccctattaggattctaaatattaatgtcacaggcacatatacagaattacattgaatgtgatttttaaaaaataatcattaggagtaaatccttaaaaatcagaggttattaaaaaatattatttctatcaattctaaaacaagtaaggtgatcaagtttacatttccttagtctgaaggctaatgggctaattgcctctgggcagtaagcatgttaaatactcacatctgaaaaagactgatgctattggaaaagcaaagttccattttaatatctcttttatttttattattttgaagaagtaatttattgtttttacaatttgggcaatctgaaaaattttattagactaagaagggtactctcttgtttattactctttaatatggcacgtataataactagcttgttttctacaccagtacatgaatgctaggtctaattctttttcagtttcaaaaatgataaatatcaaatacatgatcctaagacataataattttacatgtccgtggtttttcagaatagcttctcaaaccataatatggtacatgtggccccatgacctctaacttcatgcagtaataacaggattatacttattcattagaaagacaattgaaaatcttcagctaattgctaagaggaagcaggatgatggggagaagttaaagatatctccttatcagtcccagctctgctgctatatgacctgactttggacaagtttcttgacttctctgaaacataagtttccttttgtataaaataggaataataatcattattttccagggtgtctatgaggattaaataatataatatatgcaaagtatctggcatattatcagttctcaataaatggtagctatttttttatcatattcaggtaaacatcctcctgatgatgaaatgtatcatggatatacatttcatataaatttccattgcctgagaaaaattactaccccctattacatagaaggtatacaacagctttattgctgttttatagatacgagtagcctaaaaacaggaggggtcgatgacattctttaagataaaggcactgaaactgcaaaggccctagctaggcatagttgtagagttatactacagttcttcctgcatggctgaatggtaccaccagtatctgggtctttccctcaaggaaatatgacttcttatgatttaggtaggtcccactaaaactagcagtctcctattgatacggaagtgcagggtagggaagggctgggtaactggtgagggctccaccctcaggcctgtgcctaggatggcccaccatgctccccatcctgtgccgctataagccggatacagacacagacacaaatgggtggatgataagagaagcagaataacacaacaacagacaccagcaggccatctacggggagaccacatggaattcagttggtgtagttgggagaaaagtccagccactgggtggcctgactccaggggaagaccaccttcccattccatccccttttggctccccatctggcttgctgagaacaacctccatcactcagtaaaaccttgcacccatcctccaagcccacatgtgatctgatttttccaggacaccagggcaagaacccgggatacagaaagccctctgtctttgcgataaggcagagcatctaattgagctgattaacacaagccgcctgcagacggcaaagctgaaagagcacactgtaacacatgcccactggggctttgggagctgtaaacactcaaccctagatgctgccgtgggattggagccccaaaatgctacgcactacctgcctgtctgcatgcttcccctaggggtttgacagcgggacaccaaagaaatgagccacacccctattgcacaccctgcaggggggataagggaagttttcccatttcattattaatgaaagaaaaaattggaaataaaataaaaccaacatgtatcaagctaatttcatggtaattctaccagagggtagcaaaaccaatcactgtatcaaatgaggttttgtgctgagcacttctacgatatttttttctggctctttcaaagtctttcctatttctatcacaaatacattaagttatattttcataattctcagaggcaaataacatttgacaatatttttaaaagtaaattgccagcttggcttaagatattacagagcaaaattttattttaccctttttcacatctcttaaacattaattctcaaggatgcacttcaagtttaaaaacaggacaaattgatgattacctgatgcagaaaagagagacttggaacggaagataaaaattttggatttgaaatccaggtctgctacttactcactgtatgaatttggatacattacataacttcaataaatttcagtttcctcatttatagaatgcaatatgaaaacttatttcataagagttgtttaaagactaaatgaaattaacaggccttcaataaatatatttatttctttttatttcctccactgactccacctctttttgcttctgaatgaattcgttataacccagctcagaatcagtcatgagagggtttatgattataaaggttttgtaatgagaaacagagtatctgattttgaggattatccatgcctttctcttcttcctctctgctcatcggtcatttattatacattagcacaccagacaggaggcagaaaaacagagaggacacagtagatttctcatgaaatcttactttgttcaccaaagtctataagtaaaggaataattgtggtaaatcaaataagttgggttatgttttaagagatgaaacaatgtggccagactactggacaatcatctgaaaatcttcacgtggggcagaaatgtggcaactgaaacttaatgtaatcaaggaaactgtgaaaaaataaatccacattttacatataaaatatgagaccagaaaatgaccctagaagtccccaccgattatttgccaaagacatcctcagtttcctgttacaggtaaaaggcttgcttgatttaagtatcatcaacagtaaagaaaacataataggagtcattatcctactcatgaagaaagctgtgaagtcactgcctctaaaatactttagttttgtttgctccaacatcagaaagacataatgaaactagaaaacggccagagaaacttagaaccaacccaaatgcccatcaatgatagactggataaagaaaatgtgacgcatatacaccacagaatactatgcagccataaaaaagaatgagttcatgtcgtaccatcattctcagcaaactaacagaggaacagaaaaccaaacactgcatgttctcacacataagtgggagttgaacaatgagaacacatggacaccacgaggggaacatcacacaccagggcctgtcaggggatggggtgcaaggggagggagagcatgaggacaaatacctaatgcatgcagggtttaaaaccgagatgacgggttgatgggtgcagcaaaccaccatggcacatgtatacctatgtaacaaacctgcgcattttgcacatgtatcccagaacttaaagtataatttaataaataaataaataaaataaaagggccagagaaaagaagtcaaatttgcaggtgagaggaagactagaaacatcaacattcttagaaagaagtcatggattcttagaattggaattatcctgagacagtctatatgccatttccttgtgcttccagaatattcctgataaatcctaaatagtttagttatcaaaggcctaattgcacactggagactgactaggatcctcccctgatttgcagcctacctccaatctgttatctcaaatatcttccaaatatatccacttctctttatctccactggtctaaatcatctttctcattcatatagactactacagaagcatcctcattggttatcctcttctacttctgctctttacagccatgcttcccaatccattgcaataagagtgatcttaaacctcaaactaaatcataacattggcttacttagcatacctttagcgattgttcattgaccttacattcaagtgcaaagtaataaacatggtcctaaatgattggctcctgcctccttcactagtatcatctcacataccttctccctttgctcatcaaagcttatccacaccaactttatttcagttcctcaaaagagctaccatcacatataacaataacctccaccacaacagctaacatttatcaagtttttactacatgactggcattgtgataagtgctttatgtgcattatcacttttaatcctcataagaaaatctataaggtagttattttcatcgttttactgctgaaaaaaaaacaaatatttagaaacattaagtattttttccatagcaaggtaggtggcaaagatggaaattatgttatattgcatattccagggaagttttttccccaccccttccctggctaacttatatcattctttatgattactacttatatgtcatttcctcaaaacagccttctctcatctattgatctaaaattggcacccttgtcatagtcccttgtactattttttatagaatgcatcacagtttacatatttctttctgtgactatttaatatctgtcaaacctccaatagactgtaaattccatgaaggtagggaccatatgtttaaaaatgtgcctgctataatcaataaatatctgcctaataaatgattgaaaaaagacatcaaaccttccaataataaggtgttggatcactctatggaagaacctatttgagtgttagaaattctattaaaatattcttgcctacattaaaccaaaagctgttcccttataatgtctatccactgatcctaatattggtcttttggccaatagtgaaaaagaacatgtttttttctttacagttcttcgaatactttcagcctagaaagtttaagacagagaggactggtaattatggttagataattctagatttacttctaaacatctgaatgctagaatatggaagatgagagggcatcttttgaaattagagactcatctggggcacatttatggaaattaagtctttgtatactataaataattgcaagaggtagacatgaaatataggtgggactgctgtgcttcacacactctatcacaaattgaattctaactggtataaatctagaaacaaacaaacctggaggagggccagttaaaggcaattaatgactatacaaaaagattgaacaaagtaaaaatcagctactacaattacaagatagatgtcatgaagtgcaaccatatcttctcctatctctcaagaattttcttggcaacagaactctggattagatgaactatatttctaagattttgaaattagaaagacaaaatgaaagccagaattactgagagccaaaaataaaaatattctttagacattttatatatttgaataaacttgatataggcagtaattttttaaagaaggcttcatgtgccatccttaacaagaaagatagaatctcaaagttggaaaggtctttttgtctaataacttatcagatgcttaaagactctctacaacatttatatgagatagctattgaactaatattaaaatatccaagcatggcataatgcaaagatttggattttgagtttggagctttgggtttaaatctcagttcagtaatttattagctatgtaactttgaactggttactcaatgtgctccagattcctaattttaaaaccagaataacaaaatgtatcttttaaagctgtttgagaattaaatggaataccgtaatatgaaatgtcacttggcactatacctagtacatagcaaatgttcaataaatgttattttccctccagtgacaaaaatctactacctgccaagatagtctgtttcctctttggaaagcactggcagtgggttcttatactatgtggaattagtccaaaactattaagtaaataacacttaaaagtttaatatgtaagatattactttaagaaaatatgttcttcattagcattttaacttcggatgccaactttatatatatttcttaagcaatttgtcactcagaaatggcagaatttgagtaatcttagagaaatatgttacaatcatatttgactagaagcctttaataacctaattcatacaaatacttccttgaaactttcccagaaaaagcaagaacaaaaagttctccttctagtgactcaggattaattaggtatggcaattatcttttaggactacacagatactcttcctatttttattaacaattaataacaaaaaatgggcatcagaaatgttttgttgttttgtcacaagaccaagatttataattaattatttaagcctataaaacaaccatatagaagaaaattttttaagtcataagaaataatattatctattttgtgacaattaatttagcacactctgtaaacgaattcactttcctggtgttaatttaattttccactttatgtatgttatgtaagttcatttgttagagaatattttggctggctttcttcattgtaaagaataaaattacttctaacaaatctgattcaaatacaacatgaagcctgttcttccacaataatattaatttgaacaactcaaactttatttgaggaacacaattacactttccagctcaatatctcttaatttacctcaacttttcaaacctaaagaaaaactatcttcaagctattaaattattgtataatttaataagctttttaataatgaaaaatggctgagtgcagtggctcacacctgtaatcccagcactttgggaagctgaggcgggtggattacttcaggccaggagttcgagactagcctggttgacatggggaaactccatctctactaaaaatacaaaaattagctgggtgtggtggcacacacctgtaattccagctatcccgggaggctgaggcaggagaatcgcttgaacccgggaggcagaggatgcagtgagccaagatcatgccactgtgctccagcttgggtgacagagcaagactccatctcaataaataaataaataaataaataaataaataaataaataaataaaatagtgaaaaatgttaaggtcaaattagattgaagctatcagaataaaattaaaaaccaaatattagaaacaatgtttctgaggtcacaaatatactttatattggatgaaaatgtcatcaattgtgttttctctcttttctcttttgtacaataggttttatttgccagcagaaacatcacaagtaagtttaaatttgtagtggataagaattattctgattccgagtaacttgactatagcaaacgtaatcatggctaatatgattcctaaaaatgcttacagctgattaaaaaataagagcataaaataagcttactgtttcaccaatttttccaatatttccttgatctcctacttctccctgtcaaaaaagaatataaagttgcaaaaacagttatttttcaaactagattattcatgacagtttcaattttcctttttaatgtaattatctagtcataacctagaaaaaggcaaaggaaatttcagttacttaaaactttgttataagtggagcaaaccaccatggcacatgtttacctatataacaaatctacacatcctgcacatgtaccccagaacttaaaataaaaatttttaaaaactctgttatagtatttctatgaaatgtggcctaccctctattttcattcaaatagtaacgtatcagtctgttctcacactgctataaagaactacctgagactgggtaatttatgaagaaaagaggtttaattaactcacagttccacggtttaacaccaagcatgactgggaggcctcaggaagcttacaatcatgatggaaggtaaaggggaagcaagcacaacttcacatgttggagcaggagagagtgagagcaaagggtgaagtgccacacacgtttaaactgtcagatctcgtgagaactcactcgctatcccaagaatagcaaggcggaaataagccccaatgagccaatcgcttcccactaggtccctcctccagtttgacatgagagttgggcagggacacaaatccaaaccatatcaggtaataatctattttcttaaaaaatattctcctattcgtgacttttaatcacttttatcaataaaatttttaaaaataaaatctttattgaggtgtactctgtaaaaggcagagtagtaagcactgtgaaagatattaagaagaataaaattaaagtctttcccacagggatgttctatttgctcaaatagaacagaatacatgccacaggttaagtactaaaggaggtcttaggagcaggcaccctgtgaactggagcagctagagctggcatcactggagaagtaatgcatgttcataacctctgaaacaaaattttgcaatccataaatctctgaaaactcagttttccacaactcatttggtggcaaacttgacctaacttggattgatttggcagtaaagcttattttgttctgaataaggccatttatagtcttgatttattccaattaatctaaacgtccttacatttcactacagaaatattaatatatctaattatggtatgctgtcccacacccttctggtagtggtaaataaaatacagcatatgcaacatattacttttcaaaaatccaaacattaatgatttcaaataatggattatgaaactgtaagtggggccctgaaaaatatgtgatacttaacactggtaatgagaaagcgtcatttttagtggtgaggaatggcatcagcaaaggtatagattaacgaaaggtaaaagattaagttcaaagtacaacagagactgactctaagagcaatatacatttagtgtacagaaacagattaaatatgttatgtctaaaagtaatcaattactgtctaaacagtaataattatattccagtgtagaacagtaagatgttaagatactgaaaaatattgtagccaataatgacatgtggctactgaatatttgaaataggctggtctgaattgaaatgtgatgtaagtataaaaaatacatcagacttcaaagactttctacaaaacaagaatagaaaacatctcattaataatttcaatattgattacatgttgaaaggatataatatttggatatcttgagttaaataaaatatactattaaattaattttacttctttcttttcactatctaatgtggctcatatttgcagttcatgttgcatttctattgaatagtggtgattttaagcactgaaacctaatattcatcatgagtgatcactgaaataaactttcaaagtctacacaaattttcttttcagtttctgtatgtatttagataaatagtaaagaatgaagcacagcagtaggttttaataactaattttaacaggcagttcattagacagcatttatggaaaatttatggaagaataatatatgaattattggttttctagtatttttccctccttacccataagttacccttcttaaattccaaatttgtgctacttagttttaagggaggtttgtgttaatagtcaaaaagcaaaagttgtttgcagattacttgcattcttactttagttttcagaatctgaaggtaagaagttacttgtctttgacgacaatgaaagagagagagagaagctatttccccaggcctagaaagaaaacacagatctagggttctatgaagagtgtgtcccttaagcaactcccccaggcagtgccaggtccgagttaatagctacatgatgtattgaaacgcaaatttcagtgacagctagggaggaatgaacattacaaaatttcctgtgtttactaggtaacacagaagccacctagattttggtgtgattctagggagagaaagtatatacataaatgagattccgtttcttgccagtttcactggatggtagctcacagttggatttcctagcgctatttggcagtctagtaaaggagaattgttaatcccaggcaaggagaattgattaagccttttgtttgtaaatactacaatcctatttttcagaggacttttatatgtaacttgagaaagagtcaggtacacatattctgccccaggataactttagcctcatacatactgatatattaaaacatacttcagctcatatttctttatcaagcttgaaaagtgttgtttagcttttcgttaggttccagcatcataaaaatgatacatttaatacaaaaaaatagcttcaggaaacgtagtaataatgctgtgactatgtcaattcatagttaaattttcaatttgcaaaacttaccaattcttataagctagtttctttcaggtctcaattctgtatgtaataaaccattgcattactttatatttgttggtgttataaaaattatccaagaccttggaaataaagtaaatagtgagagatatatctttttaatatcataaagtgatgaaggttacccagtgattatctagtgaatattacttagactcactgtttactagtgattaaaagatccagacttagtaatgttatagaaacttgcacatttctacccagtagaattgaaaaccccagcagttatggtttattgccctgtatgtaacacacaaatcttatcctaacatttctttattaaatcacatacatagatatagatacagatacagacataatcacagatacacagattgagcatccaaaatctgaagatctgaaatcataaatgttccaaaatctgaaactttttgagtatcagcatgacactgaaaggaaatgctcattggagcattttgaatttcagatttttggatttgggattcttaacttgtaagcatgtataatgcaaatatttaaaactccaaaaaaattggaactctgaaacacttctggtcccatgcatttcagataggggatactcaacctgcatataaatagatacagatataaagatatagattctcagttgctctttgtaacagttttaacatctcactggttctttttaagttgatgtgttcatttcacatttgtatgaaagtcataattttatctttctgaaaattatattttaaaactgataataaagtcagttgctttacctttaagccttctggtcctggttcacctgcataccccttttgacctggttttccctagaagagaacagcataaaagaagaaagtatatatgtttagtcattctcatttttgaaagtttcctaagatatatgaaatttagactattcttataaatttaaatactttaaaattatttgataaatgtatttcatcatactcatttgccattcattctacaaatatccaactgtctactatgtgccatgaacggttctagatgcagaggatcgaggactgcactgaacatacctgccctcatagagcttgtattttagtgagaataacaatgttttaaaaaataagtaaaatatatagtatgttaggcagtggtaatatgtaaggtaacaaatcaagcagggaagggatatataaactgttgtgggagttttattgaaagtgtttgtaagattccaggaaagaagccctcaccgaaaagttctttgcagattacttgtattcttactgtagttttccgagagtctgaaggtaagaagtgacttgtctttgatgacaatgagagagagagagagagaagctatttcctcaggactagggagagaagagagatcccaggattctgtgaagagtgtgacccttgacccctcaaccaacttccccagagagtgccatttcctgggggagttggcagtttggtggcatttgagtaaagacctaaagaaagggacaagttaaatggatatctgaaggaaaagtgttccaggcagaggaaaagggcctgtgcacaggcactacagctaaaatgtgtgtagtatgttggaggaaccaggagaagctgaagaattgagagaagaccagtaaagtgatgaggtcaaaggaaatgggggatgagaagtcaggtcatgtagggccttgcaggttgcagttaggactttgacttttaactgagtgagataggaagcctcagacaactttaaggagaaaactgatgagatctaagttttaacaggatcactttgattccagggtagaagaagagagtccaaataagcgtctagtacaataatccaagtgagagatgatggggatgtgaatcagggtggtagcagagtggtaagattctggatataatgtgaaggtagagcttccaggaactgctggcgggtcatgtgtgaaacgtgggagaaagagaagactcaaaaatgaatctcaggtttttaatgtaagagtagcagaccaaatgaaatgaagaagactgaaaacaggtttggagggtaaataagaagctaagttttggacatgttagtttgatatgcttgttagacatctaaatggagagatcttgtggtagttatttatacaagtccagaatttaactggatcagttaaattctttctaatcagtagaaagatctgacaggaagaaataatcttagaaaccaccagcattttcattttgatggtatttaaagtcctagggtggatgacctcatttagccagtgagtatagatagaaatgagaaatccacaggccaatctttggggtactccaaaacttagaatttgaagaaattagaaaaatatttaatttgatgccagaaagtgaggaggaaaatcatggaagtaaataaattgtttctaggaggagagagtgatcttgtcaaattctgaaaaatagaaatattgagtaataagaggactttgaggattgagaaatgataattggatccagcaatacagaaaccactgatcgtatttatcagatcatttgtattgtagtggtgggaacaaatgtggtttaagcagatagagggaagagaaaaactgaaagagcatgtatagacaacacttttgaggaattttactgaaaagggaaagaaaaaatagggtaacacctgggagggaaactgacaccaaaaaagttttgttttgtttttaagctagaagaataacagcagctttatatgctgataggaatgattctgtatagagaaaagaatatgtaggagagacagagggaattgttggaccagttatcttgagtagtcaaaaggacagggtatgtagtaaacaagtggaagttttccttagcttgaaaaatggcctgttcatccacaacaacaggaaagaaagcagagtatagataaaagaaggtgggtagatgcaatgtcagaaaactgtaagttctcttctggttacttcaatcttctcagggaagtaggatgcaaggcaaaggctaagaataaggatgagagataactgaaaggagtttgaagaaacagaaagtataaagtaataatttagaaaagcaaaagaataaataggcttgaagatagaattcagaatgtaatcaaaggaataattataatgttttaagcaggatgaggaatttgggatcataaaggagacaagacacaatggaaaggcagcagaatcaatgcactgacattcctattggggctattagattggataataagagagaatgtattagaaagaaagatggtggttggggaatgagaagttcaaaattgaaaatgagaggttgctatcactggtaatgacaaagtaaagggtatgactgtagcagtgagtagctgaaaagaatagaggataagatcactgggggagagcaagtccacagacgaggtagcagggtatggtttcaggatgaaactggtccacctcagaagatcatcaggcattagattctcataaagatcacgcaacctagatcccttgcttgcacagttcacaatagggtttgcgctcctatgagaatctaatgctgctgctcatctgacaggaggtgaagctcaggcagttagatggtcaatacttagtgtcaacttgattggattgaaggatacaaagtattgatcctgggtgtgtctgtgagagtgttgccaaaagagattaacatttgagtcagtgggctggggaaggcagatccactcttaatctggtgggcacaatctaataagctgccagtgaatataaagcaggcagaaacatgtgaaaaggagagactgccctagcctcctagcctacatctttctcccatgctggatgtttctctgccttagatcattggactccaaattctttagttttgggacttagactggttctccttgctcctcagcttgcagacagcctattgtgggaacttgtgatcgtgtaagttaatacttaataaactcccctttatatatatcctattagttctgtccctctagagaacctagactaatacaagtggtaacgctcactcccagtccatggcctgggggttggggacccctgctatattggattttattgctgttgtcaattaagacatgctcttatattttttcttcttaaagtgaaacagaacaactctctggctcccattctgtttttactacacataaaagctttagccacttacaactatatttaagacttctagtcaaaacattctaatttttgcttttgactgctctaaattatcgaatcatttcctaacaagcaaaaagcaaagcaaagaactgaaaaccatcctattattattaaatatcaattgttctctacttaatttagatatacagaacaagaaatatagttaagaacctgaattattagattttttctatgatatttataaaaccaattctatttttatttccactggttggtaagagccttaatgagtcattcctttcatctttaataatactctttcaagcactgtgtagtacattaagatagagttatacatatttacattatggaaagaatctcactggaatctggtatcagcacattttcaaagtctttgaaatcaagcatttcagaatatcagtaacagaatcataacttcttgtcctacttaaattctatcatattgtattgattttgagagtgttatacttgaacatctaatactaaaatcttattttcacatctaaaaataggaacgatatcttgcaaagttgttttcaggattaaagatgattcatatacttatagcaatactaggtcccaaattgatattcaacaaatagcaacaacaataataattaatattaagactgtgtagaccagagttgaatatggttctcctgttttcgaaggaagtaaattttaaataagatcaattttattgggctcaaataccagtttttctgttaaataattctcacgaaaaataaaatgaaaactcttttttttcccccaatgggatatagcaatatatgtgctagtaaggtaaaaatgtgaaagaaataatcacagtctttttaaacgtaaaagcattttaagaaccagtactttggccaggcatggtggctcactcctgtaatcccagcactttgggaggccgaggtgggtggatcacctgaggccaggagttcaagaccagcctgatcaacatggtaaaaccccatctctactaaaaatacaaaaattagcagggcatggtggcacatgcctgtaattctagctactcgggaggctgaggcaggagaattgcttgaacccaggaggtggaggttgcagtgagtcaagatcacgccactgcactccagcctggatgacagagtgagactctgtctcaaaaaaaaaaaaaaaaaaaaaaaaaaaaaaaggaagaaccagtactttatgatgttgtcaagaaaagaaatgagatgtatttcatgtgagtctaatgcctcttaaaataaatgtaacacatataccttaattatttcataaggtaaactttgatcatgtataccaaaaatgtttaaataattcatttctagaacttgaaaacaaataattaacatattacccatggtattatctgatgaaaaaattggcagaaaatacatcttattagccttccataattttactaacacatttagaaaacaggaaatctcagaatattactaaaatggctaaagtatttagcttcctattacattttgagaaatttataaataatttgcacaaattactaagtctacagaccactgaaataacaagtaactatgtagtaggcataacatcattcaaaatatatttgggacttccagttattggcctattttattttggggcattttatgactttaatttgttttcatttttgtcctttactataatgtaaaatgttatgatgttaaaaacatttatagaacagctattttcaagaaaagcacttatggaaaattatttatatgatacctactcttggccccagttccccaaaggctccaattggtccttcttctcccttaaaaaaaaaaaaagtcagaacatattatggcctaaaatgagtatttaaaaatgtaaactcttattttctctatttattctaaaatgtgaagctcattctgagatgtgatgaaaataatgctgttattttcttgtactttgaactccatcaccccacaacactttagtttttttgtgtgaacctggtgcattcgtgtagggaccaaaaactatatgggtggatagagactgaagatgaacatagaaaaaaattaaaagcttttattcataattctctaaaagaaaaaaaggcagtaagtgtttttactccatttatagacatatttactaaatatactgatttacctttaaaaaatagatgattgttttctgaataatacatacagacctccctagaatcatatagtatatgttatttatttggtaaatattttgctcaattcacaattcaattaaaatataatttattggttcaaaaatattaagtagtcacaaatagtaaatataaattctagtatatatgagtgagattctgggttcagattcttcagacattccattggagaccactaacataaatcatttaatgaattcagaacactgtaaaatgattcttaattctattccataactggcaaaataaagtgttaacttgaaggctgggtgtagtggcttatacctgtaatcccagcactctgggacatttaggtgggaggactgcttgaggccagaagttcggccagcctgggtaacatagcaaaactgtgtctttacaaaaaatacaaaaattagccaggcatggtggtgcacctgtagtcccagctacttgggagggtgaggcaggaggattgctggagcccaggaggtcgaggctgcagtgagccaagatagcaccactgcactccatcctgggcaagagaccaagactctgtctaaatatataaataaaatggtaactggaaatctgatggtgtttaagcaaaaactgaaggcccacaataaataaaaagggaaaattttaactaaaaaccttgctgaagctgactggatatcacttcttccatacctgagttcctttgagaccaggaggtccaggaggtcctctatttccaaggagtccctataaaagcaatataaatgcacacaatagaaattttagatcaactgacattttgataaatcagcattaatgtggagatggacaatactctttgaaaccattcatttcccattaagaagtcctcaaaatgggttgcagtatgggcaaacagaaaactactgggcatctaaaaatataggataaacttatttttaaacagtaagttaatattcaaataatctgctcagtattttattcttcaacctccagacaccttttcagaaaaagtatttctaaaacggaagcaatgggtccaaatgttaaactgataagagtacagtaaaccgaatagagtgttcacaaagtctgaaaacagatggaggaaacaaacagtgttttaatatctattaagagatctgcagagtctggaactcagtattcgttagctgaagaatgcattagttcttcattactcattagttgaagaatattcttcaacttatttccctttttgatacaagatgataaaaagagaagaggaatttgcagaagaaagtgagtgtgaatttgaatagaaatttcaatactaaaaaagtattttgttaaacaaaatacatgttgttaaaaatcgattgctctctgaatgaaaactctttcaaagttaattatttttaaaaagtcttaaatcagaaaacactatacaacatctattcaacatggcaacattttcttaataagttctgttctcctaattattcaagatgccagcaaagttctaagtctctttttagaattatagtttgaatgattgcttttagtcattttataaccattaagaagttttatctaatttttaactgtactgacataatttttaaataactataccaaagagcaaatctactcaggtcacttttatcttgttctgaaatgcaacagagtgacaaactacatgggaatctttccttcatgttatattttgctctatactttctatactttaacacaataaaaaaaaactctgtcagtttaaaagtctataatatagtattgtaagcttattacataaacagcaccattcaagaaactgtattactttagacaataacctaactttttaatgaagctttcttatttttaaaagtaagatatggattagattatggaaatgggcacattgtgtcttatgccagtccaatgtatgttaatcctttttcaggcaaaagcaccctaattttccttaaggaaaaactctcttcacttttagtgcacgttgtttgaggggaggtgactccaccttcgactgtaactgtgaacatgtgacagacatctaagtcagtcagtatattgtgcatccccagaaaaaatgactggtccaggaatgagtaagggacccaattcagcccaactgaagcacgtttcaaacttcagtggcactgctgggaatagcattaagaatgaggtaaaactgaacagtgggaaaccatccaggggacagcctgagaatgaaatcaatgaattaccaaatggagagagttggagtgactgggctcttctgaaattgtttagagtcctgaattcagttgtgattgaatccctgaagttttcatatatttatgtaagcctgtttaagctgggtttccaccacttactgaaataatcctgattgatacaatgatttagaactgccttcaatatctgaaactgctctttcagaattcaaagtgaaagattttaagtgtctacactgactggaggtacagaattagaatgttgtgatatttgcattctaccacctgtcagctagtgtttaatcacttaattcatctgtttgttcatttttcatctgaaattttattaattttctactatgtataaggctcaattaacagcacaatattaggccctaagtatataattatcagtaagacagagtccctgttcccaatgaattcataatttattatggcagatggtccattaaaataaaaattattacattaagagttgtaacagaagtagaggtatatgcaaagtataaataagaatttagaaaaaggagcaaaatcctttctgggaggattagcatatttttaatatgtgaaaataattttgtattgagttatgataggctaataaaaacttgtagataaaaataagcatacaataaaaaattataaacaacttctgttctggggctcaaaaggctctaagaacatacaatattaagataagggtgtgcatgaaagaaacaggctcagctccatagccagagtgtaacctgcagacggctgaccggttaaagggaatgaggtccccctaactctctcattgaagctatttactcgagatggaaccacttatccagaaccagaaataatcctttcggtgaagcaggcaaatctaggctactttttctctcttctttcaaaaccaaaattataatcttaaaggaaaaataaaagttgggttaagagaaaaaaaatctagttatatgccatttataagaaacacacctaaaatataaaatatgcaaggcatttaccagcccaaaagagctgatgtaattacattattattagatctagcagacttgaaggtaaactacattgtttaagtgtgtaactaaatagtgattaaaggttatattcatcaagaagatataaaaaccatcattttttgtgtatctaataacatgaattccaagtataaaaagtgaaaattgatgaatatgtaaatagagttgggcaaatccactattagagagggaaattttaagacatttttctccagaagtcaagcagatagagaccacaagaacagagaaaacttaaacactaatattaacaaacttgatctagtggtcatctatagaatactgaatcctcaaatgggaatttacatagtttacaggcgcacctggagtatttgtgcaaaccaaccacaagaaaggccatatgtgtttatcagcagtagtatcaattaaaaaattatagcacatctatatagtgggttatactataaaatgtaaattaagaatgaacctataattacatgtatcaacctggattaagatgaaaagacaaaattgaatggaagaagaaagtcactgaagaatatgcatagtagaattccatttacatgaatttacaaaacacgcaaagtaccagatattgtaggagtatatttatagatggtaaaagcatggcaaaaacaaaagaacatttacctctaaatgcagagagggaggaggtagacacaattagagagagacacacaaggggcttccaatgttctatttaatatccttaatagggtttgttttatcatcattgtttaagctgtgcacatatgtttcatatttatcatatgttaaacacaaactttaaaaaagttaaaatgtgcagaactggaagtagagtgcagatttgaaatccagttctgcactttactagagatgtaaactatttcttaatctatagaatcatgttaccatcagcatcataaggttgctgtaggaataaataaaatgatacatagaatataacaggaacttaataaatatcagtttcctttctccttttatatcagacattaattagtagacatttctcaaagggagacatacaagtggccaataaataaatgagaaaatgttcaacattgctagtcatcagggaaatgcaaatcaaaaccagaataagatatcatctcattagaatgatcattattaaaaagacagaaaataacaaatgctggtgagaacacagagaaagggtgatttattggtgggaatgtaaatcaatacagctaatatgaaaaaagtatggagtttcctcaaaaaaataaaaatagaactaccatatgatttagcaatcccactactgagtatatataccaaagaaagaaaatcagtatatcagagagataatctgcattctcaagtttattgcagtgttactcacaatagccaaaatacagaatcaacataagtatccaccaacagatgactggataaagaaaatgtagtatattatacacaatggaatattattccaccataagaagaatgaaatcctatatttgccacaacaaggctagaatgggaggatattatattaagtgaaataagccagacacagaaagacaaatgttgcatgttccaactcatatgtggaagctaaaaaaaaattgatctcatggagatagagaataaattgaatggtggttagcagaggttgggaatggtagtagggaaggggcttccacttggacagaacagtgtatggagactcacatcatggacttttgctccaagaaccactacagtaaagtaccaggaaaacttaaggatttcatagatcctctgacagaaatggcatgctgctacaaattctgcaagacagcaaaaaaactgtgagttcccaaagtgtgtgagggggaacacctgcctccagacacacatccccactggggaccctgaaaacccagattacaggagaaggatttaaccttacctagagctgaaactgatttagcgtgaaacataaaagtagaagcagcagcaggaagagcattgtaggcactcccattctccagctcaagccaagggaagccatccttgactatatctcactagggccctcagggaaggcagccggcagaatctgggaggggtcacaggctgaaaaaagattccaactgaactttgtaataattttgactgaatgcaaactctctagagcagaatctgagggtgaaacggaactgttgcagagagtagcacaggagccaaggccaacagtatttgaaggcagggaggggcgaggcctgaaagccttgcttgctttctcagcagggaagcttatagcctggggcaaggtctgaatgctgagcacaggctacctggagacaaactcagtgctgttagtagggcacattgtcaggggcaaaaccgacctctacatgggagctgggtaagacctaatgctaccggctttcccctacttctctgatgacagagggtattatggaacaaaatgccctctggaacataaccccattggcccaagaaccacaccccctcccccacaggagtgtggcaagccctgcccaaggagagagtctgagctcagactggcgtaaccctgctcccacctgatggtacttctctacccgcctagtagccaatcacaaaagacataaactcttgggagctttatggccttgcccatcacctgagaaacccaaatacttattctggccaacttagggcaagcttatatcccccttccactactgcagctggtgctctcttgaaagcaatacctcctggctggaggccaaccaactcaggatattatggcaactcatgacaaaataacctgacaaaataaccctactccaaggaagtactcaaaaataactcatgacaaaataaccctactccaaggaaggagaaaacaacagctaattccactgactgcaacaccctggctaaccagaggtcctgagtctgttcactgctagcataaccagcatttgagaaagccagcacgtgaaacgtatctacaaccaaggactcttacagtctacttcactcccctgccacctccaccagagcaagtgctggtatcgacagctgagagacctgaaaatggattacatcacaggacactttgcagacaatctccagcaccagcctggagcctggtagccctgctgggtggccagacccagaagagcaataacaatcactgcagtccagctctcaggaagccccattcctagaagaagggggagagcaccacatcaagggatcaccccatgggacaaattaatctgaacagcagcccttaagttccaaatctttccactgaaacagtctatccaaatgagaaggaaccagaaaagtaattctggtaatatgacaaaataaggttctattacaccccaaagaccacactggctccccagcagtggatccaaaccaagaaatctctgaattgccagataaagaattcagaatattgattattaagctactcaaggagataccagtgaaaggtgaaaaccaacttaaagaaatttaaaaaaacaaacaatacaggctatagatgaaaaattctccagagaaacagatatcataaaaatataatcacaacttctggatatgaaagacaaactcagagaaatacaaaatgcactggaaagtgtcaataatagactaggacaggtagaagaaagaacttcagagctcaaagacaaagcttcctaattaactcaatcagacaaagacaaagaaaaaagaacaagaacaacaaaaaaagaagaaagcctccacaaattttaggatggtgttaaatggccaaacctaagaataattggtgttcctgaggcagaagagaaatctaaaactttggaaaacttattttaggaaataatcgaagaaaacctccgtggccttgctagagatagagacatccaaatataagaagatcaaagaacagctgggaaattcatcacaaaaagatcaccacctaggcacacagtcatcaggttctccaaagtcaagatgaaggaaagaatcatacgagctgtgaggcaaaagcatcaggtagcctataaaggaaaacatatcagatttacagcagattcctcagcagaaaccctacaagccagaagggattggggtcctatttttagcttcctcaaacaaaataattaccaatcaagaattctgtatccagcaaaattaagcttcataaacaaaggagaggtaaagtcgttttcagacaaacgtgtgaagagcattcaccactaccaagtcagcactacaagaactgctaaaatgagttctaaagcttgaaacaagccttaaaatacaccaaaatagaacctccttaaagcataaatctcacaggcctataaaacaacaacacacacacacaaaacccacaagatattcaggcaacaactaacacgatgaataaaatggtacctcacatctcaatattaacgttgaatgtaaatagcctaaatgctccacttatggcagaatgaaaaaaaaatccatcaattaagtatctgctgtcttcaagaggctcacctaacacataaggactcaaataaacctaaggtaaaagggtggaaaaaggtatttcatgcaaatggaaaccaaaagcaagcaggacctcaataacagttaaaaaaaagacaaagagggatattatataatgataaaaggatcagtccaacatgaaaatgtcacaatcctcaatatatatgcacctaacactggagcttccaaattgataaaacaattattactagacctaagaaatgagacagatggtgacacgataatagtgggggatgttgatactctactgacagcactaggcaggtcgtcaagacagaaagtcaacaaagaaagtgaacttcatctatgccctagaacaaatgaacttaaaagatgtttacagaacattctacccaacaactgcagaatagacattcttttcatcagagtatagaacattctccaagatagatcacatgagagactgcaaaacaagtctcaataaatttaagaaaatagaaattatatcaagtaccctctcagaccacagtggaataaaactggaaattaactccaaaaggaaccctcaaaaccatacaaacacatgaaaattaaatcatctgctcctgaatgatctctgggtcaacaatgaaatcaagatggaaattaaaaaattatttgaactgaacgataatagtgacacaacctatgaaaaccactgggatacggcaaaagcagtagcaagaggaaagttcatagtattaaatgcctatatcaaaaagtctgaaagagcacaaatagacaatttaaggtcacacctcaaggaagtagagaaacaagaacaaataaaacccaaacccagcagaatataaaataaataataaagatcagagcagaactaaattaaattgaaacaaaaaatacaaagataaatgaaacaaaaagctggttctttgaaggataaataaaattgataggcaattactgagattaacaaagaaaagtagagagaagatccaaataagttcaatagaaacgaaatgggagatattacaactgatactacagaaatacaaaagatcattcagcctactatgaacacctttacgcacacaaactagaaaacttagaggagatgtataaatttctggaagtatacaaccctcctagattaaaccaggaagaaacagaaactctgaacagattaataacaaacagaaagatagaaatgatcatttaaaaactgccaaaaaaaaaaaaagtccaggaccagagagattcacagctgaattctatcagacattcaaagaagaattggtaccaatcctattgacactattccaaaagacagagaaagaggggatcctccctaaatcattccataaagccagtatcaccttaataccaaaaccaggaaaggacataacaaaaaagagaaactacagaacaatatccctgatgaatatagatgcaaaaatcctcaacaaaatactagctaaccaaatctaacagcttatcaaaaagataatacacaatgatcaagtgggtttcataccagaaatgcagggatggtttaacatatgcaagtcaataaatgtgatacatcacataaacatcattaaaaacaaaaatcatatgatcatttcaatagttgcagaaaaagcatttgagaaaattcagcatcattttatgattaaaaccctcagcaaaactggcatagaagaaacatacctcaaggtaataaaagccatctatgacaaacccacagtgaacattatggtgaatggggaaaagttaaaagcattcctgctgagaattggaacaagacaaggatgccgactttcaccactgctattcaacattgtactggtagtcctagccagagcaatcagacaagagaaagaaataaagaatcggtaaagaggaagtcaaaccattgctgtttgctgatgatatgattgtatacctataaaaccctaaagtctcatccgaaaaactcctagctctgataaatagattcagtaaagtttcaggatacaaaatcaatggagacaaatcattagcactgctatacaccaacaacgagcaagctgagaataaaaatcaagaactcaaccccttttacaatagctacaaaaataaaaaataaaatacttagaagtatacctaaccaaggcgggtgcggtggctcatgcctgtaatcccagcactttgggaggccaaggcaggcggatcacaagaccaggagatcgagaccatcctggctaacaaggtgaaaccccgtctctactaaaaatacaaaaaaattagccaggcatggtggtgggcacctgtagtcccagctacttgagaggctaaggcaggagaatggcatgaacccagaaggcggagcttgcagtgagccaagatcacgccactgcactccagcctgggtgacagagtgagattccgagactccgtctcaaaaaaaaaagaaatatacctaaccaagaaggtaaaagacctctacaagaaaaactacaaaacactgctgaaagaaatcatagatgacataagcaaatggaaacatatcccatgctcatgaatgggcagaataaatattgtgaaaatgaccatactgccaaaagcaatctacaaattcaatgcaattctcatcaaaataccatcatcattcttcatggaactagaaaacacaatactaaaattcctttggaaccaaaaaagaccctgaatagccaaagcaacactaagcaaaaagaacaaatctggagcatcgcattacctgactccaaactaggctatagttaccaaaacagcatggtactggtataaaattaggcatgtagaccaatgggccagacaagagaacccagaaataaagccaaatatttacagctaactaatcttcaacaaagcaaacaaaaacataaagtggggaaagaaaggacaccctattcaacaaatgatgctgggataactgcaagccacatgtgaaagaataaagctggatcctcatttctcatcttacacaaaaaatcaccttaagatggatcaaagacttgaacctaagacctgaaaccataatattctagaagataacactggaaaaaaatcttctagacacaggcttaggcaaggaagtcatgaccaagaacccaaaagcaaatgcaacaaaaagaaaaataaatagatgggacttaattaaactaaaaagcttctgcacagttagagaaaaaaacaacagagtgaaaagtcaacctacgtaatggaaagcaatattttcaaatcatgtatctgatatggggttaatattcaaaatctgtaaaacactcctataactcaatagcaaacaccaaattactgggctaaaaattggagaaaggactttggagtattcatcaaagcaactgaaaacaggatctcgcaggagtgcaagtatcctgtttacatcaatgttaacaggataaaaactggatatttatatcttgttgatataaacaggatatttgcactgctaggttcattgcagctttattcacaatagccaagaggtgtcaacaacccaaatgttcattgacagatgaatgagtaaagaaaatgtggtatatacaaacaatggaatattattcagccataaaaagaaggaaatcctgtcatgttaccagatggatgaaccttgatgacattatgtgaaataagtcaaataagccagtcataaaagaacaaatgcataattccatctataggcggtatgtaaagtagctaaactcatagaagcaaaaaataggatgctaattgccaggggctgtggggaggagggcaatgagaagctgctgttcaataaatatagaatttcagtcatgtaaaatgagaaatgtctacagatctgttgtacaacagtgtgcacacattttgttacaatactgtaaacaaatcagtaaaacaaatttactaagggggtgtatttcatgttatatgcttgttcttatttaaaccctttaattttctatttaagatctgtcacaatctgctttctacctttttttttttaagtcaggtaggtttacttctgctctccattccagtgttcattttgtatctctcatccctcggctccacttggcctgatccaaccaatctgactaaaatcccaacttctctattttctcagaaaaatgatcatacagattatcctctcctctgaactccctcctactcacttatcatatgttgcccagttattgtgctttttaccttttcacttatgaagggctcatgtttccagagaattacaagttcctaacaaaaagaagaccatgttttaattttgtttttgagtcactgcttaaacacagtacccttcccattgtacaaactcaataaatatttcttagctgactaaatgttacctggagaataaatgtcttatacaagaaatctgtgtataaaatcctgttatagtatatagaatgtaaatcttcaggactgggtcaaagtaatcttagaaaactgtgtagagttatacatcttcctcttaccaagttagcttacctctctacagataaatacatgacatactgtaataattcagtgcaagaactatttccatatattacacaacataatcccacaaatagtaagctttctataaaaacttatcaggtctgctatgcaaaagacaataacagcctcttttagcatccctaattccatagccaaagtaaaaacacaaacctttatagcaacaaataaattattcctctgtttactggagaatagagaatatttatttgctactcttaccttctgcagtaagcagcaaaagatctggttttgctaatgttacgggattcttgaaagcggattcccaaactgtgtagttctcaaaaaggcttactgatgtatgttttgtatcttaatacaaatatacacacacatacaaatccacaatcagtagaactataattaacacaagtttccattcctactttgaggtttttagtgaactggcagaaaatgaacagaaaataaaagccttctttattgctgtgccaaattgctctggaaagaacccaaattgtttgcaaatagggtaaccatgtatttcaaatacagtgcacatgattttctcgatgaccacattgtatagcctcaacagagctttagcagtttttatcattcccatttgccaaacaagacatgtatataaaaatgaaagaagtttcaagatgcttgcttctatgatacagtacacccagctaaagaaacacatcatgttaacagggtcagtatgtttggctgtttttcccctctgtttctagaaacaatttcaacaaaaatgagaaggaccaagaagatagacaaaaccagatccttctcaatctacagaacagaaaattattattttcttgttcttttgataaaatcatcccaggatattcttttaaaattcagtgatgtgtataacatcaattagtctcatgatgttggtactaatgactctacatactcatgtttattaaataaacttagataatggttgaatttccagtgggtagtaagtactaacattgttgttcattaaaatgtctagctttcaagtcttttgccccagttttgacattctaatttcaagactaaaagaattagtgagaagaaagttctaaagatcactgtcataaaagaaaattaaataggtcagttggctttcttcagttctctgacacttaaacttcaagagaaacaaaattcccaaactgaagagaactttgaaagttctctggttcttcacctagtatgatatgcacacttaaaaacattaagttctattattacttccacctgaagtacatatttctcaattacccaggagagaatctattgctcaattatctaggctctcagagcacttcaccaactcttttatatagaacttcttatatttcttaattatgattattttttatctctcccactaaattgtaaccttatctggaggagggatgagagtttagaaatctttataatcccacatttattacttggtctaacacagaagaagctcaacaaaggttgaataaataagttattgaatgaatggataaataaatgtatttatataatgtataaagttcaagttcctatgtatgcaccaggtgaagggctaaagttggcaggaaaaatccgcaactccattctctacactatttgtctctctcaacttccttcatacttctatttctgcttttcaacctggtttaccgcgaactattaattatttctacctctagatgtcaaacggtacctcaaactaaatataaccagaatcaaatttcttatcatccccatcctccaaaactgctcctcttcctgagttgcctatttaagttcaatgacatcagcaacccaagtcaaaggctgctttatctttgacttctctttcttccatcaccttctgttaatcagttaccaagttgttttgtttttatttccaaaacactttttaaatggtcattcaattaatcatccattcaaccactattcactgagttatttatatgtgctatccatattatagttattatgatgtatataaaatcaattaatctttctcaaaaagattacagtctaatagacacataagcacatcagaagttataatacataaagataagtgcttgataggttttttttcaggaatataggaaaagaatattccaattagatttgggaggaacagaaaaagcttcctggacatgttgcatgtgatgtgtaggtattagctagatgcagaagggcataggaacatatatatccagacaaaaaatatggcatgtaagaagctgtgagatttgagtaagtatggcatggtttggcactctaaatagtttggctgaagtgatgcttttggaagagtgatggtggatatgactgtataactacagaattatacagagagggtttggtcataaagaacgttgtataaaaagttaaaaagtacaagccttaacatggaagttgtggaggtcactgaaggatttaagcaaaagagtgacatgatgagatctatactttaaaagattattccatctgcagctggaaggtagataggaagaaatgccagattggaggcaggaagaacaactactgaaggacaattacactatcctggtgaaaaataaagggtgcctaactacaagattggcactgagaatgattttaagggtaaaggggaaatttctatcaaaggagagattgggataaaggtgataattgatggcatgaggtcattgaagagtcaggggaggatttgatgcaaaacatatgcagaacttgaagaggtgaatgaatgcttctgtggagacagaaaggaagtgggaaagatccctgcatataggtataagtttgtaggtggcaggtggggttgcctgataaactacaggatgctcaattaaatgtgaaattcagataaacaacaaataacttctattataaatattttccaaatattgcacctccaccttttcacaagtttctttttcctgaataccatacatccccttgtctgcttcacaaattcctactcattcatgtaggttcaagtgctatcttccctgcaaaacataatttgacttccctgaccctgtgctctcacagtattgctgattatatattattcattatgattattattaaggttttcctgaatatctttctctagattttaagtttcttgaaaacagggatcaggactcttttttttcttgaaagtagggatctctgtagccttatggtctagcacaatggctgccatgagaggcagccaatatctgctgaatgaatgtcctgtttccaatctttattatttattgcctagttttcctgtcttcaatttctcccctctttaaaccatcctccaaactgacataagaggtatctttttaaaatataaccattgaagatactttactactcaaatatctttgattacttcaagatgcccgtctgatgaagcagaaactcttcagcatggtattgaatgctctacgtaatttactatcaaagctaagggtattagagctcagactttgaaatcatatctgtgttagaattctggctatatagcttaaagttatgtgacttcaagtgaataacttaatcatctgtaaaatgggaataactacctcataatgctgttgtgaaaattaaatgagataatgactataaacgagataatgtctatgaagcatttactagagtactgtgctgctcaatattaagaacactaacaaatatagctataatcaagatcctttccagcttcatctcctatcatttcatctctctctactcccattgatacctccatagcagctacatttcataacttgccaattctcccaacttcaggctatttcatccttacatgtgaattcataatgctttatttgcttacagtgcccattctacatcagcttgcatggcaaatcttggtaattaaaattttgctagggatatttcctagtatacatacaaaccagtaagtttgtatatataccatagtgttaaataaaatctgtgctgggaaaaggcctagaacgttgctttaaaatggttagattaaaagcattgccgaaataataaattagtatgtgagtcatcatgatgagtttcaataacggtaataagctaataattgtggtttcacttgtaagttaaaaatgcttgggtttcttcaggtcttttgtgctatgtagaggttcatggacaccacaggctttcttttatttcaatcaatggatatcttatgtccccaaaagatttttttagtggtcagggaattctcatccatttacttattttcagccttttatacgctatgactttttagagttttttctcctcatctcttccaaaaaaatccttctgggtgattttgcaaatattgtcacccttaatctcagttcatatcaaactagaaaaatcatttgcaactatctgaaacctaaagtttattaaatgtacctgagacagcttaaaaatatccagaaatgttctgatattcctaaaatatttttcccatttattgagaatcaggagctctagataaccataattgtttagtctctctcttcttcttcttcttacctttggtccttcagggccgttttgtccaggaatcccaatatctcctggaaaaccctagggaatataaaaatgtagcgtttattccatagaaaattactttaaatccatttagcatataaaattccctttgctattcctccatatccagttaaagcaatttataatcctcaaaaattcaatattgaagattaagttaggcagttgtttaacactggaatataaaacttacaaagtgtactaaaatagaatttactccatcagtgattcacaaacaatcctgaggtcctctagttcagtttaagagagtagaagtctcagtccaaaattatccacaatgtggaaataaggcaaaaaggtgtatgacatgttctttcaacatcatatgggatatagggctaccaaagattaggtgaatgtactttgttggactcactatttactaactacatgttaacttatagatttttgttaggcagagatgcaaacaacttctgtctgataaaaaaaaaaaacagcacccaaaattatggcttaatatacaggattaatcagttttgtatctaacccaactatcttattctaacatccccatatttaattgtctataaatacttaagtcctcaaaggctctatgaaccattatcttacaagttccatcattaattaataaattgaataaaatctttgacctgtgtttactttaaatttgcatgagaatcatgattttacttttttggaaattatattagcagtctaaaatacttggctcaagaaatgaaaaagaaatagaaatggatcacagtgttaaatacaatctatgctgggaaaaggcctagaatgttgctttaaaagtatcagattaaaactcttgctgaaataattagagtgtgattcatcaaattatgattcaataattgtaataagctagtaattgtggtttcattttattgattttgtcatagattattttccattgacattagtgaaggaaaaaagtaaaagaagtataagaatcagcatctttaaaagtaaagaaggctgaaattaaaacgtgaacatccacaagaaaaggtagttcagtgaagggataagttgtaatgggaataaaaaatatgaagtaagatggaacagcaaagttgtttctgggatattcattctggaaagaaaaacaaataataagaaaatgataccaacgtatccagtctggattaggacacgaatgcctcgactcagatttaaagcttggattctgtgaggaaaaatataatttggggacatttctggcaaaagaaaaagcagtggcaacagaaagatgatcacaagatcagatttctgaatgttctggaatagtttaatacagatatgtttaatacaaacttgttgattgctttactaatcaaagaaaatcaggctcacctatgctattatttgtatatatggcaatttttaaaaaactagattcttttcctgataattttacaccctttctctagaacacaccttttgttagtatgtttttttgtgggggggatttcttgtggacttgaatcaagacacttctagctcctgctgtaacactagctagtctaaaattgaacttactaccttctccattatgttcctccctcatcctctgttcactatttgagtgaatgtcaccttgaggtaatccaccagtttccaagccaaaaatctgtataacagatttttcatatgctttgaatactttcatatttttgatatactctgaatacttatttttccctccccaccaccaccacgaccatcttccaatcatttactaagccccatccattacatctcctaattcactgtcagtctgaaccacttttctacaaacctccctccacaaccctagggcaagtcactttctctattttcctattgcttattcatgttcctatcccctgtaaaattcattttcactccgtagccagactgatcattctatggaatctgagcatgccactttgttactggcctcagaatagaatccaaattctttaatacacagtttacagggtctttcgtgatttggtggtctctatttatctctcttctttactctctaccacccagcacttcagtcactgaacaattttcatactctgataatatatactctctttcaattctgggcttttgcatatactgtttccctcaccttgaataatgttcccttaagtttcctcacctagaacacttatgttttaactagacgactgaataacattttacttgcaaacttttctttgacctccataccttgaattaggttgcttctaagaactctcacaccatcctggggtcctataaggtcccttaatgtagtgttttggcttgttttgttttcctaatcagattgtaaactctttgagtgcagttttatgttattcacttccatattctctgcaactagtacaatgcctgatacacagtaagtgcttaaaaaatgctttgtcgttgttgtagttgctgctgttgaatgactggtttgttttttcttttcttttcttttttttttgaaagaaagtacatgtttcgtggcttgttgtagcccctcagtactggctttcagccaatttagagcatttactcatagcatctgcatggataaatcaataaatcctgtccatcctccagataagcctggaacacactatcacagcagtctccaacctttttggcaccagtttcatggaagacaatttttccataagattgcggcatggaggatagtttcgggatgaaactgttctgcttcagatcatcaggcattagactctcataaggagcatgcaacctagatccctcacacgtgcagttcacaacagggttcgtgctcctatgagactctaatgctgccgctgatctgacaggaggtgaagctcaggcagtaatgcttgctcacctgccactcacttcctgctgtgcagcccagttcctaacaggtcacaaaccagtacaggtccacagcccaggtgttaggggcccctgcagtatcatgccagaaaacaagaaagctttcgaaggtatcaaaagtagagtcatattaaaaacgcttagtaggtgcttgaagaggatcccctcggccagatatgggacaatatgaacttcaacaaggataagaactacaatggattgaaacacatcaaatatgtttaagttcataagttcataatgatacaacaacaaaaactgtccacgttcaaaggatgaaaggaggctcactcattatcttgaaacatggtaaacaaaggtgaagaatcaagaatttgttctgccttagtgtaccactagtaaccaaacagtagatgaagggatgtattccagccagtaagtgaaaaagaaagaagaggattaaaaaaatctccattttgcaatgatacaaataatctaattgatctaggcactgagcatcaactattactaacatcacacacacaaaaagagatcaccagacattatgtgcttcctgataaaagaacagaataccactgattgtcttgccaaaaacaaacctgaatatggtaaggtctctatatgtgactaccaatttgcaggaaacacacaggaccaagaaacaggcagaactacaccatgagactataatcagcaaaatccagactgtgggaaactacagatcaaatgattggggagcttcaacaactaaattttaagggggaaaacagggaatagagagagaacttgtagagtgaaagacataggaaataaaacaaataagcctaaattatagtttttaaagatgcacacttgtgtgataaactatgttttaaaaaggaggaactgcttacttttgggaggagagctgggcttgtggtttcatggggcacataatggcttctggtggtaactgtcagttttagtcttgacctgtgtggtagttacaagagtctgtcttataattgtttgtgatatacatttgttttgtatagttttatgtgtctatgttttactttacaataaaacggtaagaaaaaatttgctggggtgacttctgggtaaacatgcaacactgaatatacgtgtgaatctctgctccttaaaacgtcattaaagtatcagtggagaaatattaaaaagacaaagtggtaaggtcaaggataatagaagaaaaagatgtcaacacagctgatctcatagtatagtcatacaagctgaatattttaaaattgaaactttattgaaaagctaacaaatatataagcacaagtttattttttattttttatttttattggcttgtatttatttatttattttattattttattattttttattatactttaagttttagagtacatgtgcacaatgtgcaggtttgttacatatgttacatatgtaacaacatgtgccatgttggtgtgctgcacccattaactcttcatttaacactaggtatatctcctaatgctatccctctccactccccccaccccacaacaggccccagtgtgtgatgttccccttcctgtgtccatgtgttctcattgttcaattcccacctatgagtgagaacatgcggtgtttggtttttcgtccttgcgatagtttgctgagaatgatggtttccagcttcatccatgtccctacaaaggacatgaactcatcattttttatggctgcatagtattccatggtgtatatgataagcacaagttattaaaaggaggagaaagatctctatttccttcccacataggagagcttagaaccctggccaaagaaacttttcattattttaaaaattcatacctagattactaccaagtagagaccttgccttttaaataatacatttcaatatgttaaaaccagagttaactgtatcaactgaacattaatgataacgtacctataaaggaaaccttttttttaaacacactcaaaatgtacatcaaataacatggacatctttgccaagtagcaaaatttcagaaagcttacagattgaaaaataaaaagtacgtcattagagtccatacttttcatttctaaaaactacattagcatgaaacgatacaggaagaaaagtaaaaacaaaaatctgataaagatgctctaattcatttttataaatttaaaataatttagaaaacattaataagtccaaacattttctctcacaatgtgttttaccacctcagttaagtcatcctatcagaatttaaaatataataccttagtgaaggaaagaaacagcagtctggcttctggtgtcttcttaatagaactagtctgaccaccaatttttaccaagaagcagaaaaaagaagtagttttaaaaatagtatgtgaaaatatgtcttctgttttcagacccttcacatctgtttgccgtactgagaagagtgactcagcattctctccagtaaaaacaaagttttattattctataatcactagaggctggagactaattcacatgcattttttttttaaagcaaaacctgggaaccgaagcactagcagattccattagtttcctgggaaatcataaaagtaaaatattatcattcttatttggcagtagccagaagcttggaagctagagtgtcctaacagaatacattatattatgcgctacatacattgagcactttaatagttttccaatagaagtgttagagtatctgttttctattgaaatatatagtccctcaagttaaaaaatggtaagtggataaacttatacacatatacacaaactaattacaatatatccataaaacgaacagcctagatgtggcaacctagacgaatctcaaatgtcttatgctaagtgaaagaagccagacaaaaaaaaaagagtacatactatgtgagtcagtttatataaagactttagaaaattccaattaatctcgagtgacaaagagcagatcagaagtagcatggaaagggagaagacaagaggaacagaaataaagtattatataaaaagtgaacaagtaaattactgggtttgacagatatgttcattatcttgatcttggtgatggtttcacaggttatacatatgtcaaaaattatcaaattgtaaaatttaaatataggcagcttattatatgtcaattatacctcaatgagcctgtaaaaagaaaggtatttagtattgggtattttagataaccatatgctttatggtaggcaacattttttaaggatttaaagatctttagagagaatatataatatattagttgaactagttttcagataaaatcagtgttgctcagattttggcttgttttagaggtaatagcatgttaaattataataacagctttaaaacaaattacatattttggaaaattgaaacttttctgatattttgcaaggtagctttaagatgtcctgttgttatagataagagtgacacttgggccatttaactcccatggaaaatttcaattattgatttaatatccactgtgctttaaatatacaagaacacagcatagtttggcttaaatgtatcttctgagtagtttataagtctgaacaaagtagagatgaatatagcccttggaaaaacaatcattaaaaaaagctaaaagataaaattaataaaggcaacatgtaaattatgaattcttgagggcaaagttatgcaaagccttggctggtgttgtgtatatatagtattattgaatatatagtttatattcaataaacattcaatggcctgaattgatgaccaaattaaaaataaatcctatttgaataataactttttcaattaggcagtttcaaagttatcctgaaaaaaaaaaaaaaactagcctagcttctacagacaggactgaaattttacatattcaaacgagtaagaatgtatgcagagggagagaggttttgtaagaggataatttggtctgagacaaggatgcaggttacactcacaagattttgttttctaacatttatggaagcacatgtcatgtcagtaatatgatgagtccaggtaggaaagtaataataaaaaagaaaaacattaaaatagcctttactgagtgagaataacctatccaaaagttaatgccaaaaaaatttcaaaaggcaaatgtaataaattcactttcccagtaatctatagaaactaaactttagcacagggaagcatgcaaactgcaaatgaaggaaatattctgtcttctgaggaaaccacaaacagaaaatacagtttcttgaaaatgcaaaataatccatctaggtatctgcctctccttcattttcttttgctgttttagatctaaaagccatcaaaaccaggtattttccatcatgatactgctgagaaatttagtgactactgctattcatatattttcccttctgtaattctatgtatttgagcagaaaatatagcacagctcaattccatatgtgcagcatcctgaaaactcaacagagaaaatccacaaaactacaaagacaataaaattccttatgacaaaacatatattctgtgttccaaataagacttttgtttagatagtatttacagtattttttttaaaaaagattgattcttgctctgtcaatcaagctggagtacagtggcatgatcacaggtgtgtgccaccacgttcagctaattaaaaaaatttttttttttttagagatgtggtctcgttttgttgcccaggctggtcttgaacttctggcctcaagtgatactcttgcttcagactcccaagtagctaagattagagatacaagcgatctgtgcccagatattcacagtgtttttaacatcacttttaagggaaactacaaagttagctggaaagtctacttttagtcttctaaagtccacataaaattatagttaagttataattcaaaaataaactattctggccattatttgatatttaggtttggataatccatagtgacaaaaagcagatccccccatggtaccctgaggagggaggggggaaggagaggcagaaaagaaggattacaaatgtaaacaagaaaatttgggggtttgatgggtgtgttcactatcctgattttgttcattgatatggtttgggtctgtgtccctatgttggaggtggggcctggtgggaggtgactgaatcatgggggcagatttcaccctcagtgctgctctcatgatactgagtgcttgcaagatttggttgtttagaagtgtgtggcacctctcccttctctcttcctcctgctccggccacgtaagatgtttctgcttaccctttgccttctaccatggttgttaagtttcctggggcctccccaaccatgcttcctgtacagcctgcataactgtgagccaattaaacctcttttctttataaattactcagtctcaggtatttctttatagcagtgcgagaatggatgaatacagtgatggtttcacaatttatacatatgtcaaaagttatcaaattttaccacatataactttgttatatgttaactatacctctataaagctgcaacaaaaaaaggtaattggtattaggtgtttcagatgctcctttttggtaggcaacagttggtaataattcgaagatcttttgagagaaaatagaaattatttattgaacttgtccccagataaaatcagtggagctcagattttgaattgtttgaaggtaacagcataaccattatttactgcatatttttggctaagtataattataggtactcaatatctatatatctgtctcagaattcttataaatatcttaagaatatcaattcggctgagcacggtggctcacacctgtaatcctagcactttgggaggccgaggcgggtggatcacctgaggtcaggagtttgagaccagcctgaccaacatggcatggtggtgggttcctgaaatcccagctactagggaggctgaggcaggagaattgctagaaccctgggggcggaggttgcagtgagctgagatggcgccactgcactccagcctgggcgacagagggagactccatctcaaaaaacaaaacaaaacaaaacaaaaaacaaagaagaatataaattaacttagtcaagacaagacgtagttactatgtatcaggcactgttcttgcactgatcacatactagaaaacaaacaaaaagattccttggtttcatagaatgtatattctggagactgtttatctcagagattctctccctttcaatgtgtgtatgtttgcagcatggagtgggaagttaggtgattaaaaaagatttatattgttatgaggaactggcatgtctcaattacctacttttgttttagatacacagctatgggtctatggtcactctatgttgtttcacattctctctttcttcaaatgggatatcttgttttctttcatatatatatgtgtgtgtgtatatatatatatatgtgtgtgtgtgtgtatatatatatatatatatatatataccagttagtagaaatgtatacaggtacttaggcctcattgaaaataatgcatcttaccctgagaacttggccttagacatgtaagcaataattggccagtaccttggggtactttcctttggagaaaggagagtgcattttcagctgtgtaggtgcctgcactatgttaggcaaaggcacgtttaaaactgtataagtagcaagagggtataagtagatattgggcaataaagatgtgaaatgtagaggacatgtcttcaatctgctaaaaatctctttggggaaacattattccccatttctcagtccatgtactctcgtccccatcccagtttccaggggtgggaaaatgacctaaatcttgcaaattacagtattcctattccattgctattgcaattgattgaaagatgatcatgtgggccgggcgcagtgactcacacctgtaatcccagcactttgggaggccaacttgggtggatcacaaggtcaggagttcgagaccatcctggccaacatggtgaaacctcatctctactaaaaatacaaaaattagctgggtgcggtgacatgcgcctgtagtcccaactactcagaggctgaggcaggagaatcgcttgaacccagaggcggaggttgcagtgagccaagatcgcgccactgcactccagcctggctacagaaaaaaaaaaaaaaagatgattatgtggtcaaagcctgattggctggagtctcctaagaacttttgctagagatataaggaaaaaaagagtgctttctttttgcttagattgctaaatctgagggcaacagaagcctagagttgccaatgaccactttttctacagtgtgttcctgtgaatgtagccaacagagaaatgccaggataagatttacagagtgtcttggttatattcatcaagttcctgtacctagccaagtctctagacacatacactcctggacttcctgattttatttgccaattctgatttttttaacttaaaactgttcaaactgagtttctgtcacttgcaatggaaaaagacctgactaaaacattgaactatttgcagttttctacatacatctagcttcttcacacatctgtgcttttacaaatgctgtttcctctggctggaatgcccttgccctctgtttctacttgataaatccctactatttcttcaagtcactgctcaaacacccatgtactccatgcccctggttcttgcaccacgtaacttgttacccactcaaatgtaatatgatctatgaaaactttcacaatccaccttagtcagaatcagcactgattattttatatccatacacaactctgttaatatggctagttagcattattcatactatactgtaattaagggcatgtttctctattccaataaaatgtaagctcatgcaggaaaaggaatgtatctgacccatttttgtacctccaatatttaacttcacatgtcactgggagataattcttcattggtcccttgcatttccacacattctgcaaatgaggtattgactttgcattattccagtcactctcttcagagatttttgcattgcttcctgaagcaaagggcaggaaggaatgcgtactgtccaagataacgagataatatctctctggaatacattatcttttctgactgcccattataaaagatttaggctccttaaacttcagattcctcttatgtaatgcaacctaccgcatatgcaagtatcatctagccctcttcttgtcaccctgtgggaagtggggctcagtgaatcagtgcaaaaaagttgacactctggaaagtgcttttgccaagagtaataaactatcttttgtcattgttctaggagcttgtgtcttttaccagaatcattgaaactgtcaggctaaattgttggcttgcaaatggaataaaatctccgattctgacaattttggtgatgaagatgggatactgatagagacatagctttctggaggaggaagtattagggcctcacagatgattaacaggatttgagagaagcccatgggaaatggcaatgaatatgtaaaccaaatatatggtcaaccaggcaataaatggtcctccactttattgcctgtttagaggaggtactgggagagacagcttcaggccaagtacagggaaataagttcaaagggcagaaagacttcctcatcaatctggtgaacagtttcaggtttgcaacattgtaacaactagtactaagattccagctgggggcagtggctcacacctgtagtcccagcactttgggaggctgaggtgggcagataggcagatagcttgactagcctgggtaacacaatgaaaacccatctctacaaaaataaaaaataaaaaacttagctgagtgtggtagtgcatgcctgtggtccaagctatttgagacgttgaggtgggaggactgcttgagcctggaggctgcagctgcagtggccgtgatcacgccactctagcctgggtgggcaacagaacaagaccctgtctcactaaaataaaataaagtaaaataaaataaaataaaataaaaaagaaaagaaaagaaaaaaaagattcatcctgggtaggcagaagactctatctccttgtagataatagttacagagactcccatctacaatgagtataaaaggatgaacatttgtgaccagtatgagcaaaaaccaggcaaagaaatagaactttggttggttcacctgggagatgagaggggggtctcatagtttttcacaacacaagaattgcaacattagcccacattgcctaaccactgaatatgctgcctctgacatagcttgaaatataaggtcttatacaatttgatgccaacctacttttacagccttatttgtcactctgtgccaacacacaaaaaaactgtatcagctagccagtgtcacccactcctgtaaatccaccatgcattaacctaggtctctaggctctgcttatatggttcactgtgcttggaatgccctcctcttttcctgcaatttattaataaacaatctaattcaaggtccatcatttctgtaaacccttccatcttctctatgaacccttctctatcctttcattttatgttaatctatctctactaacactgaactataacaactccttaattctcacatgatgccttcaccattacctaacagtttacatatagatttcgttcttcccaactagactaaattttcctaaattattgataacattttattttttaatatatcttacagtgattactaggcacatatttgcacatagcagaaacctaatactttttttattgactgatttaatcacacgtgctctttcagcatgacttaagtgacaattaaaaacatgaaatttctcatccaaatccaagtcataaaagatatcaaagaagtaaattgtttaggcaaagggattccattacattctaatcaattaatacagctggccacagtctagcttattccagttaagtccactgaagtactaaaaatgaagtttaaaagcatgcttttacttgatatagccagatttttgaaactcacttcagtctttgtctctaatgaagaccaccctgacggaaaaagaggacccactgtttggccacttctggcactgctgtgattagtggtcttgattcatttttgtcataaacaattggctccatataccaagtacatcatccaaaattcaaatatttggcaatctctgtagcccagggggcttaatagctgaatcaacaaacattccaaccatcctgctaccatataagaaggtgctctgctgccagaactgagaggatacatgggattagtgctcaaaactgatatgactatgcttaaagaaatagaaatgattcctgtagagcattttccatatgtttttattaaaagcagacaaaaaccagtatggaaaaaataaatctatgtattaaggcaagtgatgttttatcttggaacacctctaatatttacaattccatgaaaagctaaatgcactgatcttttcacttcattgttacagcatatgcaagtatcatcactgtcacattgcctagaataagtaaaacattaagaagagaaaaaaatctttgaagtggtttgaagtcacatttgctcagctggtctttaatgatgaacagttctcttcaatgccaatggcaaatagcatttacaacaaaaacttcagagtactttgctttcaccaactcttatgaagatttgagtttcctaactagaagtcactagcaagaaatggtggccagtcctgtcctgcctttttagttgagtagatgaccatttgcatggtatggttaagttgagaggtatgaaagtttctagtcatccataagtttttccctgctcactaaatgacaccctaaattctttgattaatgacattttgcattagtttcaggtttctgttcattgctgaaatgtaaatatccttgaaagaggaatacattgcagttagctcataatcatttactgctgggactgaaatatatttatcaggtctttccatgaaaacaggctttgatgggaagggcaaattataggggaaaaaaaagagcacaccgattgtttgagatggaaaagaactcatgcccaagggaggaaatatatatacacacacacacaaaggagagactaagagcctcaggaaaaaaagttcttcaacaatttacaactttctctgaggactgcactgattctagactttcaagggatgacctgatttttaagttttaattttatcaaacctaatcaaacctgatgtctgggaaaaaagacagacagagacagtagaggctttgacacggaatgataattgaatattgacttcttgactataagctcctgaagtcaggacctaatcttattcacctctgcactttttttcttagtaattgacatatataatagatatccccaaagatctgttgaaaatgaataataagaattggattgtctaaagaggagcataaaaggcagagatattcccataggtggatctttgggttctgatgatcagccaatcacttacatctctatgactgtcagtcacattgtgtgtggggggatgtcatagattagtgccaccattaaaaacctaaaagatttaggggtggtggtccctattacagcatcgctgaattcaccaggcgcacccctgcggagatcgcatagattctggagggtgactgtagactaccacagccccagttacagctgctttgtcagatgtagtatcattgctagagaagattactaagtcttcccataaatggtatatagtcaccaattaagcaaatgtaactttttcctttaaaattaaaaaagataataaaaaactagtttgcattcatgtaggatggacaatagtcacttacagttttcctgtgttctcctgcctctgtcatatgatacaggttcagtctgaagagatctgaaccttcagtgaataccacagaacatcaccccaatccactacatacgtgatgtcatgctgattgaacaagatgagcaagagatggctagtacaatagagaatttggcaagacacatgcactcaagatggtaggatatacacccttcaaagattcataagctggccaattttctgaagatttaggatcccagtggttagggatatacttgaatagcccctctaaggcaagagcaaattgagagtcttacatactccaccacaaaaaaaggaaaggcacaccttttggggtctaaggagcaaaccattctatacctaggaatactactctagcccatataccaggtgacactgtaggctgctagctttgagcagcacccaaaacaggaaagggcaacatcataagtctaggacatggtacaatcagtcccgccacttgcatatttaatccagaagaccctttagtattggaggtattatggtgggagaagatgcagtatggagcctatggcagtttgcagtgagagaaacaaatgctgcctctggaattctggagtaaggccatgtcatctgaagcagaaaatactatgctttttgagaaacagtttttggtgttactggaacctggtaaaggaaggacacttgactatgggacattaagtaaccacacacttagaacttgccattatgtcctgggttctgtcaggctgccaagacataaattcagatgggcactagcagcaatccattatactggagaaatgttatatacagaattgaacccaagtgggaccgggggaacaagtaagctgcattaataggtagcccaaaccccaatgtcaccttcacactcactgcagttaccttctcctagcttataactacaggaatatgtgttagggtgagaaaatagctcccatatgactagctggaggaggagaaaaagcttcagcttgatttatggttgggtcagcttggtaggcagttctagctgaaaatggatagcaacagcaaaaaaggtacacttatgcatactctgaataacaacagagaagaaaaaagtcatcctaaggggtagatctgtgagcagtgtaccagctcatcatcttttgtgtggcaagagaagtgacctgaagtgaggatatatagattcctcggcagtaatcaatggcatggctatctggtcaggggcctgggaggaaaaaaaaatagaggaagagagatctgagacagagtcacatgactagacacatgggattaggcaaagagtataaagagttcgccctcacacattaatgcccaccaggaagcatataccatgaaggaggttataaaaaaccaagtagacaaaatgacttggccagttgacattagccagccttcatctttggtcactcccagattggcatgagtatcaaatgaatggagaagacatggtagtagagacagaagttatgtatgagcccaacagcatgtactatcacttaccaaggatgttccagcttctgctgcctctgaaagttccatttgtcagcaaaaaaagaccaacaaagtccacattatgtcaccattccacgaagaaggcaaccagctactcggtggcaaatttcttacattgggcaccttccaacctggaagtatcagcagttcatcatcacagagacagatatttatttgggtaagagtttgcctttcttgtctctaaagttctactagcactactatctagaggcttacagaatgcctgatccacagacatgaaacctcacagaacacagcatccaaaaatggagaccctctttacattgaaggaggggcaaggagtaggcccatgatgtaatccattagttttaatcctgcccaatctagaagcatccagcctcacataacattggaatttccttctaaagttataattgatgtgccagttaaaagaaaataatgtgaaaaaatggtgtactaccctttagaacacagtggatttgttaaatcactgacccatatggagttttgtcccaaataggatgaacatttgggtctaaagaccaaggggtggaagcaggtatggtcctatttaccatcactcccaatgacacactgtattctgtgcttccttcaccacaccctgaactctacagggctgaagatcttgttacccaaagtggggggtctctcttgacagaagacacaacaaaggtcttaataaactaaaaattatgactgctaccagagcactttggactttttgtcaccaggtctgaacaaataaaaagagaagtcaccacactggcatgactaattgaccctgataaacagaaggaagcaagactgcttcaatccaataaaggcaggaaggaatatatgtgaaactcaggtgatacactgggcaccttcttgtactcctgtcaaacatacatgctcttcagcaatgaaggtttaggttgtactaccagataagctaccaagatctgctgaggtgatagctgagggtgaggggaatgtaaaatggacagtgaaagagtgagaaaagtaccagttgtggctctgagaacaactggattgacagaggccacagttcatcctattaacacagtcagatcacgtaaaacaaaaataagttaagatacagcaaatctaaataacataatcaataaggaagggcaaatcactacataccaaactttgcacctgataataagaatataccatcttgtcaagaagacattgaacattcacaaaaggtgaacatatattaggtaaaaaagaaaaagatcagtaagctccataaagtaaaaaaaaaaaagtctctgatcaccatgcaatgaaaccagaaattattaacaaaatcaaaactgaaaaagctctcccacttgaaaatttaaaaattgcctatttaaataattattgggtgagaagggatatacaaattgaaatgacaaaataccaaaaagtaattttaataaacatactccatatggagtctactgaacacatttaaagtaatgatcagagaagaaataacagaccttaataattttatgaataaaaataaaagaataaaaagaaattagaaaaggaacaaagcaagaatatcccctcttatgactccttgtcaacattatactggaagtcctagataatgcaatatgacaagaaaaagaaaaaccatacagattgagaacaaaaatataaagctgcctttgtcacagatgacatgattggctatgcagaaaagcagaaaaaaatgaacaaaatcctcctggaatgaataagcagttatagcaaggttgtaggatacaaggttaatatacaaaagttaactgacttcttgtataccaagaacaaactaatgaaatttgaaattaaaaacacaatacagcaccaactgtattagttggttattagcaccaactaatacttagttatgaacctaagaaaataagtacaaaatttatatgaggaaaactataaaattatgatcaaagaaataaaaaagaagtaaattcttcccaatgtgatctatagattcaatgcaataccaaacaaaatcccataagttatttgtggatactgacaaacagattctaaactttatacagagaggcaaaagacccaaaacagccaacccaacttgaaagaggacagagttggaggactgatactactggacctcaagacttactataaagctacaatattcgagacagtgtggtaatgaagaaaaaaacagataagtagatgagcggaacagaatagagaacccagaaatagacccacataaatacagtcacctgatctttgacaaaggagcgaaggcagtacaatggagcaaagatagtcttttcaacaaacggtgctgaaataactggacatctacatgcaaaaaagaaatgaatttagacacagaccttacacctgtcacaaaaattaactcaaaatagatcacagacctaatgtaaaatgcaatattataaaatcctagcagataatacaggagaaaatctagatgaccttgggtatgttgtttttagaaacaacacaaaagacacaatccatactgaacttcattaaaatttaaaacttctgccctgcagaaaacaatgtcaagagaataagaagacaaaccacagacgggaagaaaatatttgcaaaaggcacatctgataaagaactgttaccccaaatatacaaagaactctgaaaactcaacaattaaaaaaaacattaaaaaaaggccaaagaccttaacaaacacctcaccaaggaagatatacagatggtaaataagcatatgaacagatgctccacattatatgtcattagggaactgcaaattaaaacaacaatgtgggctggttctggttgctcatgactttaatcccagcactttgggaggccaaggtgtgatgattgcttcagcccaggagtttgagaccagcctgggcaacatagtgagaccttgtctctacaaataataataataataatagctgggcacagtggcacatggctgtggtcctccctactcaggcggctgaggtgggaggatcacttgagcccaggaggttgaggcgacagtgagccatggtcactctactgaactccggcctgagtgacatagtgaaactgtctcaaaacaaacaaacaaacaaacaaacccaccaccaccaccaccaccaccaaaacccagtgtggtgccactgcacactcactaaaatggccaaaatccagaacactgacaccaaatgctggtgaggatgtggagcaaaaggaactcttattcattgccagttggaatgcaaaatggcacagccactttggaagacggagtttattacaaaactaaacatacttttactgtgtgatccagaagccacattccttaattctacccaaaggagttgaaaatttatgtccacacaaaaccctgcacatgactatttacagcagcttcataactgccaaaacctggaagcaactaagatgtcctttagtcggtgaatggataaactgtggtatatccagacaacagaatattattcagtgctaaaaagaaatgagctatgaagccatgaaaaaacatggaggaaccttaattgcatattaatatgtaaaagaagtcaatctaaaaaggctacatactgtacgattccaactgcctgacattctggaaaaggcaaaattatgaagacagtaaaaagatcagtgcccataggttgctgagggcagggaagaggagggatgaacgggcagagcacaaaggatttttagggcagtaaaaatactctgtataataatataatggtagatcattatatatttttccaaacccatagaaagtacaacttcaagagtgaacactaacactaatgtaaactatggaccttgggtgatagttatgatgtgtcaatgtaggttcatcaattgtaacaaatgtgccactcttgtagaggataataggatcactacaatcaagtagaatatatttcaagaatgcaagttgagacaataaaaaatccattaatataccatacacatagatccaaacagaaaaaatacataattatctccatacatgtaggaaatataaaacctttaatcaagtatatatatttgacaaaatataataatgatccctgatttaaaacattcaagaaaatattaatggatatttctttcttttttttcagggtcttgctctgtggcccaggctggagtgcagtggtgtaacctcggctcaccaaaacttctgcctcctgggctcaagtgttcctcccacctcagcctcctgaggagctgggactataaatgcacaccaccatgccaggctaatttttgtgtcttttttgtagagatggtgttttgccatgctgcccaggccagtattgaactcctgggctcaagcaatccccggcctatttctttaatgtaataaaatatgaatattttaatcttcatgccagcatttacttcatgaggaatcactataatgtttccactaacaccaggaacagagcaaggatgctcaccacttctttaacattgtactaggggtattacaatacaattagccatgagaattaacttaaaggtttaagaagtgggaaagaagaactaaaatgatctctatttgaaaattacatgatagcatgtctagaaaactctggaaaatcaatggcaaaacgaactaaaaaaaaagaaaccattaaggtaaccagatataaaattaacattgaaaaatcaacagtctttggacacataaacaaaaatctattagagaatataatggcagacaaaaccccttttactataacaacaaaaaaataaaatgcttaagaaaaaaatttaacaaaaaatgtgcaaaacctaaggaatgttaacacaaaaatagatctgaacaaatgaaagacaaccgttgttgttgaaaagactgagtcaacatcataaatatcccagggctctcttaatttataagtgtaagttgaagccaagaaaaatactaacaatattttttaatgaagctagatagattgatgttaaggtttatatggaaaaacaagaatgcaaatgtagccaggaaaacactgaaaaaagctcagaggacttaaaacctttccagacatctcaacacaccataaagtttctatcattagaacaaggtaggacttgtgcatgaacagacaaccactcagatggaatagaaaataaagtacagacatagatccaagaagtagaaatttagtacaatcatgtgtcacttaatgatgggtatttgttctgagaaacattttgtcaggcaattttgtcattgtgtgaacatcatagagtatacttccacagacctagatagtatagtctactacaaacctaagctatatggtatagcctattgcttctaggctacaaacctgtacagtatgttactgtactaaatactgtaggcaattgtaacacattggtatttgtgtatctaaatctatataaacatagaaatggtacagtaaaaatgtagtataaaagataaaaaatggtacatctgtatagggcacttaccatgactggggccaacaggatcagaagttgctctgagtgagttagtaagtcagtagtgagtgaatgtgaaggcctagggcattactgtacacttttatatgactgacaacacagtaggtttgtttacaacagcatcaccacaaaacatgtgagtaatgatgttatgaaggcattatatgacatcaccaggtgatacaaatttttcagttctgttataatcttatgggactagggttttatatgaggcccatcgttgaccaaaacaatgcatgcagtgtgtgactgtgtatgatataggtagcatagtttaaaataaactatgatactgaagcaaagacagattgtttaacgaatgattctgagaaaactgattagccatttagaaaaatgtgaaatgaaatacataaatcacaacattcacacacacaaaaaaaacttttaatgtatcagagacctaaatataaaaaaggaaactagtcaagaatcagaagaaaacataggtgatttctttaaaatctggatataggaaaaggttctctaatgatgactcaaaatccaaattccctaaaagactgacaaatttggctatgtaaaattgtaaagctgctttctgtcaaaaaacactacaaacaaagtcaaaagacaagtgacaaattgggaaaaaatacttgtaatagttatcaaaggtaaagggctaatttccctaatacccaaataattcttaaacatttagagtaaaatgaccaaatacctagtagaaaaatgggcaaaaaacataaacagacttttgcaagaaagattataaaacagtcctcaaacaaaaaaaagatgttcagtgtcacttatagtgagaaaaatgtcataattagagaaatgttgattggaatgcaattctttcagagaggaatttggcaatatctaacaatatcttctttcgacatagcaatccaattctagcaattcaccatgaagatacacctccaaccgtatagaaatacataagaagcacaagtttattcactgcaggagtgtttttcattgcaaaatgctggaaacaaactaaatttccatatgtaggagaatgattgaataaactgatacatccacacaatgaagtactatgaagctacaaaattacataaagagctccatgaattgatatgatttccaggatatatttttaaataaaaaaagcagagtgtcaaaaagtatctgtggtatgtaaccttttatgtaataaaaaagtgtaagaaaatacacatacatctgccccttaaacaagcaaaacatacacacatacacaactcacaagaaagatacaccagaaactactgagattggatacctcagggggcaggtgagaacactgaaaaagaataagaggatgaggacaggacagaaaggtagggagggtagtacacttatctaactttgtcctatatagctttgccctgtagaataatttctctaacttttctggaagaaagtacagttaaaattaaagtttaatataattatacttttaatatgagtttccttacatggttttaaagaaaaaaaatatgaattatttttctgcaccttgtagttatccatgaataaactcagcttaaccactgattacactactctaaagtggtaacggtggtggctactgaggaaggcttaacctctgattttagccttatagaatttaacctaattactcggtggaaataataatgattaataaatacaattgcaagatattttatgactgtaaaatatcaacatgtataattagttcactgggctaactcagattattttttctgtctgtgagactatcttctaagttacctgcccttctcctactcttatctcaggctccttcatatgctcttggtactataaaacttgtgcttttgaatcacattcaccctgtactgcaaaggcaatccagctctccttctctgttccagctcctgtgcaaattaaatgtcaatggaaaaaatccatagcaaagcttattagtgtctttcttttatcactttgtttttaaaaacatttatagaatgctatctctgtgccacgctttgctgcagtaaatagtagtaataattttcccaggctgctaaaacagaatcagatgataatttccatgcagagaacaaggagaatgttctgacttcttttgtgatcttataccttactgggttgaaagcactctcattctattggataaaggttctgctgccataaagaacagaaaaataagatgtggttctttattattgctgttaatcacctgtggagcaacccccaatgattctgattcaacatttttgagattggccctggcaatctgtgtgtgttttttctttttagtagagacaaagcctcactatgttgctccaggctggtcttgaactcctaggctcaagcaatcttctcattgtagccacccaaagtgctgggattacaagcataagccaccatgcccagccttaaaaataaaaaaaataaataaaaataaatttaaaaaaagttctacaggtgatagtgatgcccagtaaaggttaataaatcactttctatagctggcagttttattatcaaaaactaaaattactattcattcaaataagttctctgcttagataagtaaaataatctccttaaatcattgccctactggccaggtgcggtggctcacccctgtaatcccagcactttgggaggccgaggtgggcagatcacgaggtcaggagatcaagactatcccggctaacacagtgaaatcccatctcaactaaaaatacaaaaaataagcctggtgtggtggcatgcgcctgtaatcccagctacctgggaggctgaggcaggagaattgcttgaacccaggaggcggaggttgcagtgagccgaggttgcaccactgcactccagcctgggcaacagagtgagactctgtctcaaaaaataaaataaaatagaaataaaaaatcatgtccctactttcagcactgtttctccccacagtcttatgttcacacagcagccagagtaacctttgaaaagcataaatcagatcagatcatgcctctgccctatttaaagcctctcatggcttcctgctgcacttagaaccaaatccaaacttctcactatcctctatgagggcatacatgatatatctcctgcctacttttccaacttcattgtataccactttcctcttcattcattctgctcactccagttacattggcattctttctgatcttgaactggccaggcttttctgccttaggtctagacaatgtgtcctgtcttcaattatggtggtggtggtggtggcagctaatacatactgaacatttcctattaactacatgctgaagtgttttacatgtattaatgtgtgtaataaaacaactttatgaggttggtactattaatatttctgttttacagatgaggaaaggcccagggaattgaagtaatttgctcaaggtactcagactaactcctcaattctcactcagaagatgttaaccccaaaattctgtaattttcagatattaacttaaaccttttatcacccagttattaacaaaagctatcatagaagtatatatgtaggtctcatcattttggcccctaatagaattactttcactgaattatgctttcacattgtaacatccatctatactgaatagtggaaatgacacaatacaatgaattgctaccctccttttgaataattaatatgttctaacccaaaagaaaggagaatcatataactgatcatgtgtcatccttttggcagtgggaagatcgtattcaaatctgaaatccccttacaacaaaatgtacagagctttgtgactatatttcaggcaaaagcctcttacatttcaaactaaccaaaaactgggccagacatggtggctcatgcctataatcccagcattttgggaggccaaggcaggtggatcacctgaggtcaggagtttgagaccagcttagtcaacatggcaaaaccccgtctctactaaaaatacaaaaattagccaggtgtggtggcaggcacctgtaatcccagctacttgggaggctgaggcaggagaatcgcttcaacctgggaggcagaggttgcaatgagcccagacggcaccactgcattccagcctgggcgagagagtgaaactgtgtctcaaaaaaacataaacaaaaacaaacaaaaaaccttatccaaaaattaccttaaccaacaactcagaaattattttattagtccgcagtcactctctcacttacttttcaaagaactcctgcagctcctttctcctgcacagtccccttactcttgagatttagtttcaagactaagaaaacagagactatcctatctgacctctttcaacttctttcttcttttgaaacaaatccctacagttatgctgtgtataactcatttattttttaccttccttgctttcaagagaaatgaatttgtatataagttgtcctctaaatgttgcttcagctgcaacactcaagtttttatactgattcgttctcattcacttctaaatattttctaatttccattgtgatatttcttctctccagaccataagttactaaggaatgtatttttcagttaccaaaatttattttactgactttttattatcaacttaaaacttaactgcactgtagacaaagactgtagacttctaggggtgagtttccaggtgtagtatttttaaactttgttttaattcatctgttacattgcttcatctaatacctttatgcagatgattatataaatatgtatctctagtctacttttctgagctttaggcctacagttttaagactcttattagactaattttctatttctcctaaaggcctttgaaccctaacagattcaaagccaaaacattatttcctgccactctgaatctcttccttctcctcctcctccttttcctattttctatttttggaatgatgatccacattctacccaacttttcaagcaaaaagtgttcaaattgccttttattcctctctcttacaattggaatgaactgttttatgtattgtgaattatattttctagttctctctttaagctatcctttcctttctattgtcacaggacctcatcatcaatcccctgctctgctgcaccatccttctaaataacctttagttcatctccttggcactcctccttcccttcttctcttttatccttccccctgctgctttgcataaagcacaactctgataattcctttctcttgcttaaatatctttggttaacgcatacaggataaagtctgaatttagcacaatgcataagaccctttacctgagtaaaattcatccactatacaagcagaaagttttcaggcttggtttgctaccaaatatactatttaaaattcttggacctgcaagtttattaaaagcctaatgttgacaaggatttggataaaagtgttgtctcacatatagttgcctatgtactatatttttatgatcaagaaaaagttatgctccttgaattaggccccatttcccaaaacaatctagcatcagttcttgacagagtacaggttacatttttagccccatgaaaaaacttaatacaggtgaagaggaaggattggtactctgaaaatgctggggctcaggaccttatattagtggtgctaaaatcagagataatgagataatgttttcagtgttgatggatattatgaaattttaaagggaagagagaaataaataaacatctttagaagaccaagtagtaagtgaaaacatggcgcatgcatcctttaaccaagctttatgagaaagaagaaaaatgactcaaaaccatacttatagcaaggaggtaacatagccatttctagtgtacatatcacctgtaactgcagtaataataggacaatacagtcataataataacctttaaagataatgaaaattaaaatagattctgtatcctcagtatgacaaggcagtaaatactattcattccaggaaagctttcattaaaaatgattaaaataaaaattgtaggctcatatggagaagcttatactaatctgaagttttaattactcaatttccttcctatcagaatgctgagatcaatatactactgtattttacttcctattacctctctattggtaaaactagctacaatgaagttttgaagactctactttttcttttttttttttttttttggagacggggtctcattttgtcacccaggctgaagtgcagtggtgccaccccaggctcaagtgatcatcctacctcagcctcccgagtagctgggactacaggtgtgagccaccatgcctggctaacttttaaaacattttttcttttttttttttagcaacagggtctcactatgttgctagggctggtctagaactcctggactcaaggcgatcctctcacatcagcctcccaaagtgctgggattgcaccatgcccagcctgctttttagatttttgaactgtcaatacccaatgtgttttgaaatcatacagtaagtaagaataggcattttctaaagaaatcagccaaccttgaaggacagctgtgaagtaagaagtagatcttatggtttacaaagagagggagacagcatcagtacagcagtagtcttagaaactctgcctactactctgacactatgacattattgctctaacttatttattctgatgccaattattttctcagccttctgctgaatctatgactctaaattaaatatgtatgtacactgatatgtgtgtgcttgcgtgtatgtgtgtgtgtgtaggcacacacaggcacacacatatcaatatgggcatatatttttgaaactagagtgagcttcagaagtttcatctccatgtagtatatctttgactcataggtctgactcatagtaggattttttaaaatccaaatgttttatctcagaagcttatgttctatatagacttttagaaaagaaggccactgtatatcaaccattaaaccaaagtcaaaaattttaaagtatatacaaacaaatttgatatatgtactacagacttaattgtatttattttagaatactgtatgagatttaaatgatatatggatatagcaataattggaaacattttgcattaataattcagtggagtttctttcctgaaatttggttccaagcctcaagtacttgttattaatagctgtgcagaacaaataaatcagctgtgatcctaatcagtgtgaaaatgtggctaatgcacttttctgtttccctaggatccctgttgcatacctcgtgacataacagaaaaaatgtagtccaaactatttacggagatctaaactttaaagaggatctttcttaagcttgctatgttgaaacatgttttatcaaacaagtttaatttccaccattttgtttcaaatttattaactttccaccaatattttacctctggtcctggagggccagatggtccttggagtcctgggtcacctgtttggccctaaaatggggggggaggatcaaagtataaacataaacttaataaacacaattaaaagaagaaacaggcatatggtaaacaaatagcagtcagtcattatattatcatgtcaaacaaggttgtaatgactttttagaaaaatttgtaaccatcattactgtaaaagtttttaaataagatgtttatgggtttaatatacattcactcaagtgttaagtgatacaaacaaattaatgagtcaagtgctcaaatcaagaaaagaattgtatgtttatatgtgtttcacagagataagacaataaagctggactcaacaagatagggaattctagaggagaaactgcttttataaataaccacagtcccagggctgtctctgaaaattcctctctcctttgatactgtaagtggcctgaattagtaattaagactcacctggattgaaatccttgttgcttaatctctctaagcctcagttttctcatcaataaaatagaaataataattatagtactaacattctcaaagagtcattggagagttaaattagataatatatgtaaagtgctaagcacaatgtctgacatatgaagtactcattaaatgtcaaccaattttacaatcattattccttctcttcacaccctttctgctttcctggctcacacatagaattcctagactgttttcatcctttaattgaagttttaaggattcagtttcagtatctctgaagctagtttctgacattcatgataaagatgtgaaatcagggttaaaggagaaagtgacaggaaagagaagtaggtataaagcctgaaactagagaaggctagcaatgctctcgagagatgaaagtttggaaagggaggacagtagtctgatatatccattttcataagaaaaactattgcattcattatttctgtcatattaagtttctatatgagcttcaaatttaatttaaataagcctcagatcacctaaacttgcaagttacaatacgggattgcccattttccaaaacctaaagcacagtttccaatatgcacttaattcattctcagtgctgaggtatctggacataaaacaggacaccataaactactgcaatcaaatccagagaaaggcagtgaaatattatggaaaggctcatttaagtttccctttccaaataaacaaaaacaaaatctgtgatccatcagaatcagtatactgaagttcttaaaatgacaagcatctctctttaaagagatagagaaaggggcgaggggctctcattggagccctctagtggcaaaatccaaccacaaagctaaatttctaagcagtgaggataaaatagcaataccctagggctttgttttcagaaaagctgattgacaatcacatatttaaaaacagaaattgtgtaatgattttatttgatcttcagaataattctttgttttgtaaaattttgattgcaaatttcctatgaatgtcaatttttctttataaaagctgacattttaagtaacttatagataactaatattaaataaacctctacaaatgacaaaaatccctagctaaaaaatggatagggcataacaattgtgtttgttttcttggtctaaaggaaagtgtatttacgaacaacctcagagtggtagttttctctatttttttttaaaatacttgtagagcaaaagcttccctattcaagaactgtaacaactttccaaatcaggacattccttcttatatcttgaaaatattatttcatgttacaacttagatctacttggaaacaatattagttagtaacaccaacctcttaggtaacagaaaattaaaagtaggatctataaaatagggaagacatccttatgatgttggcattctttccacgacagtaaacaaacattttagataggcattaacttatataattgaatgtgggagtttgtttcttaatataataactgattctgcataagcaacttttcatcaaacaagtgtctccttctataagaaggaaaggtttcctggtcaaacacctacagtttttctattaataatatatacagccaggtgcagtggctcacacctataatcccacattctaggaggccgaggtaagaggattgcttgaggccaggagtttaagactaacctgggcaacaaagcaagacctggtttctacaattttttttttttttaattagctgggtatggtggtggacctgcagtccttgctacttgagaggctgaggtggaaggaccacttgaccccaagagttggagactgcagtgagctgtgatggcaccattacactctatcctgagcaacagagggaggccctgtctctaaaaattttttttttaattaaaacaaaaagatacaaacaagtaataaatacaacaagagacaaaatacaaggctatctcactaattttaattcatgaatgcttatcttatcttcggcccaaagtagttttcaaaagtttgataaaacaaataaaaaaaaatcaattatctccctaccaaagtaattcctgctgacattaattttctttattagaacagtacagaaaggtgtaaaatgagtaagtaaaagcctcactctcactgtctcttgctccctgccctaaaagaacatcattagcatttattgtgacttctttcaggaaaaaaatactaagggctttaagataatgtgttaaaggtgaaacaggctctctgccttttctttagcttacactaggaggaatattagtaagtactatgtctaaaagagaaaaacatcataatcacaggactataaggaaccttacatatgatatggcctaaactttcttttttcattctttcttttttttttttttttttttttttgagatggagtctcactctgtcgctcaagctggagtccagtggcgcaatcttgacttactgcaacctctgccttctggattcaagcgattctcctgcctcagcctcctgaggagctgggactacaggtgcctgccactatgcctgggtaatttttgtatttttagtagagacagggtttcaccatgttggtcagggtggtctcgaactcctgacctcgtgatccacccacctcagctgcccaaagtgctgggattacaggcgtgagccaccgcacgtggccctaactttcattttaaacatgagaagctggtaccatggtggttaaatacccaaggtgatagccagtaggttaagtgccagagctgggaccagaatccaggtctttgtctctctagccaatgatttttttactcccatcaacatgttataaatataaatttaatcaaagagtaaggaacactaaaatggtttgccttgtgtaagcacgatacttgactctagttttctcaaaaaattaattgtaaagcacaaaaaaatacttatattatttattagttaatagtgcccttagagcatgtattgtatcatttcatcctatttggtcaagcgctagaaaaatgtcacattatttaaaaaaaagaatatgtaaaaagtatcttattttgccaatcactgcaaatatcagagagtctttatatggtttagaaccatccttgaaaaacagaagttgtttgttagcttcatgacctagtctcatgatccaatttatgcactctagagtttctgagattcaactcaagggtacaagggagggtacacggcttattaggttaagcccttatggcaataagcccagggcaaagaactagtataagcaaaggtcaccactaacatttcatcgaatagatgccaaaaattgttctttgggttaaataattcctaagagatgtatataaaatactgtcactgttagaagtcacaaagaatggggtaaagttctgtaatttaatactgcttcctgagattaaaaaaataaataatcctgagatggaagggtagagttagagggaacacaatgaactgctcaggaacataacacaattattttttaatgtatattttaatgtgacattaataaattataatcctatatgtattttttgtatgtataatcatctctacctttttcatagaattgaatcctatatctaattttttctatctgtaatcacctttaccttcacagagttgtaatcaatattaaactcctaaaaccatcttaaaatattaaaccctaaaacagtatggcacagtagctaaacgcatgagctctgacatacctgattgcctaggtttttctgaatggtcacctactaagtaggtggccacccaggtgaccttagatgttttctaacactgtgtctcaattttcttaatataaaaaataggaataataatagtaccaactttgtaggattgttgtgaagattaatttagatgtatagtccttagaatactgcctggtattgtgtagatactcagcaaatgttagctataataattatgatttttaatatttagaaatatattttctcaagttttaaccattttatttaaatagctttaattattaagtaattttagatttataattttttgagttttatgttaacagcaatataaggtatctttttctttcgtctaattgatgtccaagggtcaggaaaaaaaataaggatttagaatattttggtccacaagagagtgcaaacatgctaccttttcttcagactgtttccttaataaaattgatattttgaaaagttaaaatattatttaaggtgctttacattttctggcttcaaagcctattgttttaatttaaatattgtctatattaaattattcagtagaataatatgaccaagatctttaggactctcagaaacttggctttggcctagggttgggagtagagggaagtccaaaagtctatggaatgtgaactgaatacctgagggatttgctatattctaaaactaaggagacaaatgctcagtaggcttataccctacttagatcaacagtgtcgagactcatgccatgacatgcactctgtcaattacaaagagcaaagcaaaagttcaaacctactgaaggccctgactttcctctcatccctggtggtcctggtaaaccaacagcaccctaagagaagagaataacagaagagaaagttattataccacaaaaggcagacataccactatttacaaactgctaaaaaatttcataaagtatgctaaaatattgagacaaaagtttcaaacaagaacttaaaaccatattgataccacattctaacacaatacatggataaaataataagcagttctttcttttgaatttacactttttcatatttacataaaattaatggtataaacattaccttgtctccaggatacccgggttctcctagctctcctgctgtgccttgttcaccctggaaagcacaatttcatgcaaagatacttatgtatcacaaacatggcaatattataagaaagcaaatattcattgtagaagaataatttctctatttttcttacttctgaggaaaactaatataattgatactacaaattagactccataaaaacaaaatatttcataaattgtgttgactgaaaagtaaaagacaaatgtgataaaaattatttttataatattaatatttaaatcaccttatcacctttgattccaggtagtcctttattccctgaaaggccctacaaaaaaaggtgacattttgtgatatcatagacagattaaagggaaatatccattatacaaatagaaccataccattgggccaggaattccagcaggtccaattggtcccacagggccaacactgccctggaaaacagtaagaaagaaatgcatcattaagcattcattaggattagaaagaaaatgtggcagaattaataaattaatgaacccaaaacagccaactcactaagctcctacacgtgccttgttcttcaacaacttatttttctctccacatttataaatcataccaatatttcaaaccttagtgaagtccatcatttttctgaaaccttttcatatttgtctagtccacagagattctttcctcctttgagctcctataatactgtccatgacattcatcttgcaatatttctccaactagatgagacctttaaaaaatattttagtgccatattcccaggaactagtcaacagatacttcatttgattgtcttagagttttatttcacccacttattcagcaaatattttttgaggagttactatgtgccagacatcctaatgatttgattttataatttcaaatttgcagaatgagaaaatttatcataatttcagggataaactcagaggcaaacaaaaagctctactcttctgggcttatctcgtttattcatcatttaatatttactaagcataatatgtacgagacactgttgaagaaaaaaagagaaaaaagacataatctctaacatcaaggttctcaatttaatgctctaattcttcagaaacattaccactattatcttctgcaagcaagagacttagaaaaaacttcaatatgtcatcttagaagacaaagggcaatagcaacataagggtatgaaagaaaaatttgaaaaacaaaatggcacttcttggtggtttgggatcagttataatttctgtgtcactgaggtctcctttttcttctttttctcacgatctttctttgcctggcttccttactactctttataatggaaatccaagttagttcaaacttctctttctagtttctaaatattaaggaactcttaaagttgcatttgtgaaatgctaagaatgttacctcttgtagttagaattctaatttcttaggatagcatcctaagccctctctattaggcttccatcaaactttccagtctcctttccttccattgtcctcatttcccttccactttacttctccctccccgaaatcctccattctagctgcagtggactgtctttcattttctgaatagctctcccttaccaaatgctcagaacctttgacaagacagttaccagtactagaatgcacttctactacgctacttagtacatggcactgtactttttttttcctgccttcctagtctgtgcattttgtgacagcggaaacacgtttcattcattttttttatttcccagacccaacataataactggcagataatggttctgaaataaagtgtagaatgaatactgaagggattaatttgaaatggtgatttctagagctcaatatcctaacataacagcatttctaattgtctacatttatataatacaaatttcagaatggaaaataagacatcatatggatgagtcttaaagtctgtgaaatacagctaagataaattatttctaacatgtttaatcctgaaatatataacaccgttagaggcaaagggtaatactttccaacttaatagatatgcaatattaatacatgatgcttgtaatttcaaattatgtcaataggaaaacttgtgcttatgattacagtggctagtttattcaaagttcatagctttaaaacttatgataggttagaaaaatacaaaaatatctctgtttggaaattatgcaaaagtaatccaagtaagtatggaaaggactatcttaacaaacacacacacaaatctttctttgtgtccttttgttttcttcatagataaaataatattcttaacttttttcagtaagtatattactagcatcttcagatgaatgtactttgtatatataatatcctattttacttttcagtgactctacatgaaaaaatcacataacagtaagtattgggagatatgaaaaatatattataatgaacttagaaaaataaagaactataaagtaaaattgaatactatggaattgaaatttccaagaaacagcatgtcacaaattgagtggaaatcctagtcctgagaaactatagccttctgaaagcaactcagttctcagttctaccaaggtaacctgaaagtccttcagcattccctaactaccaactcatcttccataagaacatggaacagacagaagaaatactttcatgcgtgggagccttgttgagggtgtttgggatatggcatcagagacagaggagcctcccacacagctcctctgagaacttctgagttaagtcaaagaaatagagagacccagaggataagttatttgtattaaaaagagcagtcactggccaattaataagggttcatatggtatactgtagaaaggactgtgagttccacatggtgcttttaaatcacacccaccatactcacacgtgatacacattgtcactagtctaagaaagcatataacaatgacaaccaactgcatggaaaaaataatttagataaagcaatagcatctcttatcagaaactatacctgctggaagggaacacctgagagataaagcagaggctgctgctccgggcaagcagacaagttgtttactatgcaatataaagggtcttcataatccttcccaattactttcaaaacctcaattccttccattctgctcccaagcccttacttcctatgctacaatcccactactcctctttccagtcccaaacattcatttttccccatcttctgtgtatttgaacacagcatttttgtacctaaagaaagcttttccccctttcaccccaccccattcatatacaatcttcaagatatagctccaaaaatatctcctttgtgaagcctactctgactttctgagataacagaaattgctccttttcagtggttttacatttaatcaattatagcagtaatcacagtatatgacactacttatttttccttctatgccattagattgtaatgttgccaaaaataggaattttaacttgttcatattattaggcctagcagttagttcagctatttagtaggtgctcacattgttttaattttaaaaagtaatgaatgtaaaatggaagtaacaatacctgctttatctactttacaactcattgaggagcaaataagatatgtatataaaactactttgaaaggtagaaaggaccatctatatcagtttagaagagatgaggactacaaagatgactcttactatctgatatggtttgggtgtgtccccacccaaaatttcatctgaattgtagtctccataatccccacatgtcaaaggcaggaccaggtggacataatcagatcattggggaggattcccccatgctattctcatgatagtgagtgaggctcatgaaatctgatggttttataagcatctggcatttcccttgttgcactcactccgtcctgccaccctgtgaagaagtgcctgcttctcctttgccttccaacatgactgtaagtttcctgaggtcaccccagcaatgcagaactgtgagtcaattaaatctctttcctttataaattacccagtctcggatatttcttcacagtggtgtgagaactggctattacagtaaactggtactgcagagaatggttgctgctataaagatacctggaaatgtgaaagcaactttggaactgggtaacaggcagaggctggaacagtgtggagggctcagaagaagacaggaagatgtgggaaagtttggaacttcctagagacttattgaatggcttttatcaaaatcctgatagtgatttggacaatgaagtccaagctgaggtggtctcagggtaagatgaaaaacttcccaggaactacagtaagggtgactcttgctatgctttagctaacagactggtggcattttgccctgccctaaagttctgtggaactttgaacttgagagagatgatttaggatatctggcggaagaaatttttaagcagcaaagcattcaagaggtgtcttggatgctcttaaaagcattcagttttatgcattcacaaagagtttggaattggaacttatgtttaaaagggaagcaaagtataaaaaagttcagaaaatttgcagcatgagaatgcaatagaaaagaaaaactgattttctgaggagaaattaaagtcagctgcagaaatctgggtaagtaatgagaagccaagtgttaatccccaagacaatggggaaaatgtctccagggagtgtcagagatcttcacagcagccccctcctatcacaggcccagaggcctaggagaaaaaaaaggtttttgggctgggcctagagccttgctgctttgtgcagtctcaggacttggtgccctgaatcccagctgtggctaaaaggggtcaacacagagctcaggccggtgcttcagagggtgcaagccccaagccttggctacttacacatggtgttgagcctgcaggtgcacagaagtcaataattgaggtttgggaacctctgcctagatttcacaggatgtcaggaaatgcctggatgtccaggcagaagtttgctgcaggggtgacaccctcatggagaatctctgctaggacagtgtagaagggaaatgtagggtcagaggccccacacagagtccccactagggcactttttagtggagctgtgagaagagggccaccatcttccagaccccagaatggtagatccacgaacagcttgcaccattcacctggaaaagccacaggcactcaatgccagaccatgaaggcagctgggtgggggtctttaccctttaaagctacagggtggtgctgcccaaggctgtgggaacccacctcctacatcagtgtgacctggatgtgagacacggagtcaaattgagatcattttggaattttaagttttaatgactgccctacttgattttggattttcatggagcctgtagcccctttgttttggccaatatctcctatttggaatgggagtatttacccaatgcctgtacccccattgtatctaggaggtaactaactgctttcaattttacaggttcatagatggaaggacttgccttgtctcagataagactttggacttagacttttgggttaacgctggaatgagctagaactttgggggactgtcggaaaggcatgattgtgttttgaaatgtgaggacatgagatttgggaggagccagtggcagaatgatatggtttggctatggccccacccaaaatctcatcttgaattataattcccataacccccacatgccaagggcaggaccaggtggacataattggatcatggagatggctgccccatgctgttcccatgatagtaagtgaggctcacgagatctcatggttttataagcatctggcatttcccctgtttgcattcactctgctaccctctacagaaggcacctgcttttcctttgtcttccaccatgattgtaagtttcctgaggcctccccagcaatgtggaactgtgagtcaattaaacctctttcctttataaattacgcagtctcaggtatttcttcatagctgtgtgagaatggactaatacagttatcattagccatttccttttctgtagaatctcttcccatgaactgaaaggtgaatggagaaagagaaaatacagaagatccacttatttttactgagtacttttatgtgccagacagtgtgctaagttttggagcagaaaagtagagatagagtgtttcaggtagacaaacatgtgcaaaaccttgtagcaaagatgctgcatagcatctgagaattaacagctttgctagtatacaaatagtatgtcatggacatgtgggtaagaactaaaccagactagatatcttgggccatatttaaaaaatttggtcttaatcttgacagtaacaacagaagctttttagctaatcaactccatgctaatagattaaataaaaactgcatgaagagcatctttggaatctaactccttttgcctacttccttactctacccactgactaatatctacaggtttaaccctattctaagttctcaggaaaaaaaaaaacatcacacagagtttctcagaaaggactaaagaaatctcataaggtagataatatacacataagggagtataagttttaaggaggtggtacagaccaacgaaattctggactctggatttagatcacctggcttcaaatctgggctcaaacacttatcagctaaatagtcatgggttggtctgagaatggaatgacttaacaattgtggctagtccactgaaaatagtaaacaaatgtgaggtgccctcagtaattttattattactactactacaaatcttaccattatgttagagaaaagtttaaatgtttcagactcacacaggttctttgactctaaatcccatactcatgttatcccaagatggcaagttaaagcttatgctgacttaaattttaccacagttccaataactaagctcctgacttatttatttttatttatttgatttttttttttttttttttagagagatggggtcttgcttcatcacctaggctggagtgcagcagcatgatcatagctcactgctgcctctaactcctgagctcaggagatgctctcacctcagcctcctaaacagcagagactacaggtgtgctctacctcacttggctaattaaaacattttttcagctttatttttatttttttcaacgttttttatttaaataaggagaattcttccctatggaaagagctagcacaatcacatatttgaaaggagaaacaataggtactgaaccggagggaaagggcgaaggctgagtgtaccagcaccagcctggagaatccacaattccacttcctatccaaggtaagtttccgaaaatagtatataaacaagttgcacattatacctttagccatcatctgccctttcaaatatctggtctacatgaaaagagaaagaggaaaggccaaaacgaaaacaaaaggaaacaaaaacaaaacgcaaccctctcaaaaacaaaagaaaaaaaaacccaaaatcttttttactacacagagcataaggtcaaaaacttacagtaccagtgtccccttcaagccatggaagaaaaacatccacataaagccttagcaagaatttccactctgaggctttgtaacatgctgaagacagggccctgggggtgctgctgccattttggaggccaccaactggggtggagaatcagtgaacagcacgtctcatgcacttggaagatcaccagccaaatatgcactggtggcctggtggagcatggctaggtgactgcctacccccaacactgaaccactcctatcctggatgacctacttcttaggtctgtctcacatttcacaaaagagctggaagtctgcatttctcattcatcacaaaacaggacaaagcacacacactctagtatctttggtcatcaaaggccatttccaacagaccctcaaacccacgtttgctttgcaagaagtgaaaagggacaaatgaagatttgaagggcagcctgcagccacttggcagaaggaaactaaatggcagggagggggctccaccagagctgccatgctgccacagtgggccaggctaattttcttttttctttctttttttttttttttgttgttgttgttgtagcattgggatctcatcatcttgcccaggcttggtctcaaactcctaagctcaagtaaccctcctgccttggcctcctaaagtgctgggatcataggcatgagccaccatgcctagccgtgacttctttgaccaagctgtcaccttgtgctttgggacagctaaaggtaagggaaagaagactgaaagaaaggctatcagcatactgaacagatatttgcactcccatgtttattgcagcactattcacaatagccaaaatacagaatcaacttaagtatccatcagtagatgaatgaagaaaatgtggtacatacacacaatagaatattattcagctataaaaaagaatgagattctgtcatttgcaacaacaggaatggaactggaagacattagtgatataagccaggcacagaaaggtaactaacacatgttctcacaaatatgtgggagctaaatatatgagaagggtaggagtgggggttataaaaggtatgataaataggtacaaaaatacagtagaaagaataagatctagtattccacagcacaacagagtggctatttttaacaacagttgatcacagatttcaaaataaaagagtgaaattagaatgttcctaacacaaagaaataataagtgcttgaggtgatacaagcaccaattattcaaatttgatcattacacatttttgcttgtaacaaacatcacatgtacccccttaatatgtacagctattatgtattgaaaataattaacaattttttaaaaaggaaagaagagggtcttctatgtcttatgcttttgaggaaactttgtcttaagtatcctttagcgcacaggtacaaatacatacatataggtctataaaaatatatcattattttttcttatcataaaatacaattaattttttgacttatactactggtctaattattcatatctggttgaaaaaaatacatttaatcaaggttgataaccaacaatgacagtaaaacctctcatttccctaagtttcaaaaacacatctaacacatataaattgcacaataaaatattttcttaagaatgatgatatttagtgatactcactctaagcccaggaaaccccggaggaccagtgccacctacaagtccctattgtaaaagaaatttgcaatacttattaaatttgattcccaactactaagggtatttctgaagataaacacaaaactttctagctaagaatacatcaaaatgtaccttctactatagctaacttctgaaactcccctaatctatgcatcctcctgagaagcacaaacctatggtggccatttatgttcttcacaagtgcccttggctaaatgcttttggatgccaggactaccacctagcttaagcagagtcccctctgcctcctatgtatttaaccaaggaagtaaatcctatcaataatcaacactgtacacttaattatgctatccattctatgaaaagacaggtggtcagcacgtagggttagaaaaacattttcagacggtttaaaacactatggactcttttgaagtacattatttaaattctctaatcttcatttttctcattaaaatagaaataccaatatttgttctcactgtaaatatcacaatgaaatttgtcatatgtaaaggcaccataaaaatgtataaaattttcaatactgttaaattatttatataagtatcagatttttcatgatcattattaatttttccagctgatttgtgattggtcttttgaactcattgtcattacactttatagtctttaagataattcctaattcactttatgtcactgtcacattatttacaaggcacaaagtacatgaatgtccttctttttttgcatttcaaattctgtttggaaacaaaggcagagaatatactatagagaattataaaccagtaaactaaatatatccagttgactattgtattttaaagattttaaaaactcaaaatgctcctgaagaaatattattatattttaaatgaagagcagatttcaaaaaagaaaactttaaatattctaggagtcttaacagacttcatggatagtaactgacaaaaaattatgtaaaatggcttcacactaggtacacaagtgcacaaatggcattaaaaataaataatgtctactttattatgcttgaaatgggaagctcctcagaatcatatgcaagaaaaatggtaaacattccacttaaaacaacattcaagtttttaacaatttatttgaaaatcagttctacttttatctgctatgccttgtaacaaatgcagtcttggctgaattcactgaatgagctaatatagttttaatttggaaaagagaagtaaaaaagaagaaaaataaactattttaaactcttcatgctagtgatttacttacgtgtaattattggaactattcccaatttaggctacagagattttgtgtttttttctaactcactttaaaatcttatgaaaagaatatgtgaatggcttaagattggggaatagctattggatggtttttaagagcaaaaactaaagcttttctacctagcgccaaaaaatagcaatccatcatcattctttgatgatataattaaactaattttagaatagtaactctttctcaatctgaacattgacagctaaataatcccaaagtagaataattttctataaaacactaagaagtaaggtggatcaatgacaggtttgagtccaaagagcaatcgctgagtgtaaaatttttatataaggcttgttagtactttcatgtataagagacagtattgtgatcacatatttttaatattttacttaagcagttatacttaacatcatcaaaataattaatttaaagattgaatgtcatgatgaaatttgaaatatttttggttaatttcctaagctgaaaaatcacaaactggaatgtgcacagtggtgtggagattgtttttccaatagtgtttattcacaaatatgataataaggactgtaagtgcagtgctatgaagtatgaatgatgttagaatgcaaggctgaaccaacataatgtactcacaggactgccatcaagaccagcagggcctctgtctccaaagtcacctggaaaaccctgtcacagggaaagaggaagaatgccaacatatataaataattcatttttgctgtattttctaacaaagaatttagtaatagaaaatattaatttcctaactcttaaactgtaatgcaacaaacattcttttgcataacacgcttaattgattttaaatacaatatttcaaaaaataaaaaacgaaatacagtatttctatatgttataaaaattattttatatgccacataacatatacagaaaacaaaattggagaagtttgttcatcatacataaaaaatcaccaaatgaaaggaaaaacaatgaagatttctggctgaacaatcttcagttatctctgctattccaaactattcctatactcaccccatagagaataaaatagctagtattattaagcacttgccatgtgctaaagggtttatgcacataattatatatacacacttcatttcatcttcataacaggtctattcaatagatactaatattctcacattgttgttgaggaagttaaagcacagagagtgtaggtcacttgctcaaggttagaccattaaaaatgggtgggactgagatgtgaatggaggcagaccgattctagagtccatgtttttcaactatgctatactgaatactttaaatcatcattccaagacatacatgtaaaacaaaaagtcctttaagtacagttttattaaggaaacgaataatacacataaatactacaaatttaaaatgaggtgaaaattaaaagcttcccaaatgcctattgagaattctgcatggtaaaactatgaaggatggtaaaataacaaaccttctcattataaattctattgtaaaataactcaacgctcagctactcttactttacaatactacatttttctctaaagatttaccattcctcaactttaaagctcactttttaagaggctattttataaaaatgtttataagacttactattgtaaacattttcataatattcatttacaaaaactaggaataacaaaaataaaaatctatcattagattcttataatctctttacataggcaagtcagtattaaatattatgtttaacagactgccaaaaattactggttcccagagcaaatatgaataggttaaacttaaaagatagtttaacaatggaaaaaatgtacaatgtttctaaaatatagttaactcctactagaagcacagtttctcttattctgtaatcaaaggataatgtaaaaaccatctgtgtagtcaaatatattgtagccatactcccttcaaagtcagctgaagctcaagcattttactttcgttgtctttggaagtcaaattttcttgtcaacaacttgcaaatctgcaatatattatcctattcagtatgagctaacatggatacttgaaagtacttatgacacacaggtaatggaaaaagtagaggaaatatactacagtaagtctgaaacataagagatgattgattttttttagatagatcattagtaggttttccagaaaccccagtgaaataataaagtgtaggggacacactgcatgattccattactgtgtaatgtccagaataggcaaatccacagggacataaagtagattagtggttgcctacggctggtgatgtgggggaggaatggaaagtgattcctaatgagtacaggatttcttttgggggtgatgaaaatgttataaaatcagatactgtgatggctgcacaattctgaatatactaaaaactgccaaattatatactttaaaggtgaattttatggtatgtgaattatatctcaataaagttgttcttaaaaaacaacctgaacaaggagtgggattgctgaaaaacctttgggaattcactcaggattgcctagagaatgtgctgttctcccaatccttcccagtcccttgcatccagtgggagaaactgttctctggctcaccttccctcaaaatgagtaatttttccccacctaggagagggaagatgagaaagagaagaggggaaagaactgtgatcagttcttcccttatcacaaaatacttactttctacaaccagcagaaaaataatgcaatattcattaatttcaacttcttattcttccagtagttcacaaacatgtgtattggttgttcaccttgactttgcccctgaaataatttaattgaatatctactttaaatttttaatgtatttttctttattattattattatcgttgtcgagatggggtctcactttgttgcccagactcttctcaaactcccagcttcaagtgatacctcctgcctcagcctcccgtagtgttgggattacaggcataagccactgtaccaagccgttgtgtattgtttctcttctcactttattactcattaaacatttcattttaattctctattcttgatagagataatttattcttttaatccctcatatgttgatcatgtattatcaatttttgaaataatttctatgaaatctagacacttcttgttttatgaaatattgcacagttaataccacaaaggcattatttggctccttattagacacataatattttcttttaaagaacatcataccaatgttttatattgttgaatatttccttgcttgtttaatgtttattcagttgtttttcaatgctaataactgcattaatattttaatacaggtgaggttctatattcttttaatcatgaacttaatgtttgcagccacatagcttcattgccaaaaaatggtcttcaagattggttgtgaaatatggaacagtagtgacaaaatacatatctttcctttaattttataatacaaaagacagtctctataatttctttctccagttgaaagaatgttgaagaatgaaatattttgttatattttcctggtagaaaattattatcattaatttaaatcaaattgtgttttcctaaaaatactctcacgttgccaaaggacaaaatggccatttagcaggattatcatgcaacagagataggaaagctcaagagttttgcttttcttgttcaatttgccagtttcacaaatgttaactttcatcttctaatgagcatgccagagtcacattgttgcttctgtgttgtatatagttctcttcttcacattttgatcagttaaaatattttatgtgatgaagaatatgatgtttcaggaatttcaaaaaatctcttcaagttgtaaataattttctattttctcatttatttccagtgatcagtgtggtggacagtttaaaggatctccaaagattcccatttcccagtgttcacacttttctatgacatcctccctttgagtgtagctagcacctatgacttgcttcatctaacaaatagcatatagcaaaggtgatgagatatcactgccatgattatgttacactatataagactgtcttagcagcctggagctagagacttctcttatgagtttgatgaagtaagcagctgtgttggagaagtccatgtggccagaaactgtgggtgactctgcaaactctggacagtctataggacctgagagtggcccatagccaagagccggcaaaaagccagagccctccattctacaacctcaaggtaataaattcttcctacaacctgaatgagtctggaaatgaactttaccccagtcaagcttccagatgataatgcagcctgtctgacactttgattgtaaacttatgaccagagcagaagactcagttaagtaacacctagattcctgacccatgaaaactgcaagataataaatgaatattgttttaagctgctaagtttgtggtatttgttatgtatcaatagaaacagaaaaccaattaaattggtaattaaatcttctttagagaatatataatgtcttatttccaaattttaccataggtaatgttcaatataagtctactgttgtttctagttttaaaaaacttagatcatctctgaagattttctactgctgtctactttctattacaaattataataacaaaaagtattacaatttttatatttacttttttgaaaatttgactttatcttgttaaatatctgtattttaaactttatcattccagcattttatgtccacctgtcgccaatgtaaaaaaaatcttatcatgcttcatgaattttgtctatacttatgtaaagacaaatttaataataatatgcattgtttaataatggaaaatgcttgtcagtctccaattgcaactgtttgcaaatatcacactaattctattacctcaggaagaataaatcataatagaaagaaaagataatagaagcttaaaattaccagaaaacagtatttttattacgtaagattctattgcattcatgctgagagaaaaattagataattaatttctctttccttttatcaaaatgcttctactgcctgctcgaacccttagcacaatcttgagcagtttctgtctccaatgtcagcaatggtaccacttaaaaaccttcatggcattcagacatgaaaatacaggcaagagatgtggagaatttctctgaagcctaaacattattaaactgtggtacccagcctcaatgatggacctcagtgatctttgattcccggtattcatgctgttatgtagtccagacgcaccctgaattatgtgggcctatgtgaccaaaagaatatagaagtgacaatgtgtaatttctgaagctaggtcataaagatactacagctatcaccttgctgtagtatctttacaccactcactctgggggaagccaaagctatgttctgaatacattcagcagcactgtggagaggtctccatggggaggaagtgaggcctcccatcaacaactagcaccaacttggccagcaagtgagcctccttaaaagcaaatcctccaacccccagtcaagccttcagatgacagtagccctaaccaaaatcttaaccataacctcatgaattagaaccacccaactatgccactaccaaattcctgacccacagaaactataaaaataatacatatttattgttgttttaaaccaccaacttaatttgtttcatagcaatagatagctaatacatagtaacaagagtgactgtctaggattatggggcatgtgatgccagtgctaagtgctggatcctgaatgacagaggcactcaagtattttaaatgtatgatatgcaggggccctctaaagctcagagcccagagcaagtttctctgttgcctgggtctaacaatggtactgttatcaaacatggtagttattaaacactaagaccaaaagaagtttgttagacttgataggcctgaatacatgtatgtgatattaatattttagatcactcatagatactacatttggtagtctatttaaatatgtttaaacagtggaaaacttcttgcttagcatgtccagtaaaagcattattttcctagctccacaaataatatgtttaaatgtatataaaataactaggaaaataagaggaccaagataaccataaaatggtcacaatgactatatttacagaatttttaaaaaacaaaagcaatacaaaaacccttctggagaacatattttgttctttctagaggaaggtttagaaacaacatatttaatctgaagtagaaatgaataaaaattatcatagaaggttatatactaaacaagcattaataatcataacagaaatcatttgttccaaaactaagcattgaaaacacaggatcagactaacttgtctagaattagaaacactaaaatttaacctagaagttatttttacacattctgcatatgaatacatattaccaggaaattctgttattttaaaatccctcaaatataaaacaagatcactacaggaagaggctggagtgtgaagtattctgtgatgatctaatcttttcacccttcttttcctcacagcaaggacaatttgatccacactcagggtcaaccctatcctcataattgagactaattctaaacttcatcagaaacatgagtaggtttggcccaattcatgggggtttggcccaattcatggagatttggcatcaaggcaggcttaatgctaacctgggcctcagttcccagattcaagttccggccttgttcttaaagactgaataccacgttgtgtcctttttcttgtgtccaaaaaccagatgtggtatacaacatcatgttctgtccctcaataataagagtcccaccttattcttgccatttgccctcctagagaatataatccctgagcccaacctaggcctaactgccatatatgcactcacacttctgattttgataacctacaaggctcttttttttttcttttcttaattttatttattattattacactttaagttttagggtacatgtgcacaatgtgcaggttagttacatatgtatacatgtgccatgctggtgtgctgcacccactaactcgtcatctagcattaggtatatctcccaatgctatccctcccccctccccccacccctacaaggctctttgagttgtcccttatgttatccaccctgaagataattgccatattcccatccattggtgtcacatctctatgaaatcaattatgttctgcctggacttcctccaaattataacatgtagttcattgggtgtccttcttcttagtgtctatgccaaccctgtggtggggttaattcaaagtcctgaaatcttccatacaccctgtcatactacagttagccaaatatagctactacagactatgcccagtaaagtagaatccagaaaatacatttttcctgaaggaggcagaatcccttaagaattaataacaactttttcataatgttctagctagagttgtactttatgatagaattaactgcattcttttcctaaaacaaaaacaaaacaaaataaaaaacactgtctctaaattctccacaaaatgtatgtatctgagatgctactatgcaatatgtatttaagactgtcttgggctaaagataaaaactaataacagatgtccaacaccaggattttatattctgaaattctaactctagatttagaagccaaaatacagtttacttcaaatacactcttctaacagaaaaacatatgagaaaagaggagcaggctctcctttctatagttagaaaagtaaacatctctgaagtctgggtgccttaagggtgttattttgcccaccattctaggctgtgatatttttatcttcagaggaagaaaactaagtacagttttgctctttgtcaaactttaaatgtaatgtgatttgattatttataatccattctaagggtctgaaaaattccttgaaaaacatcagcattcggatagcagttttctaggtgttgttgaaagcaattcccatctccaatttcatgtttattttcaatcctggcaagtcagttctagcataaattttttaggtctgtggagccatataaatttgcatggctaacttggtacaagacagagactactgattaaatcaagctgagagctctgtaaatgctttttttaaaagcaactatagaatttcctgattgtagcactacaaaataaactttggaaactttgcactaaaaaggaagctacttggagtgaggtataagaaatctaaagttatcaaatacataacaaatcccctctccctgcctcccctattttttttaaacaggattcttcttttctgttatgaatcagtgtacttaggcttttaaaaaatctggctcacatcagatatgttccaagaagattctcaaataaagacattaaagcatgtaaaacaaaacagtagtagttctatggtgtttaaaggctcctgaccaataaaggttgtccactgtcttgtcttttcctgaaatctccagagaatgaacttgagttgaactcaaatatccacagatagagagcaaaaggatgaatcaataatagcctcttgagcttctctatcttcaacagttagttttattgaaggcacagagagccccagggtatcctctaatattaattaataataagggttttgatccaattgtgacatgtagggagtgcaggagggaaggagaggaagaagtcagaactacacctcgctatccaaaagcatgagtatacacatacattgactaatattaactgtgattacaggaagtctttaaaaataattgttgtggttagtaagtacttatgctaaaatcctgaaatcaaaaatggcttaaaatacaaggaagaaaaaaaacatttcgaatgccaacagtataagaccaaggaacaagtgaatttgttaatataactatttttaaataatctttggttctaaaatataccaaattcctaacaaaaacaattctcctacttcaaactaatggcccttattgaagaaagaagtgtgttacaaatatcaattaaatctaataaacataacatttcattttgggaaaaaagaattttctgggaaataagatttaagtggaaataaattttaacacaaatgttaaatttgaacataccattatgaggctaaataataaataattttctctttttaaaaaataattacctcttgaataaccaaagtaatatgctattctaaaatgtgtccatttcaattgcattcataaaatatttatactaagagaagatagctcttatttgtaagtctataagttcattaaaagaaaaatacagacaccactaagctcattcatgacaacttaattccgtgctttgtgtttactcagggaaataagtgatcatttggttagcagtatgagcacgtgatttatagtaacatcttcccaaatgtaaaattagtaatgttactaactcattggacaattttagacaagacttttagtccatttctgtgctatatgtatatataatataagtactatttttgcaaactattcatatgaaacatgaagctttactgtgtagctgagaatccaattcagtagtccaaagaaactgaccctgatcaataggtagaaagacctgaactcagattttgaagtttttcatggctattgctttcactgtattgactgttagactgtttcatataatacataaaacagaaagtcaagtcatttactaatttctgggcttaaattcagaatcttaaaaaatctaagtataaaatgttaataaaactttatagatttctctaaaaatatctactattgttctataaattatatgttgtaactatttaaaactgaatcatactccatgctcataagactgactatatcgctctacctaaaatgtaaggaaaccagctcatttaaaacccagaaatcaaaacatatcgtgtacctaataattatatacaccttctatcacccacaaaaattaaaaaataaaaaaattagaaaaaaacagaaatattaatttaaaaaattaagggtaatagttgtgataaagtacatcttctaatacgattctactaatgatagtaaatgaaataatattgcatctacacagcagcactacaatgaaacatcaatccaaacttcttctttttatttttatttttcattttttttttgagatggagtctcgctctgttgccaggctggagtgcagtggcacgctctcagctcactgcaacctccgcctcttggattcaagcgattctcctgcctcagtctcctgaggagctgggactacaggcacacaccaccacgcccagctaatttttgtatttttagtagagacagggtttcaccatgttggccaagatggtctcgatctcttgatctcatgatccgcccgcctcggccccccaaagcactgggattataggcatgagccaccatgcccggctcaaacttctaaatagctctcaaaccagcagaaaattaaaacagtttttgacttatgcaaaaccaaaagtttctcagatactggcacgttcagatttcagcatttccaggtttctatcacattcaaatgtataggtgtcatccatctacttcatagtagcctggaatcttttagttctgttctgtatttcacaattgatagtacacataatttaataaattaccaggagaacatgaccatattcatcttctacacacctacttttttcgacatcaaagagaatggaaagattatcaaaagatcttttccttttactgttattaaaacagtaataaatgaccatgattctcatggaattttaaccatctaaattgaagtacaagaatcctatggtgcataataccttttgaagatgattttatttataataaacagaaagaataagggggccatttatacataggataacatattctgggacagtctctaaggtcacccttgccataagttgacatgtggctataactgtattttattctaagtattcacattttccttataaatatagacaaatgattttacagtaaaaatgagaaaaagtacatatagcatacataatatattacggtactagacagactttaaaataaacattagtcagaaaaaatgaatattatgtgtttttcaaatacaatttttctaaagatctaaatctattacaaatgcatatattttaaaagcaataaaactttgaaaattttgtaataagaagaacagtgcaatcaaacaagagccccataatcatttcattcactatttttcagctgtcttcttaaactccttttttaaattcaatagactcctgttggataatttcataattccctatggattacaaaaccagaagttgtctataaaggtctctgaataattttataattcattatagtaggaatagaaattacctgtacattgccaaagccaaaatcaagttgatgtctacatgagatcagcaatattatcaaatgaaataattggtggttatctaagtgatatataacaagggttttgagaaaatactcaatttgctcatcaatgtctaaaattccaccaatgcagattagttattttttcttaagactattttatttttaatttatttttatttttgtttttattttttgagatggagtcttactctgtcacccaggctggagtgcagtggcacgatctcagctcactgcaaccttattctcccgggttcaagtgattctcctgcctcaacctcctgagtagctgggattacaggcacccaccaccacagccagctaatttttgtatttgtagtagagatggggttttgccatattggccaggctggtctcgaacacctgacctcaactgatctgcccgactcggcctcccaaagtgctgggattacaggtgtgagccaccgcgcccagccttcagactgtacctacttagtaaagggtaaggtagcattttaagcattggaagtaattcgtgtattatggcagatgattttattggtccttttattaatagcatacattgataggagaagggtgaaaatttgaagatacagaatggagtaaataagactaaagaaaacaaaccacctattgttaatttttagaattttagattagaaattggatacccaataaatagaaaggtattttctgttgggatatgtgtatgagagctaaaacataaaaaaaaaaattaacacaccaatgtattcaagtgtaacagagtatagttaaatgagatggcatacaaaatacttatcacagtgttgagaacttaaaaagggtgataatagcaacggtgatggcagtttctactgttataaccattataagattagcttctacgttcaatgtaaatgcagggaaacaaaatgtttggcttattttgtatttcttgacagtttggtaagtttatcttaatacactaaaatctttaaactttaaaataactgtatctcattttggccagacgtcatgaagaaacaattcatgcctcttctaagcactgtgagtagaagacagagcagaaatatctaggcagtaaggaaaaggattctggatttagattcagtggagctttgctcaattactgattttaccacttttaactatctgatctgagcaagtcttttaacatctctaagctttattttactcacctatattatggtgacattaacacttactctattttcccttcaaagaatattgcaaagcttgaaggataaatgttacaaaatgatttgagtattctggtgagagctgcagtcctttagtattatcattaagattttattcaggtacacaaaattttagaaaagttgtaatgaaaatctcactttttatcttcacagactatactagcttaacaagaagaacctcaggatgcctctctggaccacatttttctcatttgttaagcaatggggtactggatgatgtcacaatttcctcccatctctgaaattattatattacctagtaaaattcactttcctggattttttttaacctgaaaatatgagaagctgttgcaaactaatctctgaattaacagctgaagcacgcattttaaaaacctccagaacatgagattgaacctctacaacatctggtcatgtagagtaggttaagagtactaccatttgtgttttaagttcttcacgtattttctgtgacattttagctccttgccgtagagataagggttttcccactggtatagtgaaagggttagaagtgttcaaagttcagttattttttaatctaaattttcctttatatcctcaggtattatttgatacactattcaagaggcaaaaattaaaatggaatgattataaacaacaacaaaaagcaaaaagtatcttcacattttaataagtaagaacacataaccaggttatattgctgtaaaataaacctcaaaaaacacaaattaagatacctgtctccccttaaaacccttctttccacggatcccaggaatgccctagaatatagaaaagaaaaaggaaatatttgttgaatgaatgaattaggtactatagatctttttctcccaatataaagcaataaagtatgaaaaagacaaaaacaaattgttctataaactgatgtgatattcagaaaagcctcaatatattaatttaactgaggcagcccctttccttcttcaaaacaaaattctgcttttattcaggaatctatcccatctatacttccaaatgggatcttgacatttccctggtgatagctatttgtccagagacaggcatattaccaaagttggcacaactagatgaacacgaaggtcttattttccacatctaagggacaacgccctcctctctgccttcccctctctatctggatataaacaaggacacatttaacctgtgcactggcaatcttgcaatcatataggaaataagccttagggtaaagacaacattagaaaaggtaaagcagagagatgaatctacagcccacctaacctatggatttctggtcatgtaagaagcagtagggtacagtacttaagtacccaggctttggagccagacaaaaccttgtccaaatcctgggtctgctcttacttcctgtatatagtctaagacaaaatacttcctctgtgtgtgcctcattttcttcatctatgatgagaagaataacaatacctatcattcaataaatggttttatttataaagaagttaattcatgtatatatacacacatatatatgtttattaaaatcttcatgtatatatacatatataaataaagaagttaattcatgtatgtaaaaccatttattaaaattttttatatatatgtacatatataaaaccattcagtaaatcatttgctattttcatcatcatcattaaaaatatctttatatttaagccagtttgaattgtggttttctgttacttgcagattaaagcatcttacttgatactatcactttgagatttgcagactaagcagtctgtcacaaccatgtagcttgagattaatagtacatacaggtaagttagaagacatcactggctgaaacaatccattcactttcaagtcaacagtgtttaaaaaatactcatgtatctgatcatcaaaaaagagttcataggtgagcaagaggactcatttcattaagactttatgtatatttacataatacaaacaatcttttttaaaaaaatagaataattatttcctaaattttcagtagcctccctaaatctcatcaagaagccaaataatgcagacagaattatataagcatttttcatatatatacatgtatatatgtgtacatgtttcatatgtgtacatatgtgtatacacacaatatgcatgtaatgtacaatattgactcccagaaatgacttctttccatttgttttcagcaatagttagcattactctatcttattttcttctgcttttttgtacttaaacattttataacgtaacacccttttagctacatcattcacagttttaatgaaaattttgacatagccaaataatattaggacacagtacccgtgaggggcccaatatcacaaactgatcttgtgtatttatatgttaagacaggtcttgattttttttttttttgagatggagtcttgctctgttgcccaggctggagtgcagtggtgcaatctcggctcactgcaagctccacctcccaggctcatgccattctcctgcctcagcctcccaagtagttgggactacaggcgcccaccaccaggcccggctaattttttgtatttttagtagagatggggtttcaccgtgttagccaggatggtcttgatctcctgacctcatgatccacccgcctcggcctcccaaagtgctgggattagaggcgtgagccactgtgcccggccaggtcttgatattttcatatagactgctaaaaattagtgagtgtgattacagcaatgtgcctattgatggccagtgtcaacactgggcttaagatcattaaatccaagatgacaacattttacaaggacatataattttggtttattaaataatttacaagaaataagctcatgtcaaaggatcagaaaaggattgttatcacgaacagcagagtaattaacaacgtaaactggaaccattgggtcaagaagtagcagatcaattctctgcgtgatcggtgagatacatcctccgttagtttgctgtagtacatgaaggttaggtggcttagttgtggaattatgcttaagatgttttttgctattgaacaaaacaacttgctatgttcaccaggggaaaatctttacctcatctcaccaaagatggctagacattttgattgtcattacagcatatttaaactctttgattatttcttctctgcaggggcattcacaagtaattacaagaaaatataatttaactcactcactgaaaactatttatttgaaaaattcatttagcaatgaatctggttcactttcatttgcaaaaatcacttgccagaaatgaaaattttggcctgaactacattcttataatgataggggtgaaggctgaatgactctctaatttcaaattctatgacaatctactaatattgttcaattctactgttttcaattaatactggcaatgtaaatgaaggaatacaaagataaattactgcatacagattgcatatagcactgaaaactagatatgatgaagctgcaatgccataactcccataattaacttcattaatctttttagtataacaaaccattttgcaaaggttctatctttacttataagtacccatatttattaacagctatctcccattattaaattaaacaaaaatatatcttctgaggctaaattctttactgtatattgctctcaaaatcaagacctgtcaagaatttatactcttgacatatacttttgtaattcattataatgaattacaaaataaaaatttcataattagatattttaatattttggtgtattttcaaaaatttgaacttaaagtacaattatatttctatcatgctatattactttcctttaacaaaattcagtaagattttcaaaagtcaaattacatttctggcaggtgatttttcttcaacctggcttgctaactcagtaagattacttccctgacatctgattttatgacccccattgtacattatcacaagtatatcactttagaaatactatttgaagggaatggacttacccgttctccttcaggtcccagttgtcccgcttctccaggagagccaataaaacccttaaaacaagaaaatagtctgtatattagttcatttgaatattctccccataagtgattctgaatagaagtacttaaaattttatttgtagtagtacgaaattacaagacttacaagtgcgaataacttcccctcacctaattgcttttcttccagaagttaaagatcaatcttcccattaaaaattatacaaaatataatttaagaaatggtggctattaaaaataagcccaaataatttccttcactaaattttatagcgggcagaaaatatatgtatatgattagctaaaatttaagacagaatggaggtatcaaaagaatataagaatataagtataagaagtacagtggaggaagagatacatttcaatgtggcaggaggcaaaggcaatcaaagaaggcttcaaaggagattaccacttgagataggtctagagaataggtaaaatcttggtaaatagagacataataggaagtctttgttaatggtaacaattggggagtgtttgtaaatagtaattgatcacattttatacataatatactttgtgtgtaagatggttttatatgttagctttatgtgtaagacccaccctgccttaataaagattccaatctgatctgagaaacaagggatacatataaataacaatgcaaggcactttattctaatgtaacttagttatatctcacttgtgggaaataacccatttcatcaattttacagataaagtgtatggtagtttaggggctagattaaggagagtcttaaatttcagaataaaaattttagactgtatatattagacaaatggaagctactgattttagggagtatggtaatgcactgatgttatgctgtatttctaaaagattaatctgttgataggatacagcatacagccatgacaggaaacactgaatataggccaacctgttagaaggctctttaagtggtctaaatttgaaggtttacgggtccagatcactggttcaacaaacattattttagtagccattttgtgtctataaagatttggggtttataaagatgcatatgaaaatcaatgccctcaaaaagtacatagtttattgggaaagagggtcatacaaataaataactgtaacatcatttgataattgttacatgattatgcaataggtgatatgacaaatagacaatgggaactttggaagcagaatgaccaactttgcctagagagaagattaatggtgctttgctttactgaggaagcaacatttgagctaagtcctgaagaaaagaaaaggcagggctaacaatgtgccatcagtcaatcaatcagaatgaaatgacacagcatttgcaaagaattgcaaatagtctgtgtgattggtgggcaagaggtgagtttggaaagggtggcaaggggtcatgtcatgaagagtcttttttgttatgatggaaagtctgcaatttacactgtgagtcattaaaaaaacttaagacacagttttcatataatcatattttcactttataaattcacttggattacagtgggtcacataggtctctatctgtctataagaatcaagagaaagatgactctaaagtttacagctggactgatagacaaatgttaaccactgatagaaatatggaaaacaaatagaaaacctgagtttgatataaagaggatgagttttgttagttattttgaatttgtgattataatgagatattcaaatgtaattatcatggcagggagttgggagatgtggggttcatagaaaaagctcatagagaaaaaaagtctgaaggacagatatgtctgaagtcttaaagacagactaaagctttgaggagaaaatattaggaaaaattatcactgatcagacagagggtgaaataggggtgtgagagaagagtagttttatggatgcagagaaaagccaaagtttaaaagaaattgaagtagagatacagtaggtcaattttactaagttctaaataaaggtttcttattttgaatcacagaatgggtgatttttcagagtaaatacttccataataacaaatactgaagaattcaagcattaaaaaagtaattgttatttctatacccattccagcattattcacaattatcaaaagatagaagcaacgtaaatgttcattaacagatgaatgaataaacaaaatgttgtatatacatgaaatggaatattattcagccttaaaaaagaaggatgctgataactgccacaacatagatggaccttaaagacaattacgctaagtgcagtaagccagtcacaaaaggacagatagtgtatgattccacttgcatgatgtacttatagtagtcaaattcatacagacagaaagtagaatggtggttgccagggactgggagtggagaacggggaattgtttattgggtacagagtttcagtttgggaagatgaaaaaagtttttaagatggatggtggcaatggttgtacaacaattggatgtacttaaggccactgaccacatactttaagagggtttatacatggaaaaaattttatgttatatatattttatgttctttattttaaaaagaaagagataaatgtctcaagaatcatatctaagttgcctggaataaaacttttggaaggttttatttccttagaatttagttaagtattgccattaaaaaagttgccaccatccatcttgaaaacttttttaggtgtttttccttgtcaaaggtgcctgaaattgccttatgttccacagattgtatgaacaagcaaaaattaaaagaaaagagggagagagagaatttgttcctttatacataactttaataaagtgaaacatctatgattttcttacttgaaagccaagcagttggagaatgggaaatgtttcttttaaagtgaatcatacaaaagtatttctgatactagagcatttaggattatgatgacaagctgtgtacattttcagaatcatctgttgatgacttcaagtgtaaagtcagctaacatttgttttaatatatacaacaggagttttggttataaataaaaagaaaagacactctaactggtatatacttatcagtgaactaaataatcaattgataactcaagaactgaagtcagaactccaacatagcctgtacagagtgtaaagggaacattttacaattagatattttaaatagaataatgttataagtaattgcttaggtgtttcatagaggtttcttgatcatcattacactgattctaacagaaataagatgtcagcagtaccaaagaaaccacagagttgaggtcattctcaaaataccaccatgaaactagagtttaccgtgtaatgaaacaaagaacattaaaaataataacacatgtttttgctttttggtttgaaggttgtagatccagttagaagcaattttgtgtcaccagcaggaccaccagaaggtcgggagaggttctatatacttttacttttgggggcagctagcacattattacataaggaaatgccaaagaagggtttaaaaattatgatgtgttttaaacatttacatttgacaaaatatttctgctaataccaaaaaataccaacaaataactgccaatgaaaagctaatttatcatgattcatgaaaatattcatgtacaatgcataacatttagaatttaccagtaacaggacacaaattaagtgaaaaacatgtatcctatgagtgtgtttctatgatttttgcctttttaactagattttaagttaatgctaaaaatctatacttgataaagctgcaccctactacccactgatcttcgacaaagtcggcaaaaataaataattgggaaagaataccctgttcaataaatggtgctggaaaacttgctaaccatatgcagaagaatgaaattggactcctacctctgactgagttaatatataaaaattaactcaagatgaattaaagacttagtatgtaagacctcaaactataatcctagaagaaaacctaggaaatacccttctggacaccggcctaggcaaagaatttgtgactaaatcttcaaaagcaacaaatgtaacaaaaaatttggcaattgtaacctaattaaactaaaggtcttctgcagagtaaaagaaaccatcaacagagtaaatagacaacttacagaacaggagaaaatatcttcaaactatgcatctgacaaaggactaatatccagaatctacaaggaacttaaacaaatcaataagaaaaaaacaaataactttattaaaaagtggacaaaggacatgaatagacacttctcaaaagaagacatataagcggccccaaaacatgaaaaaatgctcaacgtaactaatcagagagattcaaatcaaaaccacaaggggataccatctcacaccagtcagaagagctattattaaaaagtcagaaaataacagatgttgatgaggtttcaggaaaaagggaacacttatacactgctggtggtaatgcaaattagttcagcccctgtggaaagaagtttggaaatttctcaaagaactaaaaatagaattaccatttgacccagcaatctcattactgggtgtatacccaaagaaaaataaataattctaccaaaaacacatctgcactcatatgtttattgcagtactattcaccatagaaaagacatggaatcaacccaagtgctcatcaacagtggactgcatgaagaaaatgtggtacatatagaccatggaatactacagtgccataaaaatgaacaaaatcctatcctttgcagcaacatggatgcagatggaggccattatcctaagcaaattaacacagaaacagacaacaaaatactgcatgttctcacttataaatgggagctgaacattgggtatacatggacacaaagacaggaaaaataaacactatagattccctaaggagggagggccagaaaaaggcaagggttgaaaaactacctattgggtactatgttcactgctttgacaacaggatcactaaaagcccaaacctcagcattacacaatatacccatgtaacaaagctgcacatatacccctaaatttcaaataatttttaaatctacatttgagaccctttatgaatgtgaaattccctccttattccaatcacactcccaagtgtgaaacctaactaaagtgtgaaaacttaactaaaagtacaacttaagagggttacagcctagaaaacaattttcaatacaaatgggaaaaggaaaaaacaaaaggatgtataatacaatgcaaaaatggtacatggaagaacacagttatatggatcactgaagcaagatgacaaaacgcagtaagagtaagttgtacagtgccaaatatattttgcatatattccttggagttactagttattgaacagaagacactctcaaattcaaataataattatagaatctatatagtaaatacatgcatacactatgccctataccttaagaatgctcatcttgtttaatttttcacaactacctgaaaagtaagtttcatcatgaccatttaataaataatgagataagaaaaatgaagcacagagagactgaataacatcaaaagtcacaaagctagtaaaagaagtattaaggggctgagcacggtggctcacacctgtaatcccagcactttgggaggctgaggcaggcagatcacaaggtcaggagttcgagaccagcctggccaatatgaatccccatctctactaaaaatacaaaaattagctgggtgtggtggcaggcgcctgtagtcccagctactcaggaggttgaggcaggagaatcacttgaacctgggaggtggaggttgcagtgagccgagatcacaccactgtactccagcctgggccatagagtgagactctgtttcaaaaaaaaaaaaaaagcctatctaactccacagcccatgttcttgaccactaatctcttctggcttcccaaatccaagtcaacatgtgttttcagtgcaatttctaataaaaagtacatgacttttcctcattatgtgattacttaatgcaagaacaaagacagcatgagctcatgaaaagaggtcagggctaaaggtgaaaagacattggttctagttctagccagctataactttgccagatcaagtaagttccttagcttactatttttctcatcagtaaaatggggatgacaggcctgttctcctacatcacagggctgatggcaaaataaaagaataaaatacatatgaaagtatttggaaatgtttaatacttttttaaaatgtaagacatcattattgcacatattgtttaaataccttatgctttacttctttttaaaaggcatgttaggccgggcctggtggctcactcctgtaatcccagcactttgagaggctgaggcaggcagatcacaaggtcaggggtttgagagcagcctggccaacatggtgaaaccctgtctctactaaaaatacaaaaattagcctggtgtggtggcacgtgcctgtagtcccagctacttggaaggctgaggcaggagaatcgcttggacccgggaggcagaggttgcagtgagcctagactgtgccattgcactccagcctgggcaacagagtaagactctgtctcaccaaaaaaaaaaaacacaaaacaaaaacaacaacaacaaaaaatattgcattttagataatataaggcacaaatgtagactttgaaaaatatttggctattaaaaataaagaattttaaaaacatattttttattttatacactacatatatgatatggtttggatgtttgtcccctccaaatcgcatgttaaaatatgattcctaatgttggaggtgtggcctggtgggaagtgactggattggggggcggatccctcgtggatggtttagcatcatctccttggtgacaagtgagttctcaactcacatgagatctggttgtttgaaagtgtctgggaccttccgtttttctctcttactcccactctcgccttgtgacattgtctgctctcccttcaccttccgctgtgactataagtttcctaaggccctcacaagatgcaaatgctggagccatatctgcatggactgcacaactatgagccaattaaacttctgctctttataaattacccagcctcaggtatttatagtgatgcaaaaagtgactaatacaatataatatagaaatgtttattttgcttccttagtgaataaaaatggctaacatttcctttaatggtttgggagtgaaatgggatgttctggatacaataaggttatttctttctttgtagatatttctttactcctgacagtttttgtataataaaatgatctcagccttgaactactatgaatttctttacctcttcatattttttccatgatgacttccttaggtctgtatccattcatatataaataacactacaaatgtttacagagcacattctaacatgccagacattatgctatggaaataaatataaaataatgatgcaaaacctaccacaatgagactgttttctgtcatcatagaagtgaaagcaactgcagtaagcaagtatattcaggctacatttgaattaaattcaaagctactaagagagtgtaaaaatgctaagtgttttatatatttcattctacttttaggcaagcatgcttaacagaatgatggaaatgcctacttacttgtgcacctttaggacctggattaccttctggtccagctaaaccctggtgtaaacaaaagacattgtcatcatactacagtactttttaaagagttaataaatagattaataaaaaggccatataaagagctatcattttcaaaactatagaattcagaactctgtataactaatgaagattaccaatgttcaaggaattttagaatttctgaatcaaaagaggcactggaaataatctatacacaatatattttagatatataaataaagtacattaacacattgtcagatttttaaaatttttttcattacattatttctcattggaagactgtgttgttttaaaacatttctaattaacttattctaaaagataggcccataaattttttttaaaatttattttaaactttagatcaatgtccatatatttacatattcatgttttatatttattatataacatatattatcacttgagagtaagagtctaatatagagtacctctaagtgtttttaaagtcctaaaaaatggaattttgttaacaatttttttcttatttccctcattcttgagaataaaaaagataaatgtaactttatacatttaattaattttagaagtaatcaattcatgaaaacttatgaaagaaagcttgttctattattaatctacatgaagtacagaaagttagaaattataagggaatacatttaaaatgattagaatgcattttaaaaatagtatacaaataactgaattcagttcagataaaagtgtttggtagtggtatactgtttctcaaatttttataactgtgttattaaaaaatgatgtttattacagagagtcttaactcttactattacttcattttgttcagtgacagtattgtaaaatcacaatcaggactgttttaagaacttattaacacttgtgcattttaattttgaaggttccattgtacatcacatcaaacatatttaaaatcccccttccaattttaaataaaactttctgaagaaaaattgtaatggatttctacaactttgattttgaaattatttctctatgagttattcattatttaataaaaaaactatttgaacattaattctcaaaatcagaaatacaatgtattaataaataggaacacaaagagaaaagtctaaatatagttactgcacctgcctgccagggtaaccgggtgaaccaatattaccagcaaatcctggaattccctgaaataataaataaaatgaacagtatagcaaagccaaaggaaacaaatttggtatatttacaatacacaagcttggaaataatttttccccataaaaatacggagtcctacacatggcttatgtaactgaaatcacctacgtgaaggaaaatggacaaaaattgctaaataaaatcagtaaactattagattagggccctaaatgatatatgatcattaataatcataaatctaggatggaaaaatccatactaaaacagacatttattctagaggaagagctggtatatttcttaattaccagtaacttttttaccagtagattgaattctttcttgtttcgatcatcctacaacactccttaacagtctgagcatgagccccagaagactaagaggggcagtaaaccacaaaaccaacctctacttctttcctaaagtaaacttaaccttacagtgagtctgattaagtaaatgaatattaagtggcaaataccgttatcatgacatgggtctgatccagtaaatttgaatggtgctgtggactgaatgtttgtgtgcctcaaaattcatgttaaaatcctaaccctgctgataatgcctaacagcattaggaggtggctctttggaaggtaattaggttggagccctcatgaatgggataaatgaccttataaagaggccatgtgagaatacaataaaaagtcagcagtctgtaatccaaaagatagcccccaccagaacctaaccgggctggcatgctgatctcagactttcagcctccagaattgcgagaaatttctgttgtttataagccacccagtctatggtcttttgttatagcagcccaaactgacttagacagatggtaaactcctttggaatttgcaatctgtattcttgatttaaaacaaggtttgctcagggaaggctgatagatggagacccaaaggcttaagaaaggaaaactgctacagaactgggtgaaaaagtgagacaaaatattataactttttttttaaaaaagactctttttcattgatacatcattcattccttcatttactcatcagtttattcagagtttgggtctattaaataattcttgacacaaggaaatgtcagaagaaagtgtgttgagctgatgacaacaatgtttaagttggctagatttcttatttatcacctaaaatttctttcctgtttgtttataaatgatataatggaagataattgcactttgtccttctgctctgaagtagatagaagagtgttaccttcactttaagtacagatatgctaaaacttctaaaaatttggaaaatctagagaaagaacagaccaaggaaatgaaaaatagaggataatagttgagtttcttctctctacttttttcagaattcatctctcacttttttccctctcatttctatctctcatttcctcttcccttcccttgatcaaaattaacatttactgagcactttttatttgctaagcgttttacatctatgagatacacttttcttcattctacatttaaagaacctaagatacacagaagtatgacaatggacaactgaagagaatgtgaataaacaatggccttctgaggattacagaagaaattcttgtctatatgtagagagattatatcctatgaatttcagaaaccatatgtatgtattaaatgttcccctattgatattaaatattatatatttacataatattttattcctataacatttattgagcacttatcatgggccaggcactatttcaagtattttatagatattatcttattcaatctactcaaaaaccctataagatagatatctttattcccatatgagagatgagaaaaaatgagacataaggtgtttatgtcaccaatgggaggatacttagctaataagtaggaagtcaggaattaaatcagcaagtctaattccagagaccaccattcaaaggcccgtctccctagtgtgagtttgaagtgcaaaaaacatccaatagcactccaaggaaagtcctctaattatgagatttgctctagtatatttacaaccaccttcctatatgccccatccaattccaaaacacataggcccacattctagagattcacaaaaccttatatttaggtatgccaacagaaaggagtaagacaaatgtaaaaggctgtttttattctgtaggccactatctatctggctaatgaaaaccaccatcccttttccattcctttcctagtcaaattaagttaactaacctcgataaaaagtcaatctgttatagaacataagtgaaatcctatttcgaatggattgtcacagagggtgttaaagcaacatgtagagatctagctaacacattttagctatgcagagaaagacacaaaagaattccactcaatgtctaagttctgctatactagaacagcagtaaacaaaataaacaagtaagacttcagcataatctttatatggcataaacgtattctgagccaaccacaccctagaatcactgagacaaccacagaaactcaaaagaaactcaaaacaaatatcatgacttaattcactctgcatttaaagatagatttttttaaaaagttggctcactcagatctgcagattggatggagtaatagagatacagttatatcaacagccccttgagaaaacaggaacagaaaattaggaagcctgccctaatctcacttaaaatacacattctgagtcagttagacttcattcagaattccggcactgctccagcactgctactatagtttctctgttttttcattagtaaaatagaataacagcactcattttgtggataaaatagaacaatgcgtagaaatatatttaaaagtggaagtaactgtaataactcttagtattggtgacattaagttaattaacatatgtaaaactgaataattatactactagaagttgtagttaatagtaatatagtttggcaaataataagggctgtaagtaaatgacagctcttattactagagctcacataaataatataattgcctttccaaatgtttgctgaacaatttgaagatatttacaaattttcaagacaaatgtcttccagcaagtcagctatgctcctctgaatgtccacagtattttcacaattaaaatgcaaaattattttagctgtttctcatagttaacacaaattttgcctgttttttttttctggaaacaaatagaatagaaaggaagaactgactacaatatacattttctaacctttaaaattggttttagactgttctaaaaagtatattaccctcagagataatatatacaccaccagtactagtttatggagcagttttgagtgaactcgtcagtaatgacacatggccaatttttcacttgtgaagtatcaggtttcctccattggaatccacgtttctgccaaagcagtaacctacaatttttttctccccagggactaatcccactcacccttctcatctttttctcccataaatgctcaaatgcttttcagtacatgtttgatttgcaggaaactgatattacatgtgttagagatacatatatcacttcgcttgccatgtctagtaattagcaatcttgaaaagttgtgcttcagggactgaacagagtgtactgtctaacttaacatgaatgaaagggaaaattggctttgtttcttcatttatagctttccctcaggtaccaaccatcacatttcttcctggatctccctttagggtttcctgagtctctgtgctgattctttaataacggtatccatcaccttagtcagtttctaatatcttacccttttcactgttatattcatattatattttcaatatagtacacaccataagacatatgactttatttttttctgtgacataatgatatattattttctgatgagagaaaagcaataacatgatcaaaaactaaatagttccaaaactattttgacttttaaatattgtgtatgtgtattatggacaatgatatatgtaccattctaatttggactgttattgaaatttatttgcatttcctcaggaaaaggtcagggaacaaacagctatggattaggctttagtgaactggtaagttcctgacattgtacaaaaaaaattaagtctctctctctgtgtgtgtgtgtgtgtgtgtgtttgtatgtgtatggatatgtatattttctgggaaaggattcatagtatttatgagactctcaaaggggtctgtgaactacagaagtttaagagctactagtctgaaacatatggggcaaaagtaaaaaatgattaacagtgaaatattatgttatagttttttaaataaaaagatctacagctaatcaattaaaaggttgtcctgcactaaacagagtaaaaaatcactgagaagaaaaattgaaaaaatgggggaaaataatctctcaaaggagttctctaacatgtgtctttttcacacatgatacaagtcttataaaggaagtacctacttgttcacctggaagtcctgggagtccaggatgtcctttgagaccctgtaaaagaataagtggagacatgctatgaaaagtaaactcatataagccaaataacgaaacataggttgcaagttgccttatatcccaacttttggttgcctcatcaatacaaatttaattgttactaatttatttcttattaaatttaatcttctttatttaataagaattacttttttattaaataaaaaattaattcttattaataatttaatcttgcatgttattttaatgacttgttattatcaactaaaatggtagcatagtactgaatagagactaaagcacagtatcttttataaaaggctcatatctagcaatggatatgttaagtttgctgaagcttttaaaaagttagttttagttgaatagtgctaagacaaatggcctcagacataatctgtttgtaattattgaaaaactggatcatatccaggcagttcctctaacccaaatcattgtcataacaccccatgaatgaggtaactcaaaaaatcatgaggctgcttacaggttcatcaaaaggggttctataaagttgtctagggaattagtaacaaagaatattttccaaataatagaagcaaaagaaaatcttaatctctataaattaacacccaaagctataaaacagacaatatccttcttcctcaagaaagatataggagcaaaatgaaggaaactaaaagaaaggatggcaagaatgaaataaagaaaaattttggagcttatttgtacagttctacataaaaatcagtggtttgatctactgtttaccaaaggattttggtgcatataaagaacaaaagaaattccttttcttaaggacttaaaatataattcaaaagcctgaaataaatcatagtttatgaatatcaaaaatttccaattaatatactgcaaactaaagacaaatttcctgggtttcagaatatagcctaatggagtgaaagaattactcagtattaatcactgagggtttatcagaagagatgaattcggattaatggattagagaagggaatgacgctttggttgaaaaacgtcatttagaagaggtgcctatttgaaaactaaaggaatgatttcaacagcttttgcgatgttaaacttaaaacagtttaactgtttttacatttttaaagggagttcaagattagcctaattacataacatattacatattgtgctcagttgcccaaatgtttacacaaaattccacaagtaaaaatatccacaaagctaagttttttcactttttacaacaggagataagaaacatcctcagcgctaagacagtggtggtggctccctgggatgaggcagcagctctaggagggtgtgagctggaagtttcctggaggatgacaaataaagagccagggtaggaggctcataggttacagagactctgccatgagcctatttccttttcctatttttttaaagtgtgtgtttatttatttacttattttaaattctgtgaatccttgagcctagctacatgcttgattttctttggccaacacctgtttttcagatcagagttagtttcctccctagcctataatgaaacaaaatgcaatcgtggcacaattttattttagcttattttccccaaatcactccataatagtgaactatgtgtatatatgttaatcatggtatcttttttatgcacacttctctttaaagggattcttcttcattcagagaccctgacaaggtggcagcaccatgcagtcatgatctgttttttatgaacttactccttccccacctcagccccaggacttgacagttaatctaagggaggacaatataagtcaggccagtagcctataaaatgacttggaataaagagttttatttaaataaaaacaagctgggccaggcaaatggcattcctgtagtccagctactcaagatgctgaggtgggagggttgcttgagcccaggagctaaagtccagtctgagcaatatagcaacctctaaaaaaaaaaaaaaaaaagagagagacaagctgggccaataaaaatctcttttttaaaaaaatgaagttgattaaaacaacaacaatagaaaaatgcaagtacttaacagtgggggtaggagggagctggaaagattcacaaagaaagactaagaggaagagtagggtcgctgagatgctacaggaagccaaagtatacacaaaaattaaaattgaaattatgttaagacagttgtcagaggacaagataacacaaaaaagcagatgcagagaaagtagataagcactggtagaaaagtacaacaaaagattcacaaactaatgctgctaagataagctgctttgaatcagtgtgtatgtcagaccaagtcatattacagtacctagttttagattccatgggatccctgtttccttattgctgcagacaggattgaaataactcactcttttccttgaaatatcctaagtctcctttttttttttttttttttttttttgaggcagagtctcgctctatccctcaggctggagtgcagtggcacgatctcggctcactgcaagctccgcctcccgggttcgcgccattctcctgcctcagcctccggagtagctgggacttcaggcgcccgccaccatgcccggctattttttttttcctgtatttttagtagagatggggtttcactgtgttagccaggacggtctcgatctcctgacctcgtgatctgcccgcctcggcctcccaaagtgctgggattacaggcgtgagccactgcgccctgctaaaatatcctaagtcccctttctacgcaatccgaagagcctaagtaaagcaatttttgtttgtttgctttactgataataacaatgaacagatcaagccatcttgatctgttctagatccagttttaccacaaactagccatattgtgaacctcaatgtcttattttgtaaaatgacagcattcaattaaattattgctaattttttattgcttaaatcctgtgaatactggaatctatcagaaagtaactacttttttcaatgtagctgtcactgaataaaaaacaaagcagatatgagttacttcaggaaggccgggcgcaatggctcacgcctgtaatcccagcactttgggaggcagaggcaggtggatcatctgaggtcagtagttccagaccagcctggccaacatgatgaaacccgtctctattaaaaatacaaaaaaattagccaggtgtggtggcgttttcctgtaatcccagctacttgggaggctgagacaggagaattgcttgaacccaggaggcagaggttgcagtgagccgagattgcgccactgcactctagcctgggtgacagagcaagactccatctcaaaaaagaagaaaaaaaaaaaaagagttacttcaggcttggagacataggaaggaagaattcacgtaaggtcagtggacatatcaggctcccacggggcacttctttaatgctctaaaacaaagatgggactctggagtgggcaaaatggaagagagtgggttgggtaggaggctagtatgacagtctaggtcaaagataattataagttagcctaggatagtagagtaaaaatgatacctaagcccttgaaaaagcttaagcttaatttaagttactgtactcactgtggtgtccccagtgcctggtacatagttgttgcttattaattaactggtggacagacatggatggatgaatgaatgaatggatgagtgaatgaaaagacttggatgaatttaagaatcacttaggtagaaaatagattctatgtatttaatatggtaactctattatccgaatgttgaaatgaaaggtgataaatagaataaagacttcctttttgttattttaaaatatatatttgtaatatactgaagttatctccactattatataaagactttcatttattcccatatgcctcatttattttctacttaaaaactagtctgtaaagtttttaaaagcaaaggggatacattccttggaaaactgcctacatgcaagctttggcatagctccaatctagggattttattttaaaaactagtatttgagtcattattttctatactcatacaggaagaataacaaaaaagtttccataactagcatatgatttttctctgattagcattctgaaaactgaatacattccttaaggaatgacaataggaaaatttacaaattgtttcaattcagatttaaaacacattacaatgaattacagaattgtctttaatttttgttgtaatataaaatcagtttacaaaggagggcagagcaagatggcaaaatagaagcttacgctattcgtcccctctccaacactggaacatcaaattttaacaactatccacacacagaaaaccacagtcacaagaagcaaaaatcaggtgagcaagagcaatcacagtacctggttttaacttcatattgtggaaagaggcactgaggaggacaagagatacagtcttaaatagtgaatgccacccctcccccatctcccctggcagcagccctgcagtgtggagagagaatctgtgcactctaggaagggaaagcccagtgactgggaaactttacattgaactcagtgcttccctggcacagcgggaggatttggaccagccctagccagaagggaatcgcacatcctcaaggaacttgagtttcttggcaagccttaccaccatgggctgaagtactctggggtcctaggtaaacttcaaaggctgtctaggacacgacaactgcaaatcctaggctattcctagtgctaggctgggcttacagccagtgaactagggtggaatgtgaactaaggagacaacagctggcatggctaatggagtgtgagcaccattccttccctaagcccaggcagtgcagctcataacaaggaaagtgactcttcccttctgcataaggagagaagagtgaagagtaaagaggactttgtttggcatcttggataccagctcagccacagtgtaatagagcaccaagcagagacgtgaggcccccatttgaggccctagctctgggataacatttctagatgcactctgggtcaaaagggaacttcctgctttgaagggaagggtctagtactggcaggattcatcacctgttgaccaaagagcccttgggccctgaataaccaccaatgatacccagtgagtgtgctgtgggccttgggctctgaaacatgctggccttcaggggtggtccagtacattccagctgtggtggtcacagtgaaagactccttttgtttgagaaaagcaaagggaaaaagagacgggattttgtcttgcaccctatgtaccagcttggccacagtagggtagggcaattagcaggctcttggggtccttgagaccaggactaggatcttacacagcatttctggaccgtccctactgtgctgaaggatgagtcacagtcctggcagcattcaacacaagctgatggaagagagcccttggcctttaagtaaacattggtgaaagcctagcagaaacccccatggactagtggtggtggccacagggaaggactcatctgcctggggaaattgctggaaagagtaggaaggactctgtattatggtttgaatgggagtttagccatagtagagtagaacagcaggtaagttgctaatgtctttgacttcaatcactggctcccacacagcatccttggacacaccctgggcctggggaaaactcatcactatgaagggaagggctttgggtgaggcccagtagctcatgtctgacccagcacagttccagtggtgacggccacagggtgcctgtatctccacacccacagttccagctggcccagcaaagagagagagagagaggagagactccatttgtttagaagaaattaagagaaaagaacaagaatctctgcttggtaatccagagaattctttcagattttatgtaagaccaccaaggcagtacctctacaaaaaccacagcgatattgggcttggggcccaagtcccttcaaacacttggaaagccttcccaagaaggacaggcacaaacaagcccagactatgaagactacaacaaatacctaactcttcaatgcccaaacaccaatgaacatctacaagtaacaacaccaccacaaaaacatgatctcaccaaatgaactaaataaggcacggggccaattcttgagaaacagagaaatatgacctttcaaacagagaattcaaaatagctgttttgaggaaacccaaagaaattcaagataacacaaagaaggaattcagaatgctgtcagaaaaatttaacaaagagatagaaataattaaaaagactcaagcagaaattccacagttgaaaaatacaactgaatgctgaagaatgtatcagagtcctttaaaagcagaattgatcaagcaaatgaaagacttagtgagcttgaagacaggctatttgacaaaacacagtcagaggagacaaaagaaaacagaataaaaaacaatgaagcacacctacaagatggaaaacagcctcaaaagggaaaatctgagagttattggccttaaagaggaagtagagaaagagataggggtagaaagtttattgaaagggataatatcagagaactccccaaacctagagaaagatatcaagattcaagtacaagaaggttatagatcaccaagcagatttaacctaaaaagactacctcaaggtatttaataatcaaaccctcaaatgtcaaagattaaaacatgatcctaaaagcagtgaaagaaaagaaacaaataacatactatggagcggaaatacatctggcagcagacttcacagtggaaaccatacaggccaggagagagtggcatgacatatttaaagtgctgaaggaaaaaaacttttaccctagaatggtatatccagcaaaaataggctttaagcatgaaggagaaatagactttcctagacaaacaaaagttaatggattccatcaacaccagacctgtcctacaaaaaatgctaaagggagtcattcaatcagaaaaaaaaaagaatgttactgagcaagaagaaaccatctgaaggtacaaaactcactggaaatagtaggtacacagaaaaacacaggctaatatagcactgtaatggtggtgtgtaaacttctcttgaattaagtggaaagattaaatgaaaaaccaataaaaaataataactacaactttacaagacatagacagtataaaaagacaaagaaaaacaacaaaaagtttaaaaatggggaaatgaagttaaggcatagagtttttatcagttttctttttacatgttttttggtttatgcaatcagcattaagctgtcatcagtttaaaataatgggatataagatagtatttgcaagcctcatggtaacctcaaaccaaaaaaacatacaacagatacataacaaataaaaagcaagaaatcaaagcatactactagataaaaatcaccttcactaaatgaaaaactggaatggaggaaagaaggaagagaagaccacaaaacaaccagaaaacaaataacaaaatggcaggaataagtctctatttatcaataataacattgaatgtaaatggactaacctctccaatcaaaagacatagagtggctgaatgaatgaaaaaacaagttccaatgatctttgcctataagaaacacacttcacctatatacacatagactgaaaataaagggataaaaaaagatattccatgccaatggaaacgaaaaaagagcaagaatagctatacttatatcagacaaaacagatttccaaacaaaaactataagatgagacaaaggtcattatattataacaaaggggtcaattcagtgagaggatacaatgattgtaaatatatatgcactaaagcacccagataaataaagaaaacattactggagctaaagagagagatagaccctactacaataattgctggagacttcaatacctccactttcagcaagactgggactggttagtcagtgggtgcagcccatggagggcaagcagaagcagggtggggtgttgcctcacccaggaagagcaaagggtcagggaactccctcccctagccaagggaagccatgagggactatgccttgtgggacagagctatccagccaagatactatgcttttcccacggtctgtgaaacctgcagaccaggagattccctcggacgcctacaccaccaagggcctgggtttcaagcacaaaactgggcggccatttggggagacaacgagctagctgcaggaatttttttcataccccagtggcacctggaacgccagtgagacagaactgttcactcccctggaaaggaggctgaagccagggagccaagtggtctagttcagtggattccacccccacagagcccatgaagctaaaatccactggcttgaaattcttgctgccagcacagcagtctgatatcgacctgggatgcttgagcttggtggggagaggggtgtccaccattactgaggcttgagtaggtggttttcccctcacagtgtaaacaaagctgccaggatgttaaaactgggtgaaagctgctattgccagactgcctctttagattcctcctctctgcgcagggcatctctgaaagaaaggcagcagccccagtcagggacttatagataaaactccctgggtcagagcacctgggggaaggggtggctgtgggtgcagcttcagcagacttaaacattcctgcctcctggctcagaagagagcaacggatctcccagcacagcactcgagctctactaagggatagactgcctcctcaagtgggtccctgacccccgtgcctcgtgattgggagacacctcccagcaggggtcgacagacacctcatacaggatagctccagctggcatctagtgggtgcccctctgggacaaagcttccagaggaaggagcaggcagcaatctttgctgttctgcagccttcactggtgatacccaggcaaacagggtctggagtggacctccagcaaacccgcagcagagggatctgactgttagaaggaaaactaacaaacagaaagaaatagcatcaaaaccaacaaaaaggatgtccacacaaaaactccatctgaaggtcaccaacatcaaagaccaaaggtagataaatccacaaagatcaggaaaaaccagtgcaaaagggcagaaaattccgaaaaccagaacgcctcttctccagaggatcacaactcctcgccagcaagtgaacaaaactggatggagaatgagtttgacaaactgacagaaggaggcttcagaaggtgggtaataacaaactcctccaagctaaaggagcatgttctaacctaatgcaaggaagctaagaaccttgaaaaaaggttagaggaattgctaactggattaaccagtttagagaagaacataaatgacctgatggagctgaaaaacacagcacaagaacttggtgaagcatagacagtatcaagaatcaaaccaatcaagcaaaagaggatatcagagattgaagatcagtttaatgaaataaagcgtgaagacaagattagagaaaaaagaatgaaaaggaatgaacaaagcctccaagaaatatgggactatgtgaaaagaccaaacctacgtttgattggtgtacctaaaagtgacagggaagatgcaaccaagttggaaaacacttttcaggacattatgcagaacttccccaacctagcaagacagaccaacattcaaattcaggaaatacagagaacaccacaatgatactccttgagaagagcaaccccaaggcacataattgtcagattcaccaaggttgaaataaaggaaaaaatgctaaggacagccagagagaaaggtcaggttactcacaaagggaaccccatcagactaacagcagatctctcagtggaaaccctacaagacagaagagagtgggggctaatattcagcatgcttaaagaaaagaattttcaacccagaatttcatatccaatcaaactaagcttcataaatgaaggataaataaaatcctttatagacaagcaaatggtgagagattttgtcaccaccaggcctgccttacaaggagggagcattaaatatggaaaggaaaaatcagtaccagccactgcaaaaacataccaaattgtaaagaccattgacaccataaagaaactgcatcaattaatgggcaaaataaccagctagcatcataatgacaggatcaaattcacacataacaatattaaccttaaatgtaaatgggctaaatgccccaattaaaagacacagactggcaaattggataaagagtcaagacccatcggtgtgctgtattcaggagacaaatctcatgtgcaaagacacacataggctcaaaataaagggatagaggaatatttacctagcaaatgaaatcaaaaaaggaagggttgcaatcctagtctctggtaaaacagactaaaccaacaaagatcaaaaaagacaaagaagggcattgcataatggtaaagggatcaatgcaaaaaaagagctaacacttctaaatatacatgcacccaatacaggagtacccggattcataaagcaagttcttagagatctacaaagagacttagactcccacaccgtaatagtgggagactttaacaccccactgtcaatattagacagatcaatgagacagaaaattaataaggatatttaggacttgaactcagctctggaccaagcagacataatagacatctacagaactctgcaccccaaatcaacagaatctacattcttctcagcaccacatcacacttgttctaaaattgaccacataattggaagtaaaacactcctcagcaaatgcaaaagaacagaaatcataacaaacagtctctcagactacatggaaactgaacaacctgctcctgaatgactactgggtaaataacaaaattaaggcagaaataaataagttctttgaaaccaatgagaacaaagacacaatgtaacagaatctctggagcacagttaagcagtgtttagagggaaatttatagcactaaatgctatagggaaagatctaaaatcaacaccctaacctcacaattaaaagaactagagatgcaagaccaaacaaagtcaaaagctagcagaagacaagaaataactaagatcagagaagaactgaaggagatagagacacgaaaaactcttcaaaaaatcaatgaatctaggagctggtttctaaaaaaagatcaacaaaatagatagaccactagccagactaacaaagaagaaaagagagaagaatcaaatagacacaataaaaaatggtaaatgggatatcatcaccgatcccacagaaatacaaactaccatcagagaatactataaacacctctacacaaataaactagaaaatctagaagaaattgataaattcctggacacatacaccctcccaagactaaactaggaagaagtcaaatccctgaatagatcaataacgagttctgaaattgaggcagttattaatagcctaccaactaaaaaaaagcccaggaccagatgaattcatagccgaattgtaacagaggtacaaagaggagctggtaccattccttctgaaactattccaaacaatagaaaaagagggactcctccttaactcattttatgaggccagcatcatcctgataccaaaacctggcagagacacaagaataaaagaaaatttcaggccaatatccttgatgaatattgatgcaaaaatactcaaaaaaatacttgcaaactgaatccagcagcacatcaaaaagcttatccaccatgatcaagtcagcttcatccctaggatgcaagactggttcaacatacacaaatcaatcaacgtaatccatcacataaacagaaccaatgacaaaaaccacatgattatctcaatagaggcagaaaaagccttcaataaaattcaacagcccttcatgctaaaaactctcagtcaactagatattgatggaatgtatctcaaaataataagagctatttatgacaaacccacagccaatatcatactgaatgagtaaaagctggaagtattccctttgaaaaccggcacaaaacaaggatgccctctctcaccacttctattcaacatagtattagaagttctgaccagggaaatcaggcaagagaaagaaataaagcataatcaaataggaagagaggaagtcaaattgtctctgtttgcagatgacatgattgtatatttagaaaaccccatcacctcagccccaaatctccttaagctgataagcagcttcagcaaagtctcaggatacaaaatcactgtgcaaaaatcacaaactttcctatacaccaataatagacaaacagccaaatcatgagtgaactcccattcacaactgctacaaagagaataaaatacctaggaatacaacttacaagggatgtgaaggacctcttcaaggagaactacaaaccactgctcaaggaaataagagacaacacaaacaaatggaaaaacattccatgctcatggattggaagaatcaatatcatgaaaatggccatactgtcccaagtaatttatagattcaatgctatccccattcaagctatcattgactttcttcacagaattagaaaaaactactttaaatttcatatggaaacaaaaaagagccctatggcctagacaaccctaagccaaaagaacaaagctggaggcatcacgctacctgacttcaaactatactataaggctacagtaaccaaaacagaggcctcagaagtaacaccatacatctacaaccagctgatctttgacaaacctgacaaaaacaagcaatggggaaaagattccctatttaataaatggtgttgggaaaactggctagccatatgcagaaatctgaaaccagaccccttccttacaccttatacaaaaattaactcaagatggattacagacttaaatgttagacctgaaaccataaaagtcctagaagaaagcctaggcaataccattctggacataggcatgggcaaagacttcatgactaaaacaccaaaagcaatgccaacaaaagccaaaattgacaaatgggatctaattaaactaaagagctctgcacagcaaaagaaactatcatcagagtgaacaggcaacctacaggacaggagaaaatttttgcaatctatccatctgacaaagggctaatatccagaatctacaagaaacttaaacaaattcacaagaagaaaacagacaactccatcaaaatgtgggcaaaggctatgaacagagacttctcaaaggaagacatttatgcagccaacacacatatgaaaaaaagctcatatggtcattagagaaatgcaaatcaaaaccacaatgagataccatctcatgccagttagaatggtgatcattaaaaagccaggaaacaacagatgctggagaggatgtggagaaacaggaaagcttttacactgttggttggagtataaattagttcaactactgtgaaagatagtgtggcaattcctcaaggatctagaaccagaaatatcatttgacccagcaatctcattactgggtatatatccaaaagattataaatcagtctactataaagacacatgcacgcatatgtttattgcagcactattcacaatagcaaagacttggaaccaacgcaaatgcccatcaatgatagaatggataaagaaaatgtggcacatatacaccatggaatagtatgcagccataaaaaaagatgagtccatgttctttgcagggacatggatgaagctggaaaccatcattcttagcaaactaacccaggaacagaaaacaaaacactgcacgttctcactcaaaagtgggagctgaacaatgagaacacatggacacagggaggggaacatcacacaccagggcctgtgggggttggggggctggggagggctagcattaggagaaatacctaatgcagatgacaggttgatgggtgcaaaccactatggcacgtgtatacctatgtaacaaacctgcacattctgcacatgtatcacagaacttaaagtataattttaaaaaaattaaaaaaagaaaactgcaggccaatatctctgataaatattgatacaaaaatcctcaacaaaatactcacaaactgaattcaacaatacattaaaaagatgactcattatgaccaagtgggatttatctcagggatgcaaggatgattcaacacacacaaatcaatcactgtgatatatcatatcaacagaatgaaggtcaaaaaccatattatcatttcaattaatgctgaaaaggcatttgataaagttcaacaccccttcttggtaaaaaaaataccctcaaaaactggatataaacggaatataccttttcataataaaagccatatatgatagacccacagctagtatcattctgaatgggaaaatactgaaagcttttcctattagatctggaacacgacaaggatgcccactttctccactgttattcaacatagtactgaaaatcttaactagagcaatcagacaacagaaaaaaaataaagggcatccaaattggaaaggaagaagctaaattatccttgtttgcagatgatatgaagttatagctggtaaaacctaaagattccaccaacaaaacaaaacctattagaactggtaaacaaattcagttaagttgtagtatacaaaatcaacatacaaaaatcagtaggatttcaatatgccaataatgaacaattggaaaaagaaatttaaaaagcaatcccatttacaatagccacacataaaataaactaggaattaaccaaataagtaaaagatctctataataaaaactataaaacactgatgaaagaaattgaagaggacaccaaaaaatggaaaggtattccatgttcatgaattggaagaatcaatatttttaagatgtccgtactgcccaaagtaatctacagattcaatacaatctgtatcaaaataccagtaatattcttcatagaaatagaaaaaagcaatcctaaaatttatgtggaaccacaaaaacccagaatagccaaagctatcctaagcaaagagaacaaaactagaggaatcacattacctgatttcaaattatactgcagagctacagtaaccaaaacagcatggtaccagcataaaaacagacacacagacaaaagtaacagaatagagaacccagaaataaatccacacacctacagtgaactcattttcgacaaagttgccaagaacagacattgaggaaaagacactcttcaataaattgtgctggggaaactggatatccatatgtagaataatgaaacttgatccctatctcttgccttgtacaaaaatcaattcaaaatagattaaagacttaaatctaaaacctcaaactatgaaactactacaagaaaatattggggaacctctccaggacattggtctgggcaaagatttcttcagtaatacctcacaagcacagccagccaaagcaaaaatgaacaaatgggattgcatcaagttaaaaagtttctacacagcaaaggaaacaatcaataaagtgaagaaacaacccagaaaataggagaaaatatttgcaaactacctatctcatgagagatgaataactagaatgtagaaggtgctcaaacaactaatcaagtaatccaattaaaaatgggcgaaagatttgaacagatatttttcaaaatgagacaaggaaatggtaaacaggcatataaaaaagtgctcaacattattgatcatcaaagaaatgcaaatccaaactacaatcttaccccagttaaaacggcttatatccaaaagaatgctggcgaggatgtggaaaaaggagaatcctcatacactattcatgggaaggtaaattagtacaaccattatggaaaacagtttggaggttcctcaaaaaagtaaaaataaaactaccactggatttagcaatcccactactgggtatatacccagaagaaaagaaatcagtgtatcaaagaggtatctgcactcccatgtttgttgcagcactgttcacaatagccaagatttggaagtgacctaagtgtccatcaacagatgaatggataaagaaaatgtggtacatatacacaatggagtactattcagccatacaaaaaataatgagattctgtcatttgcaacagcatggatggaactggaggccattaggttaagtgaaataagccaggcacagaaagacaaacatcacatgttctcacttatctgtgggatctaaatatcacaaaattgaattcatggagacaggcaatggaaggatggttatttgaggctgggaggggaataggagatcaggcggaggtagggaagggagcatagttaatgagtacaaaagaatagttacaaagaatgaataaaacctagtatttgctagcacaacagggaaactatagtaaataataatttaattgtataatttaaaataaatagagtatcattggattgtttgtaacacacaggataaatgtttgtgaggatggatatccaattttccatgatgtgatcagtatgcattgcagcctgtaccaaaatatgtcatgcaccccatgaatatatacacttactatgtacctacaaaattaaaataataaataaataaattgcctcagcaagaattccaataataaatgaagcctataatctaattttatatagacttcaattttaataaatatgttaacaaaaatttgagccctaaaaatatgttatcaatacgttaccacacaggacaaataaaaagacacaattgaatcaaaatcagaaatattagtggttacaaaataaatcagtttcaaactactcccagtaattaagatttgaatatataaataaaatgtttaatcataaggaaaacagtagtatcatttatacacagatcctcctcactttgcactatagtataggaccataaaaataactgtgcaagctgaaattgtacaatgcaatcttaataaccaatgggaaaatttacaattgttccatgacctttaaatatttttgttaaagtgttaaaaactctcttactgttggttatagttgcacggggaaataaaaaaattatagtagtattaatttagcacagtataattgaaaacattagaaattaaagcatcatttatttgaaaaaaattatcaaaattagtttgaaagtgtttgccttcttgttgttgtctaaattatcacactaagcaagcatatttcctatgccttggcaaattgtcatactcgcttctaagtatggatcaattcccaacattttatcctttgcactttcaatgtcatgaaatatttccaagaattcttctaatgtgaagttttttttttttgaaagtgtcacttcctctggaacatccttgtcctattcatcactactactttactcatttatgtctaaaagttcacctgcaataaatttccctggctgcatatgtagaatcttaaatgtcagcagtgtctcatgtccagctatttgttttaaaattcctatgttatcactactcctttatttgctgttctttcatctttgttagctaatacttcttttgattattcatctgtgtaaaatatcacataggtttatcactgcaaaacaaggaagcaacgcaactttactgtctgtacatgattgaagaatcaccaacagactgaatgaaatgacttgtctggtaattggtcacgatgcactccattacttatgtagtgatttgtggactaaagggccagtagcaaagtctgtactttatgtagttaatcatacttaatatactgtggcaaatgaaatatgaattgtgttgttcgggaactgacgctatgtaattaaattgtggtaaccaaaatatatgtatattggaaccagacaaagtaaggactgcctgcatatttatataatgttgagaattattctcaatgcccttatgttattaagtttatatatcaatggtttgctccttttaaaagtttcctcttctcccattaaatgggaagaacttatattcatggggataaagacttttccaacatatgagaaactattctacatagcacaaggcagcttctgtataatcacccccactctctatcataagcctcctttcacaaacttttaggtttcagaaatgtagaagcatatctctcgaactcataaaaatgctaaagaaattctggagactaaaggatttgcctctggcactccccttcttacaatcctgtagtacctctctactacataataatatactctacatgctttaacatggcctataaatccctttataatttagtccttcaatactcctcaagctttatctcttgacacctcctccctcacacttcatgattcatgaacaaagaagtgcttcttacctctcagcctttgcttatgcattatctatgtgtagatagcatacttgtccactaggtgcagtatcattaggataacttctgctcatcctcaagaatcatcttagatgtcacctctttccctgattcctgtatccatccacctttcacctccaggaagtttatgtgaacctccactatgtactataataatcctttcatatcttcataatcacacttgccatagcataatttatttacgtaatatataaatataataatttgtatatatttatataaatatataacatatatttatatatactgtaataatttatatatttacataatacataaatacaatttacatatttatataatatataataattaatttattataatactttaatgatttacttttgtataggttacatatcccttgcctgaaatgcttgggaccagagtgttttggattttgaaatttttcagattttggaacatttgcattataccacttgagactcccaaatctgaaaatctgaaatcttaaatgctcccagtgagcatttcctttgagcatcatgtggacgctcaaaataattcggattttggagcacttcggatttcaaatttttagatttaggatgctcagtctgaattttaaagacagtaaactggccgggcacggtggctcacgcctgtaatcccagcactttgggaggccgaggcgggcgaatcatgaggtcaggaaatcgagaccattctggctaacacggtgaaaccccgtctctattaaaaatacaaaaaaattagccaggggtggtggcgggcgcctgtagtcccagctactcgggaggctgaggcaggaaaatggcgtgaactcagaaggcggagcttgcagtgagccgagattgcaccactgcactccagcctgggcgacagagcgaggctccgtctcaaaaaaatatatatatataaataaataacctacttgaaggcaggaactatatatatcatatatatagttgatatatatatatatcaactctgtatcatatatgtatatcatttacataatagtggtttgctgaacaaatttcaggacaaaaagatgtgactaaaacaactgcagaattttagggttagttacagaatttatctgaggaagaaaactgcccttttgtttgaggcaactttcctggatcttttgcctctgtctagtcttgggaagctgaggcaaaggtggactaacaatcgcgcataatcatgtaaaaggcaacatcactgagtgatgagtaacaggttaactagttctacttagctaacctgaaataaaatgataggtggttggagccagaggatcagtgaaaataagacagcagagaggaggtggtgctttgagaagcaagccaaggtgaaggggcacagtaaactgaatttaagagcaacattttcattcattcactcataatatgtgcttgttacatgccagacactgaactgcaataccacagtgaatgaaatgtagtccttacattatacttaagcaacttataccatatttcctaaatccatatattttcccttagccactgttactgcattgttgtctaaaagccaacattaaattttctttctctgcagtgtaatatccttattctacaaattaggtaactacaactctctcgtaaagtttgtcaaatattacaggactcatgtcaccaatgcattgaggaatacaacaaaggcctataaccatggtttgaccaaaataaccagagaaaactatggcaaaattgagaaatagtgataaaataggatggtatagttatcaaaaaaagaatccctaagcaagaattgagaacaagatgaaaatcaacaaccaaaataatgtaagcacttcttggggtaagttcataaacttcctaatgttctaagaatagagattttaattatttttctaaaaaacattaaataaaagaataatcccagatagctggagaactttgggagacttaaattataggatgaatacaacacaaacctctctattctgtccaccttctcacttagaacatacttccctcaggcatacaacagactcatgccaatgttagtcccaaatttctcacaatattgacttgctaatctctttaagtagtacttggctttttccttggtcccatcgatccctagtatctctcaactagctctcacacagaaaaacagtatgatagatgaattcttgaaatgatgctaaatcacagataacagcttattctaagaacacagaaatattttaaaagacttctggaaactgaaatatttttagccaaatgaatttgtcattaatgttggaatttcaatcatatgagccagactgagggaaatatctttggacacagggaagttttcaaagtccccaaaactacgccactttggcaaccactggcttgcctgttggggagttcagcactgtgataccttgttctcagcttcccctaccattagtgggaatggcagattgcagagatggtaacagtggtggcagcacaacccccaagcagcggcatttgtattagactcagtactgcacttgaattgggaagcaactcaaagtaaaacacacctctgcagatttttataggaataataagccagtgagagatgatctatagagctggctatagaacagtagaattctccattatctttcttcaggcactgatttttatgccaactctgatttttttgtcattgtgcttatctatattcagtattaatatagctccttagtactatccttgctttaaaaagtttatgaagaactgcatacttttggggtgactgataagtcacagtgcattccacttgatgcttttggttgtttattcctgtccaactttatacagatacttactgtgtacctcctatgcaatgaaaagattcttttaaaaaataattgaacaaattctctcaaaataaaataaaaattcacactgatttataattctcactaaactgagaggatttttcaatattcaggaaaatattgccatatattatttataaaaatttgttttaaaatgtgtgcatcatatttcacaactgctctgagttgtggtaagaggtgcttaactacttcaatatggcttatcttcttgaacttagaaaaactgtttcaattagattgctaatgttcttacaattataaataaaaggcttcccattctaatatagcaactgattggctatatcaaataatttaaaaatccatcttgattccaaacgcagaattaggactcttgtcttccattcaaccaagcatgcactctggatcaaacttacctgttttttggcaaaaattcagacactcagtaagaactaaaaatatacttcagttcctagtaaaataagagttacatgaaggtagctaagttaaggcaaaataaccagtcaatctagggaaaacatattgcttgttaaaaatgttaatactggtttcaaaaaatgggaatggatggataaaaggggaaaaagaaagaagcaaaccaaaaaatctatgaaagactgaagagaatactgctgctaatttgcttgccttctctatctcaatttcactttcagttttcaagactttttttttacattaatcttctctttatttacctcaacagtttttatgagttgttagtgtatttcacataactttcttgcagacattttagctttaaggattacttgagtttggtttatattagacaaattttaatatttacaggtactttccagagaaaaagaaaaatgaagtcactgttatctgtcatccaaaactatatttgtttccttggctttcatgaaaaccagtattttacttcctcttgcaacatgctagaggtacacagatatacttaaataccactgtctaacaaatatcgaattaacgtgcttctggccagagtaacagacccatagccccaaacccagctccaagttggctgacctaccatgtgcatgcacatgtccctgacctgagaaacagcgtggcaagcccacccctgacaaagcctcaccaccaccaccagaaactctctcagcctaggctactgagacactcataaatgtcaccagcatggattacacctgaagaaactacatggagactacattactgtgttcacctagaaccaaagccaatatatcccaccaaaacaacaccccaagacttattcatatgaataagtctttccctaggaaacctactccataaaattagaagaggtaatttttccaccagatgtgtagaaatcattgtaggaacacatcaaacatgaaaaagcaaggaaacatcaaacctccaaaggaacagaataattcaccagtaacaggcatcaatcataaggaaatattgtatattcatattaaagtaagacataccataaggagtatgacacaaacttgtcccaagcctgcgaagtggagaattagtttaggcttaaatggagccattatatccttttcctagttatacttgtttttcaaaaatctgtatatagtttccattaatagagacactctgaaaagggggaaaatattccaagaaatattacaaaataatctcaaatatttcaacgctattctgaactactgtcaaatcacagtgaaccagggattcttcctttatcagaaagtaagtcactttctaaatactttcaactaaaccttatctcaagaagatcctgcaatagctcttaattgataatacgccaagatccctgacttctatcaggtctatttctatcagctaatactaaaagccagattgaaagctttttaaaaaatcttataagagaaacaagaaatctgtgaaagatattcaattcatggcccagtatgtttaaaataatgctgttatatgactttactagaaaaaaataattcaaaataatgttacatagaccaaaaagaatatattcttactattttaaaatactgatgggccatataacatgtacacgggtctctgaaagttagtaattctgctttaaacaagtacaacttcaaagttaaaatgataatctgctctaatggttaaaatcaaagtattttttgtctatgaataatatttactcccagagactgcatgtcatatactcttctatacaaaaactactcaacatttacttaatgtgtccttttctggagtgctaatttcatgaaccacagatatcatttaactacagaaagtaatgagtagtttattcttctgtcatgtacagtgtcactgcataggatgcaataactgtatatttaatatcaactaaagtaattgagatcatatccatattatgaggtcttctttgatgatatatgtcagtacaatctcctaagagatatgagtagtcagatgtatactcagtagcataaaataaacaggttcatgactgtatatcaagatcaattctgtcagaaaagatcactgcagtttcatgtctccttgcgggggcaaccaacaatctcaagggaattaccagattctaactaaggtctaggatgaagactagtctgaaggacattaaaataatggtgtggtcactcaaggtaaaatactctcatgagtaccttttcattattttacaattcagcactatagcaggggttatgaaggaaagcaaaagaggccagcattatttccaaaaccagataaatagctgacggtttacatttattaagggctgacaatttatgtgacacggtgttgcaaggattatctcattctgtcttctcccaaactccctatgaagtggatagtattatcttcacaatttacaaatgaggtaactgaagcttagaagttaagcaacctgcccaaagttgatggaacctacaaaatggcagttggggtttgaacgaagcaaccagggcctgaataccacttgcaacctaagtctcccaataggaaaggaatatggaacactaagacaacaacacagctcattattatatgtatttagatatccatatcaagtcaaatactgccctacaatattttggtgcttttaacaccttaagaagaaattttttattttcctcattccctgtagaaaatcaataacttagtgtttgggaaaaaacaagctgaccaggtagaaaagaagttatacttctgttaatccaggaaactaaaagatatattttataaaataaatattgcaactgtgtcagtactcctttctacctcacaaaaagcttagtcatatgaacatgactactgtttttcactagctgtccccaatcctcacgtcacttccatcctacccttcaagcctcacatctgtatatacctcaagacagagattattatttcccagtaaaatgagaaccccttaacaaatccatatgtattacctataagcaagtaaacctcactttgggcatataaaagtcataaagtgacttcaagatctcagaagtaggtcatttccctaatatagttttaaaaaggaaagcttcaatattctatcactgactttctcttgcatgtgaattctgtgcccattattaattgaagggtcttcttttatttttcataagattctgccttttgtgggcaccagtttccgggatgatgatggcatcctaattttcttttgctgagaaaaggaattttaaaacattagttttagggtcaacttcaaaatgagatcatagtcactgaagacctccaagatccatatatcatccaattatgtttcagaacaggtatccctgaagaaaaagacaaaaaaaagaaaaaaagaagaaaaaaagaaaagaagtaaaattccaacttaccttatcaccttgcataccaggggggcccattaatccagaaaggccttgatcaccctataaacaaaatacagacgtttaatgtcatgaaagagaactgaaaattagaattctcttgaaaattaaagctccttttaattttggacatcagctcttattacaatcatttccaatcttcacaatctttgagcctgtttctgaggcttcctgcctttccttatctcttccagggcttaataactgaactgtattttcccacctccatatccttgctccgttttctctgatgttcttttctgtaataatgcccttgctgtcaaacttcgcctcagtccaaggtctaccatgttttaaaaattgaaagtagggctgggcgcggtggcccaggcctgtaatcctagcactttgggaggccgagacaggtggactgcttgaggccaggagttcaaaaccagcctggccaacatggtgaaacccgtctctactaaaaatacaaaaaactagccgggcatggtgtcgggcacctgtaatcccacctactcaggaggctgaggccggaaaatcacttgaacccgggaggcagaggttgcagtgagccaagatctcgccactgcactccagcctcggcaacaagagtgaaactctgtctctgtctcagacaaaaagaaaaaaaattgaaagtagtttccctaaaaaatctacaagtgcattgtgaaacagctgttgaggtgtcacccctactccgtttctgtgagcacctgcagcctggtaggtctcccagagagaatctcacgggctgtggtgggaccagctaggttcacgtgacgcacaggaggcacttccgcttctggagctgagctggtgccttccatcctgcgtgccagctacacagaacgtccctcaccccggagtaacgagcgaaaattgattgggaagtccatcatgtgcttggctcgaacagactaggcgttaccgattagcgctaccttttttacatttattactctgatagaaggaagataaaactgcacaaggaaagaggaaactagaggctggtcctcttccactagctttagtcatgaaggaatcatttaatttctcctcagattcctcctctggaaaatgaggttgataatgatgatggtgatgatgattatgtcaatgtcatctcacctgtcttatgggaaaggaaaaacttacaccatttaaaaacgatctatgcatgctctttttaagctcccaaagggcttaaaaccttgtgtatgatctattacagatgttacttagtggatgttacatggtgaagtactaaatcctgcatttatttttctctttcaccattgaccatacatttattgttaaaaatggctaaatggttaaaatacaattgtttgcccacccccttctacttccaccaagttaatgtttatattttatttgtattcagatttatgtgtataaccagtttcctttttcctcagtatatttgaatccaatttaatgtaagtacaatttctaacagatcatttttaaattttaccattttaggaatacctctattaattttaaaagttggattttactaaagctctatggcaatatactattaaattttatatcttaatatgtttctgttatagttttaaccacagttagtatataagtaactcaaaaagtgaaaaaagactaacatgcttccaagtctgaattcccatattgaatcaccctatattttgctcagagaagccacagggaaagataaaaccaagcatttgatataaatatgaatgtttaatctaggggttttacttaaaatagtcaccaaaattgagtgggcctctaatttctaaattttaagttaagaaatcaaatatattatgtttagatattttaaaatatggcacttgtgtttctcatattgcagaattttgtccttgcaataattaagacagtaatgaaaatactatgtttatagtaataatctattccaagttatttagactcagtgaactcagttccaccacaataataaaattactaaaattttagatttaaaacatgttgagtatgtactcccaaaatgtgtgtaactattgtataccagtaaaaaatttaaaaacaaaataaaataattttttgaggatttactctttcatatagtatctgtagagtaattatgtttttttttaagtttacaattgtttctgtaagccaatgaaaagatcagatttcaaactttatgatagtttctgtaagccaataagatcagatcgattttgtaaccaccaaaattgttcagggatttttaaagtttgtgaatgtatactacattaaaaaacacatcccataattatattacatttataaagtgcctgtctaaacaaaacttcccagatgtcctcctaagactccatttgtatttatcctcactagaaaacagtatccttctcccaataaagtttttgtagttatctttgctttaaaactagtttttactaaaatatgtatatgtttgtattggcagtgttaggatgaaatgaaagcatactggacaagaagtccaaaaatttggatatatcatcaactctgtcatttactgtccatgtgataagtcagttaaaatctatgaattctgttttctcaatgggaaaacaagatagtggtgaccgcttctctcacagagagtaccatggtacttaaacatcataaagtatgtgaaactattctaaaaatatgtaaattggcattacaatttatatattattgtgtacatatgtattaacagcaaaatgtctgcagttaggaccacatcctgttgtaatttttaccccatccaccccctcattggcagatagtacagtggcaggccacagtagacctttaataaaagtaatgttaagacttaaatcaataagtgaaactggtgataaaatttacttaattcttcaaatagttcttccttcattaaaatccaacaattaattctcatgtttttttcctgtctgatacagtaaaatctacatttaaaaatgcttaaattattttaaaatgcttgaaatatattaccataatttcatttcatggtcaaataattaccttttctccaggaacaggttgacctggggaaaatcctggatctcctttggggccctaaataaaatagttataaaacagttggtgaagcataagttgcatataatgtgtcatatatcttcaggtatttattaccagatgttatatacattatatggtgttaaataaaataattttacattgagataggcattggttatttcattttttaatgtatatttttcttagccttatttttaaatgatgagaagattcctaaaagttctctagacatagttgattttttaatctaataaatttaaagttatactactattgaaacatttttcttgaaggacctaggtagatttattattttttccatttttgtgacatattgagttgttattcctattttagcattgaaagactattactttagtaaaagaaaacttcttataataatccttaaaattctaagatatcattccaagtttaaatattttccaaaatattacaatgcacatgtattacttttattattaagaaaaatgaacataaaaaagatacctctaatccacaaaattctttttattctgttataaaattagataagtttcacagtgtggggatctttatcttttacatttcaagataaatatgacattaggtttcagctaaagtttttgggtacaatatcaaaatatttttatgatgcatagtagcaaagtaactctttttcaaacaatttgtcatatctcaaaatataggggccacaatggagattctttaaaattcaaattctgattttattaccattctcaactaagaataaataattctccttcctagatacttctaaatactattttcactgggaaatagtcatatcttctttacatattcagagatgcttttaaatgacacttaagctgactgatgaaggatgaaataccaaaagaaaagtcctgcgtgtcccccagtaagtattttcattttacaaattagaaatgaaccctcactggcagagtcctgtattctatagtcaaagaaaaattctacattgtgtaaggaaggggggtccagttttaatgttctgtatatggctagccagtcatcccagcaccatttattgaatagggaatcctttccccattgctcgcttttgtcaggtttttcgaagatcagatagttgtaggtgtgcagtcttatttctgtgttctctattctattccattggtctatgtgtctgtggattaaagacttaaatgtaaaacccaaaactataaaaaccatggaagacaacctaggcaatatgatttagtacataggcacaggcaaagatttcatgatgaagacaccaaaggcaatcgcaaaaaaacaaaaattgacaaatgggatctaattaaaccaaagaggttctgcacagaaaaagaaactatcaacagtgtaaacaaacaacctacagaatgggagaacatttttgcaaactatgcatccaacaaaggtcaaatacccagcatgtataggaacttaaacaaatttaccagaaaaatacaaacaaccccattaaaaagtgtgcaagggatatgaaaagaaacttttcaaaagaggacataaatgcagccaacaagcatatgaaaaaaatctcaacattactgatcattagagaaatgcaattcaaaaccacaatgagataccgtctcacaacagacagaatggctattttgaaaaagtcaaaaaataacagatgctggtgacgttgcggagaaaaagaaatgcttatacactgttggtgggagtataaatcagttcacccattgcggaagacagtgtggcaattcctcaaagacctagagacagaaataccatttgactcagcaatcccattactgggtatatacccaaaggaatagaaatcattctgttataaagacaaatgcatgcatatgttcattgcagcagtattcacaatagaaatgacatgaaatcaacctatatgcccatcaatgatagactggataaagaaaatgtggtactgtatatacaccatggaatactatgcagccataaaaaagaatgagatcatgtcctttatagggacatggatggagctagaaatcattatccttagcatactcacacaggaacagaaaaccaaataccacatattctcacttataagtgagagctaaatgatgagaacacatggacacagagaggggaacaacagacatagggtgggaggtgggagaggatcaggaaaaataactaatgggaaccaggctcaatacctgggtgatgaaataatctgtacaagaaacccctaatgacacaatgttacatatgtaacaaacttgcacatgtacccctgaacttcaaatttttttttttctataaggaaagtttgtcttccaggttgacctctttttcatcatagccatcactgtttgctccactattaaggctacaattttaggtcattggttacaaggttatgaaacctaagaaatggctttggtgatatcttaatatttaaaaacttaactcatcatcaaaaaagttaatatacttagaatttataagagtaattagagcttatctagtaaaacatattttgtagataaaagaagcaataaagcccagaagagttaattgacttgctaaggattacttaggaaagtattggcaaacaatgtccattttctttcttgtatcacaatgcctattacaaatcttatctattggttttaatatattttaatcttttattataaaagctaactagttgattcaaggctataatttacaaagatttttaaaataagaaatgatagcccttgaaaagtttaaatataataaaaccctttgtggccaatgtttttattataaatatcatgttaaaaattcttacgtttagatcctatttgaattttctatcatctgtcagctttcttaatatcatcaaataatttaatgtttaatctccactttaaaaattgatagagtgggcaaaagtaatcaattgaacaataaaaattagattttaaagggtactttttcttcatgtgttatacatctgggcaacacatttgacacatatatgtcaaatttctctttgttctacacaaatatgattgagttaattgatcaactcatgttttagaatgggaatttcaagtcagtatggaggaaatgctcttaacttggctagttgtgggctgatccttcctaatataaaatgcatgcagcgaagactattgaataatgccaactttatctaaaatgtcaaggaagtagggcatgcttctctgcattgaaggagaaaactccaaaatttcttattttctccctcattttgtatcaactgttggactcttgacacacttttcatcttacttgattagtttttcaaatcccctttggaattatataaaatacttataaattcattaattaatcataactgactctgaacctcagtaccgacttccacttacttctgcatgacttttgttaaaggaagtatatatccttttgactatgagtaagaggaaaaggaaattgcctattctttgttactcaaagttccaactatcccactgatctgctagagtttaaaatcatttttatcagagtaagtcttttagtccattattgaatctccagagggccctcggtctagggagggaaagtccccaaggtagaggacccattaacatgttagaacagatttatcttagattagcatctgctcaatataattgaaagagcattgggatttggagtgaaaacaccaaacaattcatttaaactctcaatttgagatttcttctctgtaaactcgtattaataataatgagctttaggaccaaattctctatggattataaaggtattagtagtcagtactaaaattaacaggactaaaaacaattattattaaaatcacttttacaattgttgccatcttggaaagcagataacacaacttttgagtgaattattaatgaagcagcaaaactttaatagagaataatttggaatctaaaaattcagagtaggaatgaactaaattgtgagaatatcacaaaggaaacactaaatgacatgaccttgaggtagcatcatttggatattcttgactttgacattactaataaccacataagcttcataatctcaattacactctccaaccaacacttcctatctttagcccactcttcataggcctccacaactttaacatttatttgattcactttaacatttatttatttgaagctgctaatatgtggatcctaccacattttcattggttcatcccccttatggcctcgctttcctcctcagcctaaatacaagggtctaacatagtcactccattgcatacataaatgaccctacttcccctttctctctctgtcttataagcttacctggcaattcttaaatctaaattctatctattctgcacctgcctaacagccgaatgtgactaagagaaaaaattcatgttgacaaacttcactttaaattcataacttctttcattgtttggtcttttatttaatgtgtccaataattgtcttagtcaattcacattcccatttttatagatgattatttcataactccttctctttctttcctcttagctagtgatcttgtttttaatttttataagttctcacaaccaagtctactacctcaacctaactctgttctaaaatgctctgccttctctcattaaacagacaaatccaccattctttcaccaggctatcactgacgctctgtttttcctgcattattttaacttttacttctcttcagaataatttctatatacccaggataatttccattacagtaaacatactttaagttttgtcatcttaaaaaaagctttccttgagcctacatgtctcctttctgctccttatgctattcccttttagagtgaaactcctaagttgtttctgttagctaggagacctcctctccttttgttctctcttggacctactctacacagacttttttgtccctaccactatcctacttcacttatcattctttctcaatcttgttgttattgtattgttgttgttgttcttcttctccttctttcttctcttttctttcttcgtctttcttctcctttttctacttctcctcctccttcttcttctcctcctcccccctcctcttcctccctcctcctcctccctcctcctcctccctcctcctcccttctcctcctccctcctcctccctcctccctcctcctccctcctccctcctcctcccttctcctccccctcctcctcccccctcctcctccctcgtccttctccttctcctcctccttcttctttttcttattcttattcttcctcctcctcctcctccccttctcctcctcctcctccttcttcttcctcttcctcttcctatttattaaactctggagtaccccccataaggcttagtctttggacgttatctgcattcatccctagatgatctcatgaactctatatctttaaattccacatatacactgatgactgtaaactgtatttctagctatggcatgtcccctgaactccagatccaaatcctatttttaaatctccacttggatgttaaatagtgatctcagttgaatatgtccaagaaagagctcttggaaattctcgtccagatagtcacagagtagcatgtatgggatgaatcctcctgtagataatgattacaaagtcaggataagatacataaaacaacattatgtgagtatacaggagagcaaccaaaaacaggatacactggaggggattcaacccttgaaagggagacccatactttgtgtaatacatatttatacagcttgtctcctgaggatactccctagtctgcatggagtgactagaattaaagcagaaatagaccttttactaatggtgtcagaggtcagagtaaggggctaccagaatgactgtaaattggggaagaaaattaaaagaaagaaggaaaaagaagaaaggaaggaaagacagagaagcaagagaaagaaaggaaaggaaaggggaggggagcagaggagaggaaaggaaaggagaggaagaaaagaaaggagcttcccccaaatgctggatatagatttttcatccttggctgacactaacatgtgcttatatgaggtagactccaaagagctcaacagaagcaggtggaaggctgaaagaattgaacataaatatcagctgctggtcaccacaggggaaacagtttgggggtttagccacatccttttagaagaacatggtaaatactttggtaaacacctttccattgacattcaggaagggccatgctttagaagtaaatatgacatccttggactgagactcacaccaagagcaaaactgaaacaaatctgtcctttaaaaagttaccaagcccataagtttaaggtgactcttttggtaaaaagttaccaaacctttaagtttaaggtgatgaaccagttatttaactatctacagaataaaaatgaacagtcttcaattcaaaggacgtaacagaatctaacatctcttcaacgtatcatccacaatatccagtatatacaaaatcttctagacatacaaaaaaaatgggggaggggaaaatctgacctgaggttaacactatcattaaccaccataatctaattggcatttatataacaccacaccaaataactgcaaaatacacaatcttttgaagtatatgtagaatgttgacaaaaataggtcacatattgggccataaaatgccttggtaaattttaaaaggttaaattccaccagtatgtgctctctgatcaaaatggaactaaattagaaaaataataaagaaaacaacatacttctaaataagcaggtcaaaaaagaaattatatatttccgagtgataatgaaaatgtaacatatcaaattttgtgagatgcagttaaatctgtttttaaaggaaactttataactttaaatattagaagagaagaaaggtttataatcagtagtttagctttccaccttaagctggaaaatgaagaacaaattacatataaaataagcagaaggaagaaaataataaagagttgaaatcagtgaaatataatgtagtccatagagaaaattaacaaagccaaatattgactctttaaaatgattaatgaaaagttgttatttcctaccaggtgaaaccaagacaaaacatacaaagaaaaacctgcaaacatgttatttctcattatagcagataggaggtcccataatagcagctgttcaactgctcaagccttagcattatctttggctcttctctttcacactatatatgtaatctaccagcaaatcatgttgactgtaattcaaaatgtatctagattgtgaccacttctcaccacctcaactgctaatacctttatccatgccatcatcacaaatggcatggactagggatgactagcagagtagactcaactggtatccctgtttccacctgtctcccaccccaaactattctccacatgacagccagaagtatcctagaatattactggatgatgttatttgcctgcttagaactcttcaatgaatattcaacacaatcagaataaaatccgaccaaaatcttttttttaaaattttattattattatactttaagttttagggtacatgtgcactatacccaaaggattataaatcatgctgctataaagacacatgcacacgtatgtttattgcggcactattcacaatagcaaagacttggaaccaacccaaatgtccaacaatgatagactggattaagaaaacgtggcacaaatacaaccaaaatctttaccaatagaattggctcctactacctctctgatcatattcctgacacttaacctcattcagctattcttcaaagattgaatcaaggcctttggatttagtaaactgttgtttttcaatgttttcatcaggaatgccaaagtagtgatttttaattctagcattctttatttagtagctctttctataataagaaacttccatttatcaactattttgttatcctgaagttcaattctgtaaggaagggaggcaatttttaaaagtttgcttctttccttttatttttcttctatttaccattttttaaaataatgatgtggtataataaaatatatatatttggtttttgtccccagttcctggcatagagctcctaaactccttgaaatttcctgagtgataggggtgtcttttgttagtcataacaagccccttctgaccacaccagagtttatgctaataagatgacacacgctgggatccctaaatagctttcagcattggggtctggtcaccagaaagacacacaaatgattagagaatgggaactttcagccctactttcccctaccccctctgccagggaggggagagaggggctagaaattgggttataaaaactcttgaacaagatttgaagagcttctgttggtgaacatgttgatttcctgggaaggtggtatggtgggatagagcataaaagctccacactccccatccccaattctttgccttatgtctctctttcattaggctgttcctgagttgtatcctttacaataaactggtaaaagtaagtaaagtgttttcctgagttctctaaaccattctagtaaaatattgaatctgagaggatgggtcatgggaacccctgagcttgcagtttgtccaagcagaagtgtgcgtctgggcatctcatttttgtctggcatctgaagtgtgggaagtcttataggactcagtgttaaaaactgtggagatgatgctaactctggtaagctgttgtcagaactgaattgaattgttgcatatccaactggtgtcagaggatctgaggatcttacagatataattacccagcatcatcaaaagatgatcaatgactttgttgaagttgtatatcagcttaaggagctttgggtccaagactatggggttttctaggtatagaatcatattgtctgcaaacaaggatagtttgactccctctcttcctatttgggtgccctttatttctttctcttgcctattttgctccggccaggacttccagtactgtgttgaatagaagtggtgagagagggcatacttgtcttatgctggttttcaagggtaatgcttccagcttttgcccatccagtataatgttagctgtgcatctgtcatatatggttcttattattttgaagtatgtttcttcaatgccaggtttattgagagtttttaacatgaaggggtgttgaattttatcaaaagccttttctgcatctattgagataatcatgtggtttttgtctttaattctgtttatgtgatgaatcacatattgatttgcatatgttgaaacaaccttgcatggcagagataaagtctgcttgatcatagtggataagttttccaatgtgctgctggattcagtttgccagtattttgttgagaatttttgcatcaatgttcatcaaggatgttggcatacagttttcttttcttgtacctctgccaggttttagtatcgggatgatgctggcctcatttaatgagttagaaaggagtccttcctcctcaaatttttggaatagtttcagtaggaattgtaccagctcttttttgtacatctagtagaattttactacgaatctatctggtcctgagcttttttttttaaccaaaaaaaggctatttattactgattccattttggtgctcatttttggtctgttaaggaatgcaatttcttctgggttcattcttgggaaagtgtgtgtgtccaggaacttatcatttcttctaaattttccagttttggtgcatagaagtgtttataatattctctgatggttacttgtatttctgtgaggtcagtggtaatatcccctttgttgtttctaattgtgtttatatgaatcttttctcttcctttttattagtctagctagcagtctatttattttactaattttttcaaaaaaccagttccaggatttgttgatctttgaatgattttgcatgtctcaatctccttcagttcagctctgattttggttatttcttgtcttctgctaactttgaggttagttttctcttggttatccagttcttttagttgtgatattaggttgttaaattgagatatttctttttgatatgggtgtttagtgcaatacatttccccttaatactgccttagctgtgtggtagagattctgatattcgtatctttgttctcattagtttcaaagaacttcttcactcctgccttaatttcattgtttacccaaaagctgtgcaggagaaggttatttaatttcaatgtaattgtatggttttgagcaattttcttagcctggatttctaattttactttgctgtagtccaagagagtggttggtatgaattcaattcttttgcatttgctgaggattgttttacatccgattgtgtggtcaatgttagagtatgtgccatgtggtgatgagaagaatgtatattctgttgttttgggtggtgagttctgtagatgtctatcaggcccatttgatccagtgctgagttcaggtcctgaatatctttgttaattttctgcctcaatgatgtgtctaatactgtcagtggggtatgaaagtatcccactattattgcatgggaatctaaatctttttgaaggtctctaagaacttgctttatgaatctggttgctcctgtgttgggatgcatatatatttagaaaagttaggtcttcttgttgaattgaaccttttaccattatataatgcccttctttgtcttttttgatatttgctggcttaaagtctgttttgtccaaaattgggattgcaacccatgctttttttctgttttccatttgcttgatagatttttctttatctctttattttgagcctatgtgtgttactgcatgtaagatgaatctcttaaagacagcctaacattgagttttggttctttagcctgccactccgttccttttcattgagacatttagcctgtttacattcaagattagtattaatatatgtggatttgatactgtcttcatgatgttagctggtttttatgcagacttgtttgtgtggttgttttaaagtgtcactggtctgtgtacataagtgtgtttttgtagtggctggtaatggcccttcctttccatatttagtgtttccttcaggagctcttgtaaggcaggtctgatggtgattaactaactccctcagcatttgcttgtctgaaaaggatcttatttctcctttgcttacaaagcttagtttggctggatacaaaattcttggttggaatttcttttctttaagaacgttgaatattggcccccagtctcttctggcaatgtatggtttctgctgaaaggtctgctgttagtctgataggcttccctttctgggtgacctgacctttctctctagttgcctttaacatttttcctttcctttcaaccttggagaatctgacgattatgtgtcttggggatgatcttcttgggaggtatcttgccggggttctctgtatttcctaaatttgaattttggcctctctagctaggttagggaagttctcatggatgatatcctgaaatatgtttttcaagttgtttccattctccccatctctttcagcaataccaatgagtcatagatttggtctctttacatgatcccctatttctcaggggttttgttcattccttttcattcttttttctcatccttgtctgactgtcttatttcagaaagccagtcttcaagctctgagatctttcttcggcttggtctgttttaacacatgtgattgtattatgaaattcttatgtgtttttttcagctctatgagatcagttacattcttttctatactggctattttgcctgtcagctcctgtatcatttcattgtgattcttagcttccttggattgggtttgcgcttactgctgcatctcaatgatctttgttcctgttcatattctgaattctatttctgtcatttcagccatctcagcccagttcagaaccttgctgcagggctaatgcagtcatttggaggaaagaaggcactctgactttttaagttctcagagttcttgtactggttctttctcatctttgtgggctgatgttacttcagtctttgaaattgatgtcctttgaatggtttgtttttcttttatcctatttgatgaacttgagggttttattgtgatataaggctggctcagtcaactggcctcatttctggcagattttaagtggccaaggctcaactcacaactcctggactacatgctctaacactgagggactgatattgggccttgactttgttctctggcccttcaaggttaggatcccactgcaatgggaggagctaagttcctggaccattgatcacagcattccaatgggtagtgctagccaaagtgtttcatagggtggtagcagtgggatctgtccttgtttgcacatgccagcagcagcggccgagtggcaggatgctagcgggtgctgagagaccagcctccatgcaggtatttacagcagtggcagaggtagcatgactcaggaaggtgggggtcacactggtggtggtgttagcacagggacgaggcactggcaggtgcaggactgtgtgtgccctccgtacatgttcacacaggtggaggtggctgcacagggtgggagagggtccactgttctttgtgcctagtttcactccagtggcagtgttgacacaggggtggggtgctggcaggagcagggctggaaggctgtgtacctaccagggctccagctgcaatagcggtatggcagagggaggggaggtggagtgcacacacaccagctacagtgctatggcagggttcacatgcaaaaccggtggaacaaggaaggcaagatctgcctgcacacacatgcgttagcaaagcaatacggggagtggccatggaacctggggatgctgcagtgagggaaggaacaggtcagctgttgcgtgtccagagggccgctctgctggtcaggcacagtccaacagtgcaggagttatgatgcgggcccccagggccccagtctggctgcatctgtttgcagtccagcattgggtgccctgggaaaggccagcagatcaaggaaagctcagatcagaccagccccaggtgatagggaagaccaccctgcagagtttacatctgggctaaagttcccctaggggaacagtctcctatgggagcaagtgcagcctagggggattggcattcctggccatgctccaccacatatgctcctgtaacacaccctttgggctccacactggctgagtgctgctcctaccacttatctaagccgctctccctgtcaatgaagtggctgtggtggttgaggggtctcctcctgctgggattccagaggcctgtggtgaaagcaggttgctccttgccagttcaactcacctgttctccaggagtcgctggggtccatgaatgagtcccgatgtgaagtagcccctgtgcagagttcccagcttcctccctcttcagcccagcttctgtgtcttccctctgtccactctcagtgccctttctctacagatctgttaggagtgtgccagtcatcccgatcttcagtggcagctgttccacctggctgtgtctagtcagtcatcttgcccagctcccatatcattttttacattttcataatgttggacttactattttttatggcaatctgacccactacaaaattcttcttgtgggtaagcatctatacttaagatatttatttaattcatatagaaggaaaaattgtacttctagttaagataaatacacgatggagacataggagaagacagtcataaccagggatagaacatagcactaagatactactctttggtgttcaatactttatatatatactaatatattaaatattattaatgaaacattgttactgtgggttattaaggctagatgttttcatttaactggattaaatttgaaggaactattggccctgactaaattaatataagacatgaatgtttgtaggaaggttttaggcttcctccaagaggcctttttttggaaaagaactatcttgaccacagattgcctggactggaattgtaagcacatggtaggctgatgatacagactctacgtgcattcatcactcatgttcaaagatctacagcataattttacgtgtttaattaatagcaatgaacattcccatcgcgctgcaaataaatagaatacagttcatttaatagataaatatgataaataatagacccaggtggcatttgataacaagaaaaaagccattctctctggaaaacaggaaatggaatttagtttcttattttttttaagaagaacattgtttctaccatcagtctcctgatttcagccaatgatttcagctaatgatccccatagtctttctctattttaaatcatgttagttttacatgctgagaaaaattgctgcatatccactaaatttgtgtgtggcactttatatttctattgtttaacaatttaacaacacagtcctcagggattaggaatcagtttcactcttcatagaatttctatattactatcattatccacgggataacctggaaccttggaatataaccactttgttactattactaaataaattcataaagtctttaagttaggtaaccccaccactatcctgccttcttaaggtggtattttataaaagaattcctcattgtgttgggagagacaacctagtgtaagaaaaatactaagacatttccaattttgtctccccctctaccacttacaaacagtgttaccttggttaagcgcttactgctctcaagtgttttcttctgtgcaaaccagaaggtaataaagcctgctctcatagtacttatgattgggataaaactaaagagatatcatacataaaataagtggcagatattagataaaagaggattatacagtataaagcttgaatgttctattaattccgattattctagaaatgcatgttaagtacctaagaaaatcggtttcacaaaatcaaacactacaagctttatatgatacatttgtgacacaatggtaatttatttatttatttatttatttatttatttatttatttatttatagacggagtctgctccgtcgcccaggctggagtgcagtggcccgatcttggctcactgtaagctccgcctcccgggttcacgccattctcctgcctcagcctcctgagtagctgggactacaggcgcctcccaccacgcccggctaatttttttgtatttttagtagagacggggtttcaccgtgttagccaggatggtctcgatctcctgacctcgtgatctacccgcctcggcctcccaaagtggtaatttttaatacttgtcacaaatctactatcttccacaaatatatgcagttaaatcatggtcagttttagctagtttggacacagttatcaaattcttaaattaaatatgaattaaagactattgttcaggtttatatgactaaatccccaagaggcctaagtttttgcaaaataaatgtaagtttttaaatccctcatatgtgagttcataaaatatcttattggtgaatagttatagtcaaaattaagtccatcctactaaatataatgttaaagaagactcttgagattacattttcttctctcctaggtcattttaccacagacatatattaatactaaacagtatttaaaaacactgtttttaatatttttaaaatttatttttgatacatattttctgggtacatgtgataaataatttgatacgttcttataatcaaatcagggtaattgggctggatctctattacaatgtgtttaatcttggaacagagataattttagtttgatacaaagttcttcattttctcaaatattggcttctcaatatttatacacattttaagaagtcaatgaaatacaatactttccaccatctctagctttaactctcctcaccctattttccccattttttctttgtatttgcttctattctgaaacagcaacagagcttattaagaaaggactctcgggctggtcgcggtggctcacgcctgtactcccagcactttgggaggtcaaggcaggtggatcacctgaggtcaggaagtcgagaccagcctgatgaaaatggagaaaccccatctctactaaaaaaaaaaaaaaaaaaaaaaaaaaaaaattttaaattagccaggcatggtggcacatgcctgtaaccccagctactcaggaggctgcagcaggataatcgcttgaacccaggaggtggaggttgcagtgagccgagatcgcaccattgtactccagcctgggcaacaggagcaaaattccgtctcaaaaaaaaaaaaggattctctaaagggagagtaaattggtacttgccactgcagattgagagttaaattacaagagcctaactgttcgctactggctgaagtattaggctggtgcaaaagtaattgtggtttctgcctttttaatgggcaaaaaacagaactacttttgcaccaacctagaagggggagaagaataaaagccatgtggaaattctgtctccctgggtcttgtggagaggaggcaattagcaggaatataaactcactataaattcagccctgtggagaaatataatctgagcccttacagctactttaaccttactaaactaattataaagtccccaaatgaagctcgaagggctatgaaaccacaaactcaaaaagaaattcctaatttctttagaagccatctatcttcttccctattacttatccagacttgattttaaagagtcgtttttcctctctgaggcacttccattgaactcaaaaaaattttcaacacaggtgagaaattttggaaatttagatttgaattatccttgttatatgctattattacctattaataataatgataccacttatggcatcgtagcaccatgttaagagctttactcacattaatgtatttagccatcactacagcactatgagcaggtagcatgattctccccattttacagaaaaggaaagaagcttaatgagcctaagcaagcaatttgcttttagccattcaaattgaaagagttaagacttgaacccacatctgtcagactccaaaaattctattcttaaccccaatctatatgatttcatgtttacttctgaatgcgatcactgataagcagaggggtgagaccctcaaagattcatgaagttactggcaaccaagatcctaatccttatctaatcttcccccaacctctgtcatcactcatatgcacacttttttcttttcttctcttcttaatgcaatagactgaatgtttttcccttcaaaatttatatgttgaaacctaatcctcagtgtaatgataagtggggctcgtataaatgggattagtgcccttataaaagagaccccagagacatagctagttccttccattgtgtgatgacacattgagaaggctctgcctatgaaccagaaagcaagccttcagtagatactaaatcttctggtgctctaatcttggacttcccaggctccagaactgtgtgaactgtgagaaataaatttctgttgcttataaactactcagtttatggtattttgttacagcagcctgaaaaaactaagaaaatatatattgggaatgggaatattttattttatatattttaagggaatgggaatattttattttatatatatttaataaaaatatatacacaatggaaatgggaatatttcattttagtgggaaagtatgggaatggagatatcattaaatattttatgtttagtgatatctccattcccatgctttcaaggtaaccaacctgtgtacctgtattcttccatacgttttcctatgttcttactatttatcacactgttatctatcatattgagaggtgacaacatgctagcagccctcgcttgcttttggcgccttcttggcctcagcgtccactctggccgcgcttgaggagcccttcagcctgcccctgcactgtggaaggccctctccgtgctggcccaggagggagccagctccctctgcttgcggggaggtgtggagggagaggcgcaggcaggaactggggctgcgtgcggcgctcgcgagcgagcgcgagttccgggtgggcacaggcttggcaggccccacactcccagcggccccgggcagtgaggggcttagcacccaggccagcagctacagagggtgcgctgggtcccgcagcactgatggcccgcccgtgctgcgctcgaattctcgctgggcctcaaccgcctgcccgcagggcagggctccggacctgcagcccaccatgcccgacccccgccccccacaccccatgggctgccgcgcggcccaagcctccccagtgggggctccacctccttctccgtggtgcctggtcccatcgactgcccaagggctgaggagtgccggcaagtggagtgggactggcgggcagctccgaccgttgcccctgcatgacatccgctaggggaagccagctgggctcctgagtatggtggggacttggagaactttatgtctagctgaaggattgtacatgcgccaatcagcactctgtgtctagctccgggtttgcggatgcaccaatcagcactctgtatctagctaatctggtggggacttagagaacttttatgtctagctagaggattgtaaatgcaccagtcagcactctgtgtctagctcggggtttgtggatacaccaatcagcactctgtatctagctaatctggcggggacttggagaagttttatgtctagctagaggattgtaaatgcaccaatcagcactctgtgtctagctaaaggtttgtaaatgcaccaatcagtgctctgtgtctagctaatctagtggggacttggagaacttttatgtctagctagaggattgtaaatggaccaatcagcactcagtgtatagctcagggattgtaaatgcaccaatcagcactctgtgtctagctcaaggtttgtaaacacaccaatcagcaccctgtcaaaacagagcgatcagctctctgtaaaatggaccgatcagcaggatgtgggtgaagtcagaaaaggggataaaagcaggctgcccgagcccacaggggcaactggcttgggtccccttccacactgtggaagctttgttctttcactctttgcaataaatcttgctgctgctaactctttgggtctgcactgcctttatgagctgtaacactgtgaaagtctgcagcttcattcccgaggccagcgagaccacgaacccaccgggaggaatgaacaactccggataggaggaacgaacaactccagatgcgccgccttaagagctgtaacactaaccatgaacgtctgcagcttcactccttaagccagcaagatcaggaacccaccagaaggaagaaactgcgaacatgtccgaacatcagaaggaacaaactctggacacaccatctttaagaactgtaacactcaccgcgagggtccgtggcttcattcttgaagtcagtgagaccaagaacccaccaattccggacacaatatgactatcatacaactatgtacgctcatatatatagattttcaggttagttgttttcataaacatttgttcattctttaaacatcctcggttttttttcaggtaaaaataattagggaagtgtggagcaggtaaataatattttatttccttggtgtttatttacaaattaaaacgaccttaatttaaggtaaattactcaaatcataatcttatatttcagaggtttccatacattgccatcatatttttgataacaatgattttggaatactaagcaggcctatacctgattttactactaagaatataaatccaagtatggtgggctttcagaggaacctagctctctgccaggctaagacaatcatgttgaagaatcatgctctggaggtgacagagatccttgatgtatcaagacttgccttaaatgttagggatcttctttttaatatcaggaaaatcaggtgatactcattagcttaagttgcctgattagtagtcacttacctttggaccaggtaatccaggtaaaccaggatttccatgtggccctggtatgccctgcaagtaacgaaaaaagtcatcattcttggaacatactggaatggaacaaagtacaattgcttactttcctctcaacatgtgtgatccctttaagcacttgagtttttgcttatgttattatgtatgccttaaagacctacttacttcagcttatgccctatacctacccaaatttttcttcagatctcaactcatttttaaatcctagccacaagaacatgaagcaatatctctctcctactaatttccgtagaaatttcttcatgtaaaattcatttaccaattaattgtatattgcctcaggacatttcttatactgttctaatctgttacttaaatactttattgctgttctaactgccttatgacatgttctatttagccccaggattataaattctttgaaaagagactcttaaaaatattactagtgtagcacttaacacattgaatggttacactcgattaatatttagcaatttgattttgcatcactgataaattatataatctgaattcaaaaattgattctattttctgagtacctactatgtgctaggaactgtgttgatgttttgtgtttctcattactaatccttataacaatcctgcaaggttattatttttactcccatttaaaaatccggaaacttaagcgcatacaaccagtaagtagaggaacagatcaccctctccaagaaagccttccatgtctccaggttccctatgcttacttcaattttgtaccctacttctgtgctcttcagccatacctccctcttaagacataacatatagttaataattatttgtctttttaattctgaattaatagagcagaatacttcaggaagacagaggtgtcagcaatgcaaatattgaaaatgcatctagcaagatgaaaactaaagaaaaaagattaaattttggctgggtgtggtggcttacacctgtaattctagcactttgggaggccaaggcaggagcatcacttgagctcaggagtttgagaccagccagggcaacgcagcaagacctcatcactaccaaaaatcaaaaaactttgccaggcatagtggcccacacctgtagtcccagctaatcagaaagctgaggtgagaagatggcttcagccctggagatcaaggctacagtgagctatgatacccatcactgcactccagcctgggtgacagagtgagatcctgtctcacaaaaaaaaaaaaaaaaaaaaaaaaaagaaagaaaaaaatggttagatgttatgacttatgtcattggtaaccttcaaaaagtacattttaataaagtagatggaaaacatctatggggattaatgaataagttgctgatgtaaaagtaaggacaatggaatataaattattatttcacaaagctcagtagtacaaacaacagtgagccaaaacaatagctttaggaaaaattaatatcaatgaaagtttgggatttataaaagagggataacttgttggttgttgccaaataatataaaatttagggagagaaaaaatgtaaagttgcaacttttaagttagatgaggtgaaattaggaacacaagtaaaataactagccttgagcaaaacactctttcttccttaagagaatgagaattggacaaataaatggaagataaaaagtgaattagggaagataaaagtaaaaaagtaaactgccgtattatgagaacagatggagattctgaacctgaagttcatgctgttgagagtacaaccttagcagtggatagggaatagaattagtatgaaaattggcccagtttctcagaaaaataggatccaaattctcacagagaggtaggaggataggaatggttcatgggctagaggagaacgagcaaggtttagaaggggctatggaagaaatgtgataggtcatcaactacagagaattttttttaatgcaaaacagctagagcccaatgagaattcatcttaggcctcaaatggacaagagtttgatgtgactatggacaacttaaagtaatattttagagtaatttttctttataatctttgtatgttaaataaaaatcagaataaaaataaagtggattatataaaaggtatttgcatttgtcatacaattctttttctagctcattgaacaaagatgttttgtagtaaaatatccacactttttttaggtttgagagaaactaattttaacatagcaataagtcttttgttgggcctgtgtaacatgaaaaactactgctgatctttaatgcagcttttttcctcagggcagttattttctagtcaatagcttcagaattttccactatgtaatccaggaatgtactattttaaggcagcccacccctcttcatttccccaaacaaatgaatctcaccttagatattgcgatcactttataagtaagaataatgttacaagtagcaccagaacagccactaatttacacatttgatcatctttgttggacacgttcacagagaatgctttggctgtgtgtttacactcaaaataaactaggctgcatgtgttcttaagcttctcttgaattggctaaggtaggactaagtttgaagatccaggcaggtttccaaaggaagtacatactgtacaatactagaaaaaacatgttagaaagttacaaattctcactgccagcaggaaatatagcccatctacttacccgtggacctctcttccctgacggacctgggatacctgctggaccaggtggacccttggaaaacaaatgtcaagacattaggcatgatagtggacacatttattttcttacgagtctgaataagatttccacccaaagacaactctttttcagtccccagttcccagctggtgatgatttttaagtaacacgaacccccttaccctaatcagcaggggtgagttgaaactcaagtgtcccctttaatctggccagaaatggcagcaggaagtctatgacttatggttacagccaccgtatctggtttttaaagggaccacaactagtagttttgtgggtaattttttacctaaatttacttttactatggaagaaggaattcaatttagggtttggcgaccaacaactacaagtttttttcaaacacaattcagaagaagatttgctttgaaaaatgaaaacactggccattttatgtacttttaaaagaattataccaaggatctgtgtaatgtgttaaactgttataatgaaatccttcttgtatatccattaataaatctgacttataccaattgcagcacaccaggaagtcactaatagagttaaatgatttataaaataaagtatgaaagcaaaaactgatcaattgttacagtgttctgagttatttaaatgttaatttttaaacatatcaaataagaaataggacactacttctttacttctccatataatgttttatgttgtcttcttcacttactttaacaatcaactgtggaataataaatgctcatttgtgatatggttgaacacatattcattcattcatctgttcattcattcaattgttactgagcactctgtgatatggcattgttcttggtgtctatagagcataccatacacatattccacttaacaaatattcattcattattgcagtaaaaatagtacacgatttcaaattagacacatcagggttaaaatactagcctcaccagtaacaagcactgtgacctaatgtgctttatttttctttattgtaaaatttttatatatctatgctgattgcacataaaataaagagatgaatccaggttaaatcatatgtactttccaatatgtgacagttttttaacctacaatttcataatttcatacagtttaatctgcagcatggccaggtacacctaaaatgtacattgagtttcaaaggaggagagggaaaatggattgatgggaaaggatcattccaattcaaaaacacaagagggaaatgagtaaattatgttgaaaaaaataacagttattttgcatatttctcatctcacattttttgatattaactactccttgaaactttctcttttattagagtcatttgcagttttctgatattcattagatatttcagactgtccatgtttttcctttagttgcacttttttctcttaccccctaaatttataaaacttttcatgtatttcctaatattgagagagaaatgctatttctattcagcccctaactgagggcattctccttcctcagctgttcaaatattttagcagccattatcatatcactagcttccatcaaatcttgatattttactcattgtcaagaaaaattgactttcttttcaagttaattctggtcctgttgttataattaaaaatttagcagctgttgatttgaatttatgtccccaaaaataagagccagtaggagaaatcgcaactaaaatgaaaaagaaaatgaaaagttttctttaaaaatgtctagtttggtttagtgtcctgtctcactacttgtgacaaaagaaaacactattccattcacattggaaaggcagtttgctatggcttgcgtttgtgtcctcccaaaattcgtatgttgaaatcctaaacaaagtgatggtagtaggagatggggactttgggaggtgatgggtcagggattagtgtcctgtaaaagaggcataagggagttagttcattttcctcttccaccatgtgaggacacagcacgaaggtgccatctataaaccagaaacaggccctggccaactaccaaacatgccagcactttgatcttcaacttcccagcttccagaactgtgagaaataaatttctatagtgtataagcctcctagtttatggcattttgttacagcagcctgaactaactaagatgcaattaacattagatactggggggaaaaagaggtatagtttatgtcatgatataaatatttgaattgtttgataagcactaaattaaaatcaattctcacatgtcttcataattttgtggtttcaaaatcttttacaacatagtattaataggcattttctagataccagagaagaatcataatttttatagcatgacatttttgagaataaattattttctataaataaggttaagtactaaaaaaggcactttaactttcagattatttgttattaagagaaagtacaattccatttaaaaagtaatggttttgcaatcatacaatgtagattcaaatcatgcctcaatcatttactagctgaataaccttagacaagtcagttactctttctaagccttagtttcctcacctttaaaatattgatgatagaaatttacctttcagggttattgtgagtattaaagctattgtatataaaatacctgtcactgtgcttggcagtgatagtagttaaccagtaaacagtagtctaattaactttttttttttttcgagatggagtctcactctgtcacctaggctggagtatagtggcgtgatctcggctcactgcaacctccccttcttgggttcaagcaattctcctgcctcagcctctcgagtagctgggattacaggtgcgtgccaccatgcccagctaatttttttgtatttttagtagagacggggtttcaccatgttggtcaggctggtctcaaactcctgaccttgtgatccccctgccttggcctcccaaagtgctgggattacaggcgtgagccactgtgcctggcctaattaacttttttaaggtatgcataaggcacagcaatcactgagtaaatgttagatattattattactaggataatatatacattaaggtaaatctattcaatagtccaatacttctaaaagataataatccctggtcagttaatgttggaaatcctgcatcttacattccttttttaatttattcattcactcactcaataaatattataaagcatcaagccctcctggagtttgcagtctagataaaaagacatacattaacagataaatacataattacaaattttacttagtgacatggaggaaaagaaaaggcaaccaagaaagaggttaatatggtggacctaatttatattgtgatgtcagagaaggcttttctgaagaagtatttagttagacctaaaagattaatgggagctagaaaaaagaagaaaataaaatttcagaagataggaataaatgaatgaggccatgagtaaaacaaaacaaaactaataaaagacacagtcattttgaggaattaaaagaaaaactaatagagcaaggggaaaagtggggcaagaggcagttgcagaggtaagcaggggccatatcacatacctgcacaggtcaggatacagagtttgagtttaagtgctataaccttcttccactgaagaacttaagctgataaacaatgttatctgattcatctttttaaaagaacactagagaattttggtaaaagatgtcagagtgagaacattttgcagactactctccctccctcaaaaccagctgtaaacaacaaaaagcaccaaaagaagaaaacatcatctccagtgaaaaacgaaaggatcataaccacaaaccacaaaatatgaagattacctgcccaatactgagaaactttggagcgaaggtgttgagagataaccaaatccaaaaaactcctcagacctcaaaccttggatacatattagtcttgaaaatccacttttttgattatgataaggtttaagggaatgtgcaagccacaggaaatatgattcatgacccagtaaaaacccaacttcaaagagacaagagtagaaaaggtggagctgaagaagaacataccttttttatgttctacaaccagaatcctctctggtgagaggggacaaaagacaagaagagcacaaatccccctatcacttctgagacagcctgtgatacaaagggtttcgcaacaaattgtgcatgaacatgagacgacacatgcctctgggtagaagacaaaacaaatatggtaagatggtgttttaggcagcaatctaaatttgactctgtgtaccattccaccttacttccctatgcctctccatataccattctgaaacaaatcaccaagatacagttgcctttattttaaaaatgaataataaccagagagcaatcagtagaggatttataaatagatatttggaggaggggaaaagtgagaggacaggaaaataaatttaaagaacaaagctggaggcatcacgctacctgacttcaaactatactacaaggctacagtaaccaaaacagcatggtactggtaccaaaacaaagatatagaccaatggaacagaacagaggccttagaaataacaccacacatctacaactatctgatctttcacaaacctgacaaaaacaagaaatggagaaaggattccctatttaataaatgatgttgggaaaactgtctagccatatgtagaaagctgaaactggatccctgccttacaccttatacaaaaattaattcaagatggattaaagacttaaatgttagacctaaaaccataaaaatcctagaagaaaacttaggcaataccattcaggacacaggcatgggcaaggatttcatgacttaaacacaaaagcaatggcaacaaaagccaaaatagacaaatgggatctaattaaactcaagagcttctgcacagcaaaagaaactaccatcagagcgaacaggaaacctacagaatgggggaaaatttttgcaatctactcatctgacaaagggctaatatccagaatctacaaataacttaaacacatttacaagaaaaaatcaaacaaccccatcaaaaagtgggcaaaggatatgaacagacacttctcaaaagaagacatctatgcagccaacagacacatgacaaaatgctcatcatcactggtcatcagataaatgcaaatcaaaaccacaatgagataccatctcacaccagttagaatggcgatcattaaaaagtcaggaaataacaggtgctgtagaggatgtggagaaataggaatgctcttacactgttgatgggagtgtaaactagttcaaccattgtggaagacagtgtggcgattcctcaaggatctagaactagaaataccatttgacccagccatcccattactaggtatatatccaaaggattataaatcatgctgctataaagacacatgcacatgtatgtttactgtggcactattcacaatagcaaagacttggaaccaacccaaatgtccagcaatgatagactgcattaagaaaatgtggcacatacacaccatggaatagtatgcagccttaaaaaaggatgagttcatgtcctttgtagggacatggatgaagctggaaccatcattctgagcaaactatcacaaggacagaaaaccaaacatctcattttctcactcataggtggaaattgaagaatgagaacacttggacacagggtggggaacatcacacaccggggactgtcatggggtgaagggcagggggagggatagcattaggagaaatacctaatgtaaatgacgagttaatgggtgcagcaaaccaacatggcacatgtatacatatgtaacaaacctgcacattgtgcacatgtaccctagaacttaaagtataataaaaaaaaattctactcagtaccattgtttaaacatgaatttttaaagcattaattcactaacagtatccttttttattagcacataataaagagaataatcgttaatgtgaaaaaaattatttaccagaagaggaattactccatacaacagataaagagttcagttatataggtcactacatattcaaagaatgtcaagatgacattaacgtacaaaaataaagttcaaagaagagttgtgaaagatttaaaaaatatgaaagagcaaaaaagaaactctttgatgaaagccatgtcagagcaataaaaactgattaaatataatttaaaaatcaatgaagggataggaatatatagaataaatgagttcacacaaaatgaaatggaaaagagcaatcatgatgacacggttgtagaaaagataataaataccattcatcatcacaaatgacatttaacatatgcaaacttgtatgcctgaagaatttagaaaaatggaaccaaccaatatttggttattataaggggaggtctttctataatcttcagatcaaaataatcttctgatcaaaagagtattcccccaaaaacctgattcagaacctaataggtttaaagaacttcaaagataaagaactgcatgggtatataggcaggaaaaaattgttacttaaaagtaggaaaaaccaggctggcttcaggcttctgagtcacatctacttcaagaagcagtaaggcaattcctacaagttcattattttatcaccattcagtctctcattatctctctaaaatctacctttagtcttctacactgcgctgaagttaggattctcaaagttcaacaatgacttcttcatcaaaatatccaatagattatcgctttttctcagttctcattctctttgacttctctgtctcttttggccctgctgatcaattccttctcaaaagtctcttctttggctttttgatattgcttctttcatattttgatatcactattcttttctcctatctctctgacttctcatcacatttctgctttttctttctataaccaaaaagcaaacatccccctcatttgactggtgaccctatgccacattcctctctttgaaaatctatccaactctatagtttcaactataaaagtcaatagaaatactcccaaatctatatccccagccttgacatctattctttacttcagcttcttcaactcttctaacagcttaattaccaacagctctttaaatgtttcatttttctctcctaaaattgactttccctcttaattacagtttttaataatgatatcaccattctctcaatctgcaggcttaaaatttgatagtcatcttttattcttttcctttttgcttggtccctaggtcccattaatttcctagttctaccaagtcttcctacaaaatctcttgaatcctacttttcctttgcattttcactgctgccaacctagataatgttctagtcctttaacaccaagatggtaacagaaacttcgtatcctggacactgttaccagaccgattttccaattaatacctctgcttagaaacctacaaaattcccctttgagaacaagataaagttagaatgatcatttgacagttaagaatgcccacaacctgacaccatcaagcttggatctttatctgtctgctttagaggaagaaaacctggattcaaatcctggctctatcatttaccaacaatgtcattgtgggaaagtaaattaactctttgggcttcagtttcttcacctgaaaaatgaggataacactacaaactttacaaagttattttaagataatatatgtaaagagactggtagagcatctttctcaaggaactcaataaatgatagctattatgctatcataaaaaaaactcacctactcctctcacctgtcaaaatcttacccattcttagagcctaggtcataactaactttgtccacaagatcttattctgaatagctcagctttaagtgacctttcatagagactccatcaaaaaatactatttttttaacctttgaacatctctagcccatacacttactttgcatctctctgcagcatttatcctactttactacaagatatattaaatagttataaatgtacttcctttatcttcattatgaaatataagctttttctgagcaattactgagttatacatactttgtgttcctgctttgcttatagcagagactaagtaaatatctgctgaatattactgcttcacctgccaatactgaatgactatttttgaatttacagaagagattaatgctcatctgatcagactgactttttctgaagaaagtaaatggcttccataactatttgcttaatattatatgtccagtgattcaattttatgaccaatatgttgataattaattgtcatagttgaagagtttatttctctataatagtatagtcttcatattttatttttaaatgtctaaacatttactctagcaagagtgactcaatacctatcaaatcacttctaggaataaccacaaaggaaacacaagctaaaagactggcttcaccttctcccattctatgatttctagagctaagccaaagactcaaattttattttcattaaataaatactttaagatatattttaatctacttgaaattttgaaaaaaaataatttctaaagacataaaggtaaatttaagtatacaaatatgaagcataaaaagaatatttccaacactgtgattttaaatgactttaagtggtttttaaatgattttagaaatttttaaatgttgatctctaattcccacctatacaacaaaagaaattcagggctgaaaagttcagtttattatctcacagttttgtttacatgatattaaacaagtgccttggttgtttttttcccctcactgaattgactgataactggttctttttgtgttaggcaaggggagctttaattaacccataaacataaattgaccatatcactaaagacagtcaacgattcattacacaataatctctatctaaagtaagttttacactctattttaatccatttgatgctattttgctgtaagaatatttaatggatgtatttaatgtatttttctttaacctaccatatcttttatatacttctcttaacatgactatgcattctcctatggttttcaaaatataaatatattatctatatttagcagttgaaatcctgattgaatttcaactgaacaagaaaaacaaatagtttgcccactacttcaccagaattaagtcacctttcagcctaccagatgaagaacaaaagcacgatatttgagccagggttacattctggcagatatgttacagcaaccataaattcatttactgtgccagaatgcatttccatgacagactttatctgttatgtattgtttggtccagagaactctctttaaaatgtattttaaagagagtttaaaatgtaagttagcatattaggagatattaaaaaaaaaaaaacttacgggaggtccagtgtctccttttggccctctcagatactccatttcaagcattgtatttagatcctcataataataataatcataaagctcagtttcatagctattttcgatgggataagtagcatcaggataaaattcaccttctttccttagatcaaggtgattatccacagatggctcatttgtcactctatgcaagcttgtgtttaaaattggttgcatttccatgagttcgttagtgtgtagatttgctgtgatagccttcttgagattagtaattgtatcttgtttaatttgtggaagaatagatggcatcttcttaaacagtgacagaccagttactctatcatcatgttgtgtgatattgtcagacatgtttaggagagagctaaatttctctttggtattcatttttgcctcactgatgcgatgagtggtcactgacaggctgaaatttgtctgagtatcttcctcagtgatcatttctttggcctgaatcccatggtttgtgagatccacagcagagacatttcctgactgaagagaagataactgagatcttgatatctggtgttcttgtcttttatacacggtttcagaatcattttttatgatatttggaatgcttttgccttcagtaaatgtatcctctgacagtactttttcagcaaatagtttgggcgggggagagtgttccggtatctttgttggtatgagagttgtacaaggaatgcttgtttcaggttggtatttgtctgcttggcgacactgctgtttcacatatctgcagtagtctgcagatgcttctgcagaaggaataatatctaactgacatactattccttcaaaatggatagaattattattcatacttcctaaagtaaacacactattagaatcaaaggtctgaacttctggaatagtctctgtgctaaaatatttctttccacactcaacaaacattgagacactttggtttctaatagtaatggcaaatgagtgccattgctcatcatgaacactgtagttgaaaactgcaggctgctttcctctaatgtgtactactaattttttaggtagtaattgtactcctaattgcagtctatttttatttctaatgctgaagagaaatgcattgttcacccgatgtgactgtaacccagttaatattgtaaacggctgccccaagttgactggtaaaattttcacgaaaggtgtctcgatataagcatcatttttaaaaatgactcctgattctgttaaatggaccccctgaggtaacggtgtagatgctgatggtacagcagtcgctggtgatgagtgtcttacgtctttgcctccaaggcctagttgatgaagaatatctatgcctggaaatttaaaaaagagagagagaaagaatcttaattttatggattcaagtgttcatataaatgtttgaatatgataaaaatcttccttgtagcaacagtagtttctaaaataagcatgttctatcaataactaattatgggtaataagaaatagggagggggagagtaagacattatactcaataatttgaataaagtacatgcccctccccctacacacacaccaatctctaaacccaaaacttatttattattagtttatttattattttagagacagggtttccatctgttacccaggctggagtgcagcagcatgattatagctcactgcagccttgatatccggggctcaaaggatcctcccacctcagcctcccaagtagccagcactacaacggcatgccatcatacctggctaatttttgtatttttcatagagacagagtcttgctctattgcccaggatagtcttgaactcctaggcaaaagcaatcctcccacagcactgggattacaggtgtgaaccaccacgcctgatctccaaaatttaattagtttatctctcttgttttccattttactgattcttatttgtcacttcaatgaatatacatgttcaaagattcccagatcccatttgtttctttgatttagaacttaaaatttaatgaaatctgtgttaaagtgaaagtggagtcatacttccaaagataattgtgatttggaaaacattttataaattaggttcacacgatcccttaaagtataatttttcaggctgtttttccttctaaccttctgggaatttacaagttgcatggaagctttcccaatgcctactaccttaagtgtgtgctacgcttaaagtattctggttaccaaagtcctttgataattcccggacaaaagaatttaaattcattttattggtgatcactctggtttttctgtcccttccaagcttctctttcttccacttttccagtcctccagagtaacttttatccaacttttagactctttcaatatctattatgtaatacgcattttatataatatggatttgatataattgtggatttctctgatttattattcatcgtaatattaccaatagtatattgtttgtctcctttacccaattaaaagcttctggaaaactggatatgtctgattcattattggatctcttcagcaccttccttgcaaatagttctataatttcagaatgaatgaatttgtcccacagcaatctgaccaggtctcatattcacctctggagtcatataaatttaaatatcacttaaaaagaatgacaaattctgtctttaaaatacagaacagcatagtcagctgcatgatctttattattctttgggttataaatttcccatctgtatctttgtataaatataatcatctccaaccagaaatgttacagaattgtgataagtgaaaaaaataaaagtctttgaagattagccaggaacgtttggcatcaccttactttttccttttgtaggaaattagtagatatttgataatgcatgcttattacaaatagcaaaagataggagagaatctcatttcccaagtctcacaactgtgtacaacaatgaaataattactgaatgccattcctgtgtaatctagcaatgcaattaaaatgttttttaacagagatcttcacaaaacactcaagtgttttattttaaggttagaacaaccatcattttatcaataaaatagttgtaatttcatgacatttttaaaggatagcaatatttgtatctatgatattgtatgacaaacttttccaccaaaatattcctaacaccagtgtagaattatatgcacctccaggaatttagggacatatttcaaagaggccccacataatcaacaaaaaaatacctttgacttcttatgttttatcatcataattcacacaaaatttaaactttaatccataatatggctggttgtttcaatatacaatataaattacttatgagctaaatcagctaattgtactcatccccaatcttcagtgaaaatttacaccgccgaaactagctatgttagtctgtgacattggatatcctcacccaggtttacctaactctaaaggtatgcctagctcaatctgagaagtaaactatggaaggaaccctgcttctgtggaaatcacaatgcttaaatttaaagtatatatgatcataaagtatctgaaagctataattctgagataccaaataagctacatatgtaaaaaataatcatacatgtggtatatcaagggctgcacgctgccccaagaacatctccccttgcatttattaagaacccctgccatctagtgcttcgaatttctgaccctattatacagaaatatcattgggaggagtattatttgaaaactttaaaaagcatatgtgtgttttcaatgtttctttatatgtatattaatatgcttcctccaattctatttttagtggagctttgatgacaaatagctgttttttaaaaatcaaatgtgtttgaacacttattactgaataaatttcctgttattgaaccatgattgcatccctaaaataaaatcttattagttttacgttattcttttggtatctcactggattattgactaatagttttatgtagaatcactacatcaatatgtatgagttgactggtcagtgtttttctcttattgtcctatatttatcagacaataaaattgaaatttcattattttctatagcctaaaacaatttcagtaacctttgaaattacattttttcccaaaaagttacaaaaactcacctataaaccaaattgatcatgttggctctttcattgatagtgcttcattcactttcctaatctcttctatgttaattgatttagtctaattttccactgcaccttgagacaattttagaaatttatatttttctatgaaataataaatttcctctaggcttttacatgtattacccagaaatcttcacataataatcccttacaattatttttgttttcctatgtctgtggccctctgtctcatttctctaattttggttattttgctttatttattcttaagtctgtcattattggtcatttcaaatgtatacagccttcagatttatttatctactatttttgttcattttctctatcattaattttagaatttatctttattaattatctcttcccatttttttttgttttactcttttgctaatctctgaagatgaataattagtcctttatttttcttttcttgcttgataatgaaggcatttaagttatacattttcctgagtgctgctttagctgcatcccatagattttgatatgtagcattttcatttttgttgttttctggaaagtatttttatttgtattttctctttgacccaagtggtttaagaaaaaagttttaaattttcagttaggaaggtctttttgttttctgattttgttattaaaatctaacttaatagtattatgatcagagaatggtgtctaatcagcactttctttttcaaaactcaattagcctcataagtggtcaattttcaataacatttcataagcactcggaaaggtgtttgaaggtacaaaatttaatacataccagttagttgtacctcattgtttatgttatttatatcctctatattcttgtttatttttgtacaattaatctgccatcaactgagagataaagtatcttaccagtagtgtgtctatttggccttttctctcttgtggtctttgctttatgaatattgatgtcatggtttttatgcatagataatcatgcagttcacatatttattgagtactgcacctttcagaattacaaaaagaccttctatgtctagtttattgggttttatatttttggcattaccttaactggtagtaagactaagcttccctcatctgactttctttttgtttacatttgtctgatatacctttgcctttgtttttgttttcatctactgtgaaacactatgttttaggtaaagacaaagggattgtatttgttttttgatccagtctgaattgttttctttgaatgtataaactaaatctatctacatttgctaatattatggtttgtttaatctgttgtattattttatgttttaccactttaattttttgaagtctttcactatgtagtttgtttcctttgctttgctttgtgtatgccttttgagatttagaagggtttgtatttttattctaagggtttcctttaaaattttaaatgtatataatgcccccagtcctttcattacacatatctattaattctttcctttacacaatgttttattttcctccctttaaccctttcccataccttctaatattagtctataggagtatctttcatagtgtttatcttttcattcttaaatatccttatatttctttcatctaatttaccaactgtaaaatatttaattcccagcttcttcagataaggcaatcagcaaagttaatctactcttcctattcttcctctcttctcctaccatttttctgtaattgtaccattcctacattgttagtttgtatggcatttatatttttctttttcccacattttcttttgacaaatagagccagacttttgtagtagcttccccaatcacttctctttggctgaagtttatcctctattagtttcctcaagaaggtttacgggaacaacatttcccgagtgttggacttttcagaattgattttttgtagccttgtaccttaaatttcatgggatataaaattctttcatgatactttatttccttgaatatcttgcagctgctgttccatggttctcaggtagtctttctaaatctgaagtcagctaaatatttttctccttacaagtgactccgtagttatcaacattcttcaagagttgttctttatctttgaaatgcaggaattttataagaatatggcaccatattgaccattcttgataaatgtttccaggtgcatagtatgatcattcattgcacaggttcaaattttttttatttacttcagcaaacttttaatgaattgtatccttgaatattggttctatttcatagttttggttttcttttttatatatatactttaagttttagggtacatgtgcacaatgtgcaggtttgttacatatgtacacatgtgccatgttggtgtgctgcacccattaactcgtcattaacattaggtatgtctcctaatgccatccctcccccctccccccaccccacaaaggccccagtgtgtgatgttcaccttcctgtgttcatgtgttctcattgttcaattcccacctatgagtgagaacatgcagtgtttggttttttgtccttgtgatagtttgctgagaatgatggtttccagcttcatccatgtccctacaaaggacatgaactcatcattttttatggctgcatggtattccatggtgtatgtgtgctacattttcttaatccagtctatcattgttgaacatttgggttggttccaagtctttgatattgtgaatagtgccgcaataaacatatgtgtgcatgtgtctttatagcagcatgatttataatcttttgggtatatacccagtaatgggatggctggatcaaatggcatttctagttttagatccctgaggaatcgtcacactgatttccacaattgttgaactagtttacagtcccaccaacagtgtaaaagtgttcctatttctctacatcctcctctccagcacttgttgtttcctgactttttaatgatcaccattctaactggtgtgagatggtgtttcactgtgattttgatttgcatttctctgatggccagtgatgatgagcattttttcatgtgtctgttggctgcataaatgtcttattttgagaagtgtctgctcatatcctttgcccactttttgatggggttgtttgtttttttcttgtgaatttgtttgagttcattgtagattctggatattagccctttgtcagatgagtagattgcaaaaattttctcccattctgtaggttgcctgttcactgtgatagtagtttcttttgctgtgcagaagctctttagtgtagttagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccattttcagctttctacatgtggctagccagttttcccagcaccatttgttaaatagggaatcctttccccatttcttgtttttgtcagatttgttaaagatcagacagttgtagatatgtggcattatgtctgagggctctgttctgttccattggtctatatctctgttttggtaccagtaccatgctgttttggttactgtagctttgtggtatagtttgaagtcaggtagtgtgatgcctccagctttgttcttttggcttaggatggacttggcaatgcgggctcttttttggttccatatgaactttaaagtagttttttccagttctgtgaagaaagtcattggtagcttgatggggatggaattgaatctgtaaattaccttgggcagtatggccctttttcacgatattgattcttcctacctatgagcacggaatgttcttccattttttgtatcctcttatttcagtttgtagttctccttgaagaggtccttcgcatcccttgtaagctggattcctaggtattttattctctttgaagcaattgtgaatgggagttcactcatgatttggctctctgtttgtctgttggtgtataagaatgcttgtgatttttgcacattgattttgtatcctgagactttgctgaagttgcttatcagcttaaggagatttggggctgagacgatggggttttctagatatacaatcatgtcatctgcaaacagggacaatttgacttcctcttttcctaattgaataccctttatttccttctcctgcatgattgccctggccagaacttccaacactatgttgagtaggagtggtgagagagggcatccctgtcttgtgccaggtttcaaagggaatgcttccagtttttcccattcagtagatattggctgtgggtttgtcatagatagcacttattattttgagaaacgtcccatcaatacctaatttattgagagtttttagcatgaagcgctgttgaattttggcaaaggccttttctgcatctgttgagataatcatgtggttttcgtcattggctctgtttatatgctggattacgtttattgatttgtgtatgttgaaccagccttgcatcccagggatgaggcccacttgatcatggtggataagctttttgatgtgctgctggattcgttttgccagtattttattgaggatgtttgcattgatgttcatcagggatattggtctaaaattctttttttgttgtgtctctgccaggctttggtatcaggatgatgctggcctcatcaaatgagttagggaggattccctctttttctattgattggaatagtttcagaaggaatggtaccagctcctccttgtacctctggtagaattcggctgtgaatccatctggtcctggacttttttttggttgctaacctattaattattgcctcaatttcagagcctgttattggtctatgaagagattcaacttcttcctgctttcgtcttgggagggtgtatattttgaggaatttatccatttcttctagattttctagtttatatgggtagaggtgtttatagtattctctgatggtagtttatatttctgtgggatcggtggtgatatcccctttatcattttttattgcgtctatttgattcttctctgttttcttctttattggtcttgctggcggtttatcaattttgttgatcttttcaaaaaaccagctcctggattcattgattttttgaaggttttttgtgtctccatttccttcagttcttctctgatcttagttatttcttgctttctgctagcttttgaatgtgtttgctcttgcttctctagtgcttttcattgtgaagttaggatgtcaattttagatctttcctgctttctcttgtgggcatttagtgctataaatttccctctacacactgctttgaatgtgtcccagagattctggtatgttgtgtcttggttctcgttggtttcaaagaacatctttatttctgccttcatttcggtatgtacccagtagtcattcaggagcaggttgttcagtttccatgtagtcgtgcggttttcagtgagtttcttaatcctgagttctagtttgactgcactgtggcctgagagacaatttgttataatttttgttcttttacgtttgccgaggagtgctctacttctaactatgtggtcaattttggaataagtgcgatgtggtgctgagaagaatgcatattctgttgatttggggtggagagttctgtagatgtctattaggtccacttggtgcagagctgagttcaattcctggatatccttgttaaccttctgtctcgtggatctgtctaatgctgacattggggtgttaaagtctcccattattattgtgtgggagtctaagtctctttgtaggtctccaaggacttgctttatgaatctgggtgctcctgcattgggtgtatgtatatttaggagagttagctcttcttgttgaattgatccctttaccattacgtaatggccttctttgtctcttttgatccttgttggtttaaagtctgttttatcagaggctaggattgcaacctctgcctttttttgttttccatttgcttggtagatcttcctccatccctttattttgagcctatgtgtgtctctgcacgtgagatgggtttcctgaatacagcacactgatgtgtcttgactctttatccaatttgccggtctgtgtcttttaattggagcatttagcccatttacacttaagattaatattgttatgtatgaatttgatcctgtcattatgatgttagctggttattttgctcattagtttacgattttcttctttaaaaattcgtattatgagtatattgaatcattgttgtcttctatatgtctcatatatcatttctctataatcctttttattatgttctttaaattcatttttgtttgtttgattttcttatttgtctttactgtttcctacaaagtataacttccctttgtgctccttcccatttcatcttgatttatgagataatttttgtatgacttctttactgacttctacaagctcacaattcatatccttttaatatattgccttcttttacttttccctgagttctttcatttctgccttagtatctttctttgtgtaggtgataagggggacatatttggtcagaatatttgtcagtttaacagcaacatttttttgtgtgtacattctcatttttgctgcttttccttacatgtttccttattgtatatttctacttgtgctgtgccaactccttttgctcattaattcctagcctagcaacttatagaaagatgctggcagaagaagaggatgggctgtgacttccaagtctcaaaacccaaaggctctgctccggtactaccagtttcattctaaatggcttctagccccaccttcttctctaaaccaaatctagtccaggaggacttctgcagccagctctatatacaacccttcattctctttcctccatatccactcacattggtatatgcttcagaatgaatccttcatctcagtgagtagatttttgcattttctgagatctgtccccactcatccattttagctattatctgtgcttatttattatactttccccttggcagcttctgccttccccagaccctgtagcacttgtgtacaagggctaaatgtatattttggggtgtgtttctcaccttcaggaagtctggttttgctggtgctttctgaagtctcactattgaccttattccatatggcatctgcttttctgagcacattttggggatttgcagattatattagtcccctagttttgctgaaagtgatttttaagtttattatttcattcatttttttctattgtatgatatccaaggccaaaaatgggaagatagtatctcttggtttcaactttatacttaaagtctacacccatttcacaaatgaaaaatctctgaagcacagagagattaaataacttggtaaaggtcacacagctgataaatggtagcgatgcatttgagcccaatcaatatggctttaaggtctctgactgctccaccacacgacctctcagccattatattccccacaccactccacatatcccttggcaaatctcactaattaatcatggcagtattacttttaccccacagaaatctcagtggggaatactctctagatagccaccaaaattggtacctgaagtgaaatcatcaaattgtcatcctaattttaagctttcttacctgagtatgaatacacttagcaaatgtgtttgagcaagatcttaagagaagagagattaaagaacacttaagggtagaaggcacatatgactggagctgaggagaactgcagacaaaaaaaatgggggtgggcaagagaagaagaagaaaggctttcactcagaggtcagactctttaacatgtaatttatacctggacttggatatcaccaaattacaattaggggttgaatttagatatttcgtaccaatgtttacaagaaataactaagttgccggaagtaaattgcttgttttgtgagtggccctatataaaaaatcaatccagttcatgtcacttggaaaatcagttaccatttaaagaatattaatgatcaacccagcactatattaggtgctttacatttttaaaaaataagaattatagcagcatgtattaaatttccatgtaccaagcactattctaagaactttaatattttaagtcacataatttgcataacaactgtatgaagtaggcactgttgttatctacatgtgagagttaggaaaagtaagtcatagaaaagttaaattatttgcccaagcttacccagctagggagtgcagaggcagaatttgcatgcaggtcatctaaggccaacttcttaacatggtgaaatttaggaaaggtttgtgttaagtaacagcagaactgactgtatctccttcctttatttgcttctgaagtgtaaaataaatggtggtgtcaccaagacaacgacttgttcttttttctataaataccaggcctaatgacttcatccaaaccatggctgcaacaaccacatatgctgactcacaaacctctcttctgggcttgcatatccaattgtctattgaatttatccaatagaaatgagatgtttcaaaagcatttccacttcaatgtattttccccaaacctcatttttcttacttgagtgcttctctcagtgaagagtctcacaaccacacaagcaggcagaacaatcttttcatagtgtaaagtagattatgccagtcttctgaccaaaatcgtccaatggctttccatggtataagacacctatgccatttattctcttcttatctctctgatcacatctcctatcattttatcttacctaattttgctccagccaaactagtattttccttcattcttaaacccacccaactaattttaaactcatggcatttgtacttactgttctttcttgggacgctttaaacccgtgtattgattttaatctgtatccttaactgtgaatatattgattttaatctgtatccttgtattgattttaatctgtattcttaactgtgaatacaacacttcagtgaactctctgagtataacgaattttggtaagttctgtgagtccttctaaagtattactgaggctgagagtagtcttggggaccccttaacttgaagctagtgtcagaagtaagggtggtctttgggacagctctctaactttatactaccctgatatggtttggctgtgtcctcacccaaatctcatcttgaattcccacatgttgtgggagggacctggtgggaggtgattgaaccaggtctttcccatgtttttctcgcaatagtgaatgggtttcactagatctgatggttttttaagggggagtttccctgcacaggctctctctttgcctgctgccatcgaggtaagatgtgacttgctcctcctggccttccaccatgattgtgaggcctccctagctatatggaactgtaagtccactaaacctctttcttttgtaaattgcccagtcttgagtatgtctttatcagcagcatgaaaacagattaagacataccccttacttatttttctcttcactgatatatctgctcacttcacagcattctccactctctgtatgtactcttccttgaatttcttgccataacaaagcttatctgcttttttttttatctcatcccgtcagagccctgctaagtatatcccttcatgccaatctttactcatcctgcaaggctcagttcaagtggttacctcccctttaagtcatcagcgcaatttttgtttgttgttgtttcgttaaacactgatgagaaatagatcctctcttagtatgctaataaaatcagtcttctaagcttacaaagctgacatactatataaacacagacagcccaaacttacttgcctttcatttgaaacttgtagagtaagcagcactgatgttgttatcacaagttagaataaaagaaagatgagggagaaggagaaaggggggggagagggaggagagagaagtagtagatcgagaaagagggatggagaaagagtgagggagaaaggtgaaattaagtcttagtagaggataaaactatgactcataaccaagtctttgactctaaactcagtgactatatcaattgactctgtggggggaatatagtatatgcctaaagaaatagatatgggagatccaatggttataactcattttacaagtacagagaaccaaagaaccattaaatgtgtcaatattcagcgatagtctatcacaaattggaagaagaagaattgtactattatgtttactacctcaaaatggacagatttttacatctcttagtaattggtagtttaaaatacttaaaagaaagttaccaatttttagataaaaaggagtaatatatcgctttataaagtataacaagttacagagttaactcttaactattaaataactaaattaatataacatagcacttaaatttaatgaattctcactgtttaaaattttcatatgtcttgatcagttacatcccaaagctatattctttccagtttgtaggaaagaacaaatatgactgtttaaaataaaatcaccaaatttgcaaatgagaatgattatagacttcgacacacttttctttttcttgccaatttacttaaactgactaaattaactagataattgcccaatattcattttgtattattttttatagtctcagctaaatagtcaatatcagaatcaagactcaaatacagcttcctagctccagttcactgaattaaggaactaaaggaaactgtttaaaataaaccattttattttattttttcaatattatgaggatatgggaaaagaaaaggatctggagtattccccttcttctaatcaaagttattgtatccttatgtaacaggcactgtgctaagcactttacatgtgttattttatccacacgacagccttgtgtagtaagtattactattttcttcactttagcattgttaaaaatgaggctcagagagtatttaagaaacttgctcaaggtcagttagctaataaatggcggaaactgggcttaactctaagatgctggctctggaacacctgtgcttaaataccactgtcacactgggtatgttaaaggtggcaatcgtttcttagaagtattcttactttaaatagcacatctattctgtataaagagataaatgctaatttatttataaaatgagaaatgaagctctaagctgtgtatagaagttttggctaagtgcccatacaagtgtttgtgaagaaaggacttgaagttactgcagctacaatgaactgcttctgttaacaataaacacatttcagattaatttctatgggaaattcttcgagatgaatattctacacagagatttttacacacgtggttttcacacctagggatcatgaacctgagaaagatgtgcatgttaagaattagttacacattatgcatggtgcaagtcattgtagagaagtgttgtagctatgccaacatctcactggcagccatcccaccaacacagacaaagtaataacaaaaatacacatatcaggtaagaaaaggtatctacatctgtcaaatcctcagaaaactcagacttacataattaatttttctggagatagaatcatttattcattagattacacctaaaacttggacataaaaaatatacaatttacatctattaataaggtacttaaaatgttttttcttagctgtgttaaaatttaagggaatttactgaaaccgtgacaaatcacatagatgcttatttcttctcattcttaaaatcttactcaaatgagaataaggaaatgtggtttagaactacagggaaaaagttaatgagtagaagagacaacagcagacaaaatatatcaacaaatttttggaaaatgaaaagcacacgaagaaattaccagagctgaaaaaactgaacctaagggcttcagaggcaaatgctaatgacaggcaggctgattcatattgcaaaatcctgaaaaggctcaagaattgaaggcaccaaatcaatgaattcagcattgaggcttcaaattgggggttgaggatatgtgagggtggaggattgaaagtttgtataagaagtttccagactaaaggagaccaaaggttaatgacatagaagcattgaatcaatcgtagaggaaaatggaagggaagctctgtattgagaagggatttggctaaaattgacatacaaaattgtgagacaatcctccccccatcaacccaagaacctctttatatcactgaactctaataacagtggcaaccaggattatattctacaagtaaggtattggaggatccttctctacatgccttagacatgtgtagcctaacaaaatagtcagacaggtttctacttaatcatcctctatgtgaaacatctcagttaactagcctacccatgcaaacagttgttaagcatatttttagtgtcttacttttttttttttttttgagacagagtctcactctgtcagccaggctggagtgcactggcacgatctcagcgccctgcaacctctgtctcctgggctcgagtagttcttctgccttagcctcccaagtaggtgggattacaggcatatgccaccacatccggctaatgtttttgtattttccagtagagatggggtttcaccattttggccaggctcgaactcctgacctcagataatgtacccgcctcagtctcccaaagtgctgggattacaagcatgagcctcgcatctggccagtgtcttacttttaaatgataacagaaatgttgcatacttataaacaacttctccaacataaaagacagaccaatacaaaaatttagaacaaagacaatgcagagagcagaagaaaagttgaaaaaatcgtcattcttatccttacagagataaaagtagacattgcatcaaagaaacgagaacaggatgaaaaaaaaaaagactagtctcagtgaaaaaacccttaaaaatttaaacacagaggccaggcgctgtggctcacgcctgtaatcccagcactttgggaggccgaggcgggaggatcacgagatcaggagatcgagaccatcctggctaacacggtgaaaccctgtctctactaaaaatacaaaaaattagctgggcgtggtggtgggtgcctgtagtcccagctactcgggaggctgaggcaggagaatggcgtgaacctgggaggcagagcttgcagtgagccgagattgcgccactgcactccagcctggacgacagagtgagacactgcctcaaaaaaaaaaacaaaaaacaaaaaacaaaaaaaacaatttaaacacagaagaaataagaaattaaacaaaatgtttggaatagtaagtgatgaaaaatctcacataaagtagtacataaaacaaagacggaaaataggatctaaaaataagaaaataaagagcccaatactgaagatttaatatttaaaagatattgaagaaagaggaaataaatatatcaggaagaaaaacataacgcaggaaaattcccagaaaattaaggatgcttccacactgaaaaggcctactaagtgcctagcacaatgaattgtaaaaagacctgtaccaagacagattattgtaaccttccaaaacatcaaagataaatagatgatcttaagggattaaaagggaaattaaaaggtcacatataaaggatcaagaattaatataacatcagatttaaaaagtctgcaagccagataaaaaaaggcaaaagatgaaaatatttcaaattctgagggaataatatttacagcctaaaattttatactcacctgaactacctgtaagactgagaataaacacattctcagaaatggaatgttgtaaaaaatgcaccacccaagtgcatattctcaggatgcaactagaggatgtgctgcacccaaataaataaggaaatagactatgaaaaatgacataagacttccaagaaactccatctaacacagatatcagctctactggaagcttagagaactactggtccatagcagagcagaattttagcatgcagaaggaatatctccaagaaaagaatcaaatttctggagtacttggtgcgtttgggggaaaatatatttcaaaatatctgagatttagtgatagtgacatagaacataaagcaaacagaaaaggaggcaatcttgttaattcacaagaaaaaaatataaacgtacatggctcagtgataaaaaaatatacacatggtcataataagctgaattgtgaatattaaattaaccaaaaattggataaaactatattgagagaatagaagtagggaaaggagacacagagaatagtaatgttaagtcctcatcattaataataggaagtcaatataatatttaaacatattatagtattaaatatagatgttaaaaccaaaagaaggtgctaaaagagtttgggcagacaatagtaggagtgggtaaggggaagggacactgctttttgctatatgttttgtcatacaatttggcctttaaactttgtacagtacttgtaattctttgatatacttttttaagttttgaaaaatctcataagcatacaaatatttatttctgataagtctaacttaggataatctctcactcaaacatattcagcagtattaatataaataatatctgtgatcatataaaaacacaatttatctgataatggttttccagtctcctgattagatgttacaaattgcatcgtgccaatttaatcagaaaatttcttttaggaaaaaagtgtttctaagtttctgataatatgctatttccatttctttttttgtgctcaaaaatattcaattttctaaagtctgagaggttttctaaaggacttttctttttgttaagaactggcaataaaattttaggtgtataaaattgaaaattatgatgcttgccctgaaataaaataacatattttacattccataaatgagatcttaagggtgagagaaatatgttgtttctttcatttattccttttgttggttctagatttttaaaaaataagttcataaatatttaattttccctatatctttctttgcatgggtttctaatattttgataataatatctttggtaaattattaaactcataatgccagtggctggcaactgtgaagctagaggacgtctaagggaaagagttttgtcttcagagacggacagacctagattcaaatctaagctgtaggtgagccacttctttgagtctcagtttcttcatctataatacctactctgcaggttcattatgatgattagaataatatatgtaaagtaccagcaaaagagatgatacaaaatatacatttaattaataattgtattcttctcttccttatcttctctgtggctctaggagcctcaattttaaggaatttgtagactttgcagtcaaaatatgagctcaaatcttggttcttccattcattaagcttttacttggaggtggttacctattctccttaatctcagtttcagcaattctatcatggccataattacaaaaccctgtgatgaggcagcagtgaagtaaatgtacattctaatagcacagtgactagtagctcatagtaagttctcagaaacagtaaccgtgataataacaataaattaagagagagagtttttctcctcttcatggctacttcaagctaaatgaagtaacataaatgccttggttaagaatagtttttcatgaagttacatgtgacatgtggcttaatcatttcccataaaagagatttagaaaatgtcttctaagaaatattttaattcatctatgtgatatttgaaagaatatttatctgtatctacttgtcaatttggtcaaccagagtaccactcttcctttttgccctctctctaccttgcacatatttcattcataatttgtttacttgtctttttcttactgttatttgatcaattgatcaaactgacaaggggttcatcaaactgaccactcaactgaaaacttggttctgtaagaattaatgctttggcagctctgtgcagaagagccctttgctacctttaaggcagaggagaaaaacaaacaaacaaatctgaggccttggtaatattatctgtaggtccagcacagttctaggatttgtctctttgactttggtatgttttttacctttgataaaggcatttttttcactttgatgctacagacattatcttatttacatttccaatcattggcaataggatattacacaggaaatagaagatgcatcaatcatgtttaaatgaatgaattaggatatacatagactcctgaaactctatcatcatactaccagagtaattaactagtaggcacaaacaaaacaggtttaggtttattttctaaacctctccatttgaattacatagaatcctaagcccactagtatgcaaattccattttgtttcttaatgatgcaaatctggacggaacattttttatatgcttttgttgtatcaagaagtgcaaaggtaattcagtcacagtttgccacccccaagaactcccacttaaaatgaagtcacaagcaaagcctttttattgtacaaaacttcttttttatagagtttgcttaaaaatgtaagcaatttcacagacggaagatatgagtaatttcttaaaggtcgtatttcccctcaaaattggtttctttaatcttacattctcatggtactgggtggaatttttgttattgtttaatgttgaatttacagttataatgagttgaaagttatgtacttttgctgtctggaagtagaatttttaagtaagcaaataaattaaaaggtaattttcttaccttgttcttgtgcatgaacaaccaccccagccacacatagtacaataaaatgaagaagtgatttcctaggaaaagaaaaaagcatttgggaaaaacttactagttggacatttacaaccatatagaatccaaaacagtctatgcaagattaagaattaagcaattattttaaatagcatgatattttaatattcatagtggttaagaccaaaggctctgaagtgaaattccagttttgccacttactatgtgacttgggcacatttttaatcattctatgccttagctgctttatctgttaaacctatctcataagattttctgaagattaacttaaaaacttcatgtaaagcacagaaaacagtacctggcacataggaaacattcaataaatatgaactagtataggtggtattattatcatatattatgttaaattaccatatatgcaatttcatacaaagtaatagaaatttccacaaaaataacgcaaattacagttgcttaactatagtgattataagttaatggaaccagctatttatttgtttaatggttatatgtgaaagccatttgaatatcatacttaaatcactcgtactagattcatgattttttggttttgaaaatagcaatggcctgtagatgtcaacattgagcattttgattagtagtagctatgagcacaatacccaatcactacaaattaaaatgtccattagtattgataagctatctaagcaaaaatgttttgtgacattgctagtataaccaaacttttaataaattttgttgaacattcttcataattggctgtatctacctccaaaatgaaaattacagaaataattttgaagagagatgataagcatgctgaaaacaatacttcattacctaattttgctaatatagaccctgattctgtttttgattctaacccagggactgttcaaatgatgtatttgtaaaatgcagttccgcaaggagtgattatggagctgtctataaaccattaattcccttttattaaattcctgatgtactagtagtaattggtacattttctatttattactaataagatgttttttacctttaccaactagtataaggagcatcttaatgtaagaaagatgatctttttacaaagcttaagccagcaaatatataattcgactatttataatggaacacaaatttcatttgtattaaaatggtatttatcctttgttagtaattttaaaattgaacattctatggccgtactcagtccagagcacagctcttataagacaaggtttcgatagaatacttaacaactgtcactaactctacaaacagatcaactgaatcattgcagagatttcagctgatatggataaataactaaaccatatattctaatgaggcctatgaaacattcttatatatggcattattcatgtagatggatggttcccaaatgttagactcacctgaggaacttgtaaaaaatgcagattttgggccctgacacagagattatgattcaaaaatttgcgatggatatgcaggatgcatacattttaactaggtgattctagtgcagattgtacgtgtgccaaactctgagaaaaaactatttagaacattcactgtgtttatatttacaatgttattaaaatacatctaaattgattttacttttgcttaaatcacatatatctaattttataacatgacatgaccctaaaatattatttggcccttttaaaatcctttcctactgcactaggtcagtggttttcaaactttagtgtgatcagaatcgcatgaagcacttgtgagcaatcactgggcctcacccccagaatttctaactaagtatgtctggggtggggctcaagaatatgcatttataacaagttcctgggtgtactgacgctactgatctgggactacattctgaggaccactactctaaaataaatgaccctcaagagatgatataaagtcctcctgtttggatctttttaccccttggctgcacactggaattacctggggagttttgttttgtttttgtttttgtttttgctttcttgagatggagttcgctctttgttacccagtctggagtgcagtggagcgatctcagctcactgcaacctctgcttgccaggttcaagcaattctcctgtctcagcctcctgaatagctggaattacaggcgcctgccaccacacccggctaattttttttttattatactttaagttttagggtacaagtgcacaatgtgcaggttagttacatatgtatacatgtgccatgctggtgcgctgcacccactaactcgtcatctagcatgaggtatatctcccaatgctatccctcccccttccccccaccccacaacactccccagagtgtgatgttccccttcctgtgcccatgtgttttcattgttcaattcccacctatgagtgagaatatgcagtgtttggttttttgttcttgtggtagtttactgagaatgatgatttccaatttcatccatgtccctacaaaggacatgaactcatcatttctcatggctgcatagtattccatggtgtatatgtgccacattttcttaatccagtctatcattgttggacatttgggttggttccaagtctttgctattgtgaataacgccgcaataaacatacgtgtgcatgtgtctttatagcagcatgatttatagtcctttggatatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactgcacacccggctaatttttgtatttttagtagagacagagtttcaccatgttggccaggctggtctcgaactcctgacctcaggtgatctgcctgcttcagcctcccaaagtgctgggattacaggcatgagccaccatgcctggcccacctggggagttttaaaaactaataattggatctttctctccttgccccacagagattctgattttaatgtgtccataacacaggcattttaaaacattttccactgattctaatgtgcaaacaaggttgaggaccatcacgcaagattaaaatgatgtgtgggctctccaggatgtatcctaatatgatttagagcttgagtaaggaggctatttacctttcaaatttatgtttcaacatataactggcaggatacatatcagcgagactagaaaactgcttacttaggattacagtcaatgaaggatagtgcatctcaattatgctgtcttaagtataaagttgaatgtgaatggaagcatgtctcacctgcccaaggtaatcagcctcactcagatgcatagaaacaacccaacaggcacttttcccttaaaaataactaatgacaagtacaacagccagcactactcatttagcaattcaacaaactcataaacttccccaatgacctcagtggagaaaaatggaaataaacatgttaacaagtccattcctggtgtgaggcaggaaaacctgagcacatcaagcatcattctttagacaggtgatcctaggggattatgacaaaccagttgagccataccttgcataaatgtacctgtgtatgaaagctgatgactaatggactggtagagatcaatgactgaaatagattctctttctctttgtctagttacaaccaaaacaaatagcgaactgaaaaagaacaggtaaagtttcttacaatgcattcaagacccttattatttagcttcaatttccttttttagcagtatggatcccactacccctgatatctccaaagttccagccatacaaagttattctccatccactggaaagaccttgtatatgtctgaaatgccctaccagtctccacttaccattcttaagtacacccaaagcctaattaaatcaatacttgctccatgaagtttcccatcatctctaaaggggaatgaatctttcccccacctctgtacttttgatacattaattgtgactttgttatactcctataagtcctaccttttatgaaagtaaatatctgagcaagcagcaggtcttcatttttacctctagtgtacccatgtgttacatgaaattgacagtaaatactttttaaaaggaaatgatcaaaagtattatctcccaatgactgaggaattcactttttccttatggacttgattcttttaacacttggaaaaaataaaataaaatacaggcaattttagttagatgtccaaagaaagagaagggaaatagaattttttaaatctgctatggtagcatatatggtagccttcttcttttttttcttaattttcattttagctttcttgtctctgaagtgggtacaacagagaaaggatgaagtttcattgacatagtcagtttgataaagagccaaaccattattgtatatgggtatttaatgaatccaagattcttgggaaatgtctgatggactaggtttgtttgtttctttggattttcctccttatgatgttacatttattatacatttcctcaacaaataaaacttatcaagtttccacattagcagtagatggtagagtcctctatggaagcagctgttctttgtccttctgggtcttagctgactcatctatcatgtgatgacataatacaaattttatgtttttgtgttttacattccaaatgtaaaatcctataatttgtgtgtgtgatgggatcacattagtatactggcattaaaagacaaaaagcaaattacttagcaaaatgttatatatataggtgtgtgtgtgtgtgtatacacatacatatatataaagggtttgtatatatgtgtgtgtgtgtgtgtatacacatacatatatataaagcgtttgttatttaaccacaaaactgtaacggtcttcctatagttttggtccaatactatttaagtaacctaaaatagtctactaagttgttaattcattcatatatttagtttactcccacaaacagtctagttggtatattaaacatgaacaatttttgaatattcaaaacatgtttgttttcattcactggtttgtatatgtggaccatgtgtcactaatacaaagttatagagttatagttactcagacatttaacaaaatcagaccatatccaaaataaatcaacaatatggtaacaaacacttcataaaggctcaaaaaatataacccaagatattgatagctaacaaaataagaaacactctgcatgagtctggctgctagtcacattttcactttgacaccagcaacagtccaaacataaccagacatgtgagggtaaaggcctaaagaggataagacagaaaatagatatccaaagaccatactcagaacatgtaaatgactaatacccattccaggcatcgttcctagatgattcttagagctattcaacttcctctttattcaaaagatccaagttgctttaggggaatccgagggatcttttgcttagggtacccctgagactctaaggtattataacttatgtcttcaggctactgatgctcacttctacatagattcaatttataatagtgggaaggacttgtgaaatcttgtgaatagacaactttttatgagttggtggccttcttttaaaccaattgaaaatggtgaacaaatctgaaagacacacacacgtgatatacatcaataatttcaacaatttccaccacgctacgtttacatgccaaaaacttctctaagtcatgacagctttacagattttgctctttactagctactaagatcgagaaatagtaaaatttctgttctttcctctcaaaataactgaaaaaagagttttcatcacagcagtggacataaagttggatgattcagggagcaaagtagtactgtcactaacttacttgcaattaatttttcagactattaattcaactcaggtggtagttatatagctaaaccagcatgaagcatactacaggttgagcacccccaatctaaaaatccaaagtcctaaatgctccaaaatctgaaaggttttgagggctgaaatgatgccatactggaatcattttacacctgactttatgggtcacagtcaaaacttcatttcatgcacaaaattactaaaaatattatataaaattaacttcagtctatgtgtataaggtatatatgatacataagtgaatttcatgttttgacttgggtcccatccccaagatatctcattatatatatgcaaatattccaaaatccaaaaaaattcaaaatcccaaacacttctggtctcaggcattttagatgagcagtactcaacctgtagagcttttggttaaattctaagcattcaagcaattcatgcagtgcaagggagataaatgcttaagaacttcatttaatcaaagtgtctagagtccagtcagtaggagggaagaaaaatacatctaaactagtctgtcctagtaataccacagagaatgttaaactattgcctagcttagtaaagttcctggcacatactagtgttagataaagattttcaagtgaactaatgaatcagataatcttcagtcaatgaaagtatcaggtggtcttgagtttcaacaaatacataacttatctagcatcttctacctatacactcatcccaaaatcaagaaaagtcaagtctccccaacctctgcttgttaaacatggtttaaaggcctttccaaatctggtctctgtttatctctccagctccagctccagtcactgcttccctagaatgtgtactccaaccaacttcatttctttcaggccctcaaatgcactgtgctgtctcacttctgagctttttattgttccttctgtctggtaaatttcatgttcttttcagtaaggtctcagtctagatttcatttcctttggttaccttttccttccagtattatcctttcctcccctacccacccacccaagactgctaggtgcccctcatgtatatatcctcctctcatttcgttatacttggttgtttcatttgctatttcctttattagactggagagcagcaactgtggatctgtcatactcaatcattgtatctctgctgcctagaaccacactgggcccatagttggagctcagtaaacatgtgttgaataaatacgttaatgaatgatgaataaatgaatgacagaataatgttagccttttatgagaatgaaaataaaattgtctttacttctcattagagttacaaattctaaaataagtcatagttggaaggcatggcaaggaaactagcacagctattctaattcccataataacatttacttttattctgccgttcacaaattaccaagtagaatgtctaaatgacactcaaaagtactttccataaattagatttactctccctgagacatcagcttattttaaaaatttatttgaacacaaatataactaagcaactttaaaaaatagaatttcgtgccatctaggaaatagatctttatattccaaaattcctttttggttataaaagtctttaattaccataatagcctgcctcagagaccttctgataatatgtcaaattaaggtatctaaagctgactttgagatttcattaattttattaattctacaaattcacgttaggcaacccatataaaagaccccacaaaagaaagtgtcgtaaagatccacttttaaactggaactgtttttgggtgactaataagaactgtgattttaaaaagcgctccctctcttacaaaacatcaccacaaaaggaaaataaaactcagggatttcatcagagactctaaggtttaattcagtggcctgacattataaatcagctacttcttccaaatccagcccccccgccccaccccgcctcaaactccgaagggttggtggcattatttttcaaagggaaaaattccaaattatttatgaaaattggattttctagaaacaattttttcagtccaatcattagctatctttcccaagtttgcatgtgtggttggagctgtgagttctgtaatctgatgtaattatgaattacccttaattctctgcagcccatccccagtggcccctgtaacagaacaaattggatattatgagataaccaagggctgcaaggcctctggtggtcatgggagacaaacaccttcatccagaacctgctacttatccccatgtctctgcacaagggttctcttcccattccacgttttataatttttcttcagaagttcctccggtgcaatccattctatttggtttctctgcctccctccccccaaatcatctggacccaatttacaaaccccaaactgcccaagaatttatgcagggccttttctgggagcgtctggaagggaagtgtaaaccagacaagacaaaacccaggagcagatctgctttaactccggtggttggtcacaactaccaaggggagtgttagtcaccagcgtgggcctcgcgcggtggcagagggaaagccctcggggcaggagctgcaggagggccgcatgcggaggctggctgggcaagaagtggagggcctcactccgcctctcctggagtctccaggctggcagggctagagcctctctgcatccgcccctgatcagcgggaagatctgtcagttccgcaggatcggctgcaacccccgactctccaggctggtccacacagagggatgtttatcgagaacagtggcgggaaatcttctgcctgggaaccccatgcgacctgcgtgagccgctctgagaaggcaacccgcagagcttgacctctactcgctccagggactccccagcctccagcaccccgctgcccgcacggggttgaggagattgggaggtttcctcttcactgttgcatggggatgggggtgtgcggggaggtgcatgtggtcagctgggaagcccagcagcgaggcttccaggggtcggaagagagcgcgcgcgcgagccccagccaggctgggctgcacgcggctgggaagcacatgttcatacaaacacgaccacaaggcgctctttctccgcaccctgcctccgcctgccctcagctgacacggtcaattctgttccttgccctcctcccacctagcctcctgaggggcagcctctctgcagaagacttccacagccgcgttcacccttctcgcccaggggccagaagcaaacttgtgtaacccactgacctcttccagggggaccagggcatccagccaaagccgcgcaacccctggtccgagcccttttcccagggaaggcatgggagcaggtacagcgcccaaaggggaggtggggtgcccgtcaggacccgcccaaaacctccgcaggaggggcaggcccgcccccgtgtcctgctcccctccccagtccccgccgcgagtgccacttccccagtgacagggcaatgatcagggcgcagcctcggctcggatgggcaacgtttgttggccttctaaccagaggggattgcctctgagcccgtgggtaaaacaaccccccgacgcccgaggttctgcagccacccccttccccccgctggcgacccttcctcacgcctgagtccagtggtccaggctgcgcacactgaccctgggggacctctagcgtcacagcaatcgccaggctggacgccctgagaagcacctcggggaagcaggacctcgacagggccctgcgggaggagaaggggaggagggcgcgagggcggcgggagctggagccagagagatcgtcggagcccagctctggagcttagggagccgctgccctggacctcgggactcgcgccagcgagcttttcctctcgagccaaaagatcgctttagcataaactgtctgagatctgctggcacgaggcatcctttcaaacacggtattttgcaagctgagaagacaaggggaagataccgcgggtactcggccgctcctaaagccaaaaagtgccaaggagccggacttcagatctccatcaggctcagcagaaccagggggtggagagaggggttggtctaacccctaccctacccggcgggtgggctacttacgtttttgccgtgggggagacttttccacgccttgttctgtgggctcttaaatgcatttgtatgcatttgtccgtgcagcaaagcgctaacggaaaaca

SEQ ID NO: 751 - DNA, 2939 bp, Homo sapiens
ggcccatggccgcagccctggcgctcgtggcgggggtcctgtcgggggcggtgctgcccctctggagcgcgcttccgcaatataaaaaggtgagccggggagcgcgcccagccggccgcgaccgcaggagagggtggccccgccgccggggcactggagcccgaaggcgccgggcagcctgaaagggagaggtgggtccggaaccacacccaggcgggtagcctggggcatcctcagacggacttcaaaagccgcttcactttcccctggtggcctcagaggggagagaaattggcctatgaccagcaccctcgctccctccacctcccccgcccgtgccccttccgatggcctcagtcctgggctcgcttccctccccaaactgctcacaggcaaacccaccctgcatgctctggtttctcctcctcttcttccacctcctctcactgtctagtgattcttccaggcacgagggctctccccttttctcctctttctctccctctttttcgagcccgcagccccttcattctcatcccccaaccctgccccgcaaaatgggacttaagagtacacaccccatgggactcatggaggtgaggggggtccaggaaaggagaggccgagggaaaagtgctaatccccctctcctcctctctgctgccctgggtcctgctgaggggccggggtggggctggggggggaaccagccccccaaggggtgacaacctcatgacttctcctggatccctgggctctttggcaatggtgggaaccctcccctacccgcccacacgactcagggattgctcccagcctggcagacattctgcctgtccccacagaaaatcacagacaggtgcttccaccactctgagtgctacagtggctgctgcctcatggacttggactccggtggagccttctgtgcccccagggccagaataaccatgatctgcttgccccaggtgaggccctagtatggggcaacttctggcaagtagagaagcgggcagggaggttaaaaaaaaaacacctggccccacctgttttttcacctctgtctggagtgcccttcttcttctccacttggcaaactcctactcatggtgcaaaacaactccagccacctcctctgagaaggcttccctccttggagctcctgtaccctggggtcagaccctcagcagaccatgtatctccctaactggccatgtcttttctctgcctctcccagtggttggaactcttcaagggcagggatcgcatcatattcatctatgaagcacctacccccagcttagtatctgcacatagtaggtgctcaataaatgcttattgttgtttgtttgtttgtttcgagatggagtctcgctctgtcacccaggctagagtgcaatggcatgatctcggctcactgcaacctctgcctcctgggttcaagcgattcttgggcctcagcctcccgagtagctgggattacaggggtgcaccgctatgcctggctaattttcgtatctttggtagagatggggttttgccatgttggccaagccggtcttgaactcctgacctcaggtgatccacctggctcggcctcccaaggtgctgggattataggcatgagccaccgtgcccggccaataaatgcttgttgaatgaatgaatatctcttctctcacaccactgaggcagggtaagtaggaaatgaccttccccttactagtccccatctccctgccacagtgacatgatttcttgagaggagcatggcactgcagtggcaggaccacagctttgcagttggacctgagtttaaatcctgacttttccacaccctatctttgtgacttcaagcaggtcatcatggctctctgagccttagtttcctcatctacaaggagaggctaaagtacctaccccaccaggctgttgggaagattatgtggtcctggcaaggagagtgtgcagtccagcatggttgtcactcgcttttaggaatgcagggagcagaatgctcagtacgccctgttcctgcccacctggccctgggcccaaacctttctaggatggatggacccagcctctatgtccctgtgtggggagttgccaatgccctaaggaagcagcagggcccctaccatggcctgaccctatagctgaagtggctagagggtttttattttttttattttttgagacagagttttgctcttgttgcccaggctggagtgcaatggcgtgatcttggcccactgcaacctccacctcctgggttcaagcaattcctctgcctcagcctctggagtagctgggattacaggcatgtgctaatttttatattattagtccatgaccatgttggccaggctagtctcaaactcctgacctcaggtgatccacccgcctcggccttccaaagcgctgggattacaggggtgagccaccgcgcatggcctaaagggtctttttattatcaccacttgatctgctctatctcatttagtcctcacaacaaccctatgaggggggttactattactgtccccatttgacagatgaggaaaccgagctggagaggttcattgacttgctgaaggtcacgcagttataagctgtagagacagcccaggtctgtcttactccaggcctggtactcttggttctggtccccaagaagtttaagtccccatccttcctgcatcctggtgactcccgattctcatacccactccctgcagaccaagggagctaccaacatcatctgcccttgccggatgggcttgacgtgcatatccaaggacttgatgtgttcccgccggtgccatatgatttagaggaagatgcaggctggtcactgctcccttggggccataggccctggttgccaccaacttgctccaaatccagctcctgagacattaaagtcacttcctgtc

SEQ ID NO: 752 - DNA, 7012 bp, Homo sapiens
tggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctaccca

SEQ ID NO: 753 - DNA, 2364 bp, Homo sapiens
gaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggg

SEQ ID NO: 754 - DNA, 2364 bp, Homo sapiens; identical to SEQ ID NO: 753

SEQ ID NO: 755 - DNA, 2364 bp, Homo sapiens; identical to SEQ ID NO: 753

SEQ ID NO: 756 - DNA, 28430 bp, Homo sapiens
cggatccggattcggattagcagcccgggaagagtgccgtggcacaggcgccggagggagcgcgaccctcggaccccgcctggcccgcggggctgggacccggccccggcctgcccgatggggcgcgcggccccggagatgcgccctcgcccggccccgcgcccccggccccgcgcccccggcccgcccgccccggcccgcgcctccgcctgagtcccccgcgccttggcccgccaccccccgccccgcgcccccggcccgcctgcgccatggagcccggccgcggcggcacagagaccgtgggcaagttcgagttctcccgcaaggacctgatcggccacggcgccttcgcggtggtcttcaagggccgccaccgcgaggtgaggcccccgtccggcccgggatcccccgcccaggatcccctgcccctgcatccccgccccgagattccccgcctgtcccgggacccccccacgcctcccgagagccccactcgactttccaggccgacccccaccccaggatccccaccccgcgacccccagcccgactttccagttcagactcccgccccgagatccgctgccgggctttccagcccagatcctcactccgagacccccagcccgactttcctgtccaaaccctcaccccgggacaccccgcaacctggtcccacagccggctttcgaggctggatccctaccccaggacccccagcgcgatcctcaacctggctccccactcggccttccagtcccgggattcccaaccgggatcatctcagggccccacctgtgtggactggggtctgggggaggcctgcgaggggcagccctggccttgaaggtgcacgtttggctttcagaagcacgatttggaggtcgccgtcaagtgcattaacaagaagaacctcgccaagtctcagacgctgctggggaaggaaatcaaaatcctgaaggtgagccagtgctgggggagggggcgtgggcgtgggcgtgggcaagcccccctccccacactgataacaaacttgggtttctgtcctaggaactgaaacatgaaaacatcgtggccctgtacgacttccaggtaaggcctctgggctgcggtctgctggggaccgggctgggggactgtggccccaggtgctggatcccctggtgagcactggtgttgagcctgtccaggctggggtctactgggcccctggagactccaccctgggtccaggcctgggctggtgctggctcttgctgtgacttccccagctgtgagaccggggagggggtgtctgggccgcagggcgccccagggcagggctgagttctcctgaacaggcatcccctccccgccgggcgtcagtcctaggggccctgcctgagtccggcgtccccggctggccctggcagcactgccggcctggcccacctgtctaggccgtgtgtttgttgacattgctcctgcggccggcattggccggcctcgctctgcgtcagacggggcgggggaggggccgccggagactcctgctcgctggcagtcagggccgggccggggcacaggcggctgccgctggctggccaaggagatgacctcgggcccggctggccccaagaagcaagcggtgggaccagctggctttcgtgctgcctccgtgtcccggggcccagggcaggcagggctggggctgtgggagccagggtgccgtcctggggaccaggaacctgaggcgggagatccgccccgccaaagtgctgactaatggctctgtgacctgtttactgagcccagggcccagcccctggctgagggaagggctggcaggccgtgttttggtggcctcctccgtccgcctctcagagctttgctgtggccttggggaccgaggcttgtcacaaggtgccgggtggggggggcccaggtccagcgagtacctggaaacccaggcacactgtgtcctggagctgggccatccctcctgctgcttttcccgccctcttcccaccccttttctccctgctttcctccctcccttcctcctctttcctcatcctctccatgtttggaagcctcctgcctggaccacagcctgcacatgcgtcatggctctgggagccagcaaggagtggacagctgtccctggccaggcagcgactctgagggactccccctccaccctgggctacactgcctgctgctcccctccagggctccccaggtccagtcctgggcatctccaggccaggccctgtgactgtccgcacgacccccgcagacccgggaccagtatccccaggcccagctccatcccagtcagccacacacacctggttgtgggcatctgccacttcctccagtgttggcaactctgcggctttctctactcaggaagcacttggagccgccagctgcaggcgctcctgtctccgggcaccgggctctgctggagctgcagcttagcctgccctcgcccccacaggcgtggggattgttgccctgtgtcggtaaggcaatgtttgaggcaggcacccaaacccaggaaaaaataactgggttttaaaaatggacaatgaacgatttgggtgataaaagaaaatcctcaaacattacgggagggagtgcggtcgaggctagagtcctgcccccgatcgagtcccgctgccctccgttctcaggcccctgctttagttgtttccgggccaccggggacagccatccttacaaggcgatgtgttcaccggtgtccttccccgccacacccacctctctgcgccgtgaattttgtcacttaagagtatagtttgcactccatccagcctgggcgactgagcgaggccctgtctctaaaagagtagagcttggggaaggttctgtgctggctcaatccatatcagaaagtttacccctcggccaggcacagtggatcacacctgtgaccctagcactgtgggaggccaagacagaccagcctgggcaacatagcaagactcgctctctctaaaaaaaagaaaaaaaaagaaaaaaaattagccaggcatagtggcatgtctcagctactataaaggttgtaggaggattgattaaacccaggagtttaaggctgcagtgagccgtgatgttgccaccgcgttccagcctgggcagcagagtgtaaccctgtctcaaaaacacaaaacaaaaccctcaaaaagtttacccctctctgttagaggtcaccatctgtaagcacagtggtcgagagccaggctgacgctgatgaggggcccagtcctggctgccatatgtgcacacacagcttctttagtttgcggtcctatttcttcctctgtgaagcagaaagcacgggctgtgagggctgtgtgagggaggagggagtgctctcgggttggaggagccatcgtggaggtgctagctgctggcctgattgggtctgccgtggtgattttcagccatggcgtgcctgttgcccgagattccataactgatttcaccaaggccctgtaggtgggacatgaggttattttgggatgctggtacatcagggtggttgtgactggatccttagaagtagaatccttgggtaggagggatgctggtttttaatttgggtagctattgccaaatggacctccggagaggcaatgccactggtctctcagcctgtctccaagcatgtgtctccctaggtccttgccaggagggtggctctcagaggtttccatcgtggctcatgtgagaagtagaaaatgacatctcttatggttttgcttttcttttttttttgagactgagttttgctcttgtcgcccaggctggagtgcagtgacacaatctcccctcactgcaacctccgcctcctgggtccaagcgatcctcctgcctcagcctcccgagtagctgggattacaggcgcctgccaccacgctaggctaatttttgtatttgcagtagagacacggtttcaccatgttggccagcctggtctcgaactgacctcatgatccacccacctcggcctcccaaagtggtgggattgcaggagtgaaccaccatgcctgggcggttttcttttacattggtgatgaatgagcttccctatccgagcatgggaatgttagaaataccacctgtcctttgtatagtgtatttctttttttttttgagatggagcttctctttgtcacccaggctggagtgcagtggcgcgatcttggctcactgcaacctccacctccctggttcaagcgattctcctgcctcagcctcccgagtagctgggattacaggcacctgccaccacgcccggctaatttttgtattaaaaaatttatacaattttcgccacattggccaggctgatcttgaacgccggacctcaccttcgacctcccaaagtgctgggattacaggcatgagccaccatgcccagcctgcctgatatatttctatattttatatatacgtttttctgagatgtagtttcactcttgttgcccaggctggagtgcagtggcaccatctcgactcactgcaatctccgcctcccgggttcaagcgattctcctgcctcagcctcccgggtagctgggattacagacatgcgccaccacgcctggctaattttgtacttttagtagagacaaggtttctctgtgttggtcaggatggtctagaactcccgacctcaggtgatccgcccacatcggcctccgaaagtgctaggattacaggcatgagccaccgcttctggcctattttaatatattttttaaagagactgggtctcactctcttgcccaggctggagtgcagtggcataatcatggctcactgcagcctcgaacacctgagctcaagagatcctcccacttcagcctcctgagtagctgggactacagatacgcaccaccatacttggttaggcacatatttctggcaagctcttggtcccttttgtgccaaggctggaagggtaccatgcttaacaccatggcccctgagccattctgccatttgctggatcctagctccaacatttacctgtgtgacattgggcaggtagcctcctggcacctccgttttcttaccttttaaaaactgttggctgggtgcagtggctcacgcctgtaatcccagcactttgggaggctgaggcgggtggatcatgaggtcaggagatcgagactatcctggccaacatggtgaaacctcgcctctattaaaatacaaaaattagctgggcgtggtggcccgtgcctgtagtcccagctactcatgaggctgaggcaggagaatcgcttgaacccaggaagtggaggctgcagtgagctgagattgcgccgctgcactccagcctgggcgacagagtgaaactctctcaaaaaaaaaaaaaaaaaaaaaaaactgttgtggttgtgatggcatcttgagtatgttaagtctttagaactgtgcctgccactttgtaagtgctctgtcaatgttcttgaaaggtaggtgtcctttatatatgaagcaaagtagcttctttgtgataggttacaggtattccccgccatgttgtttgttgactgttgaggttgttatttttgttcttattgtgttgggttttgtgtattgggtttcttttttagccatacaaaattgtgaaaatgtgagtgcctgggaagtgtgtgccttgggtcacgctctttgagtccaccacagccgctgggaggcggctggagcacctggggagcacctggcctccttactgagcatgtggtgtccctgtctggacttgcctggccccaggagtgcggccaccacagaaatcagggtatagggctgtggagccaggctgggatcctgcccagcatgccctgggaggagggctgatggctactggccttgctgatggtggcccccctggccagcacgccatctgacaggttccttgcagctaaaggtcttgctgggccacccaggtgtgactcactcaggccctgcagacagagccgctgcctgtgagttacttgcagtggagacctgagtcaagaggtgtccagccctgcttggggtcctgggagaccatgggtccaggcagtccagcccagcatgagactgtaactccccatcccagagtgaggagggggctgccaggcctggcctggtctggccggggggctgtctgcagtgtgagttggggcaggatgcaggccgagtagaaacccgtggggtgggtacccagctcctgggcaggggcctgtgaaggggctcccagggcccaggcagttctggaattacctccgaagttgtgtatatctttttttttttttttaactttgaaaacaatgggatgagactgggcacagtggctcacgcctgtaatcccagcactttgggaggccgaggtgggcagatcacctgaggtcaggagttcgagaccagcctggccaacatggcaaaaccccatctctactaaaagtacaaaaattagctgggcgtggtggtgggcgcctgtagtcccagctacttgtgaggctgaggcaggagaatcgcttgaacctgggaggtggaggttgcagtgagctgagtttgtgccactgcactccagcctgggtgacagcgagactcgtctcaaaaaaaaaaaaaagaaaaaaatcatgggataaaaatactggaaagtgcaaaacagatgagaagatataccacaacaggccctgtgtggcgtagcaagcgccagcccaaagccatgcccgcgtcccgggccgctctcctccctcctatcgagggcacgtccgtcctcctgtgtgcccccctccccctctgctttctcattcttcacgtgagccagctcctggttcccacacgctccctttgccacatgctgactttaagcctggaggtgggatgtcagccgtaggttgaggggtgctgtgtctccgtgggtgacaggagttggtttttgtttgtgcgcagcaccccgtggtgggactgtcacctggtatcagtatctgtccgcgatggctgggggtcaggtctcagccacctgaaggacagagctgctgggaacagtttttactggggtgtgcgccaactaggatggccgggtctcggggggaatgtgaggagttggcgtcttcctgagggtctctgcagcttacaccccctgcaccccccaactcgcactggggttgtttcctgctttttccaagcaaggtcgtgccctcagaagggttgggccacccacccctgcctcactgcatctagggacctgcctcaaccccctgcggctggctcccggattgtccagacccccaggcccagcaggcgggaggctgcagaggtcagccttgggctgcagccccaggaggcccatacacaatgggcggctgcaggtggttccccagggccagagggtggcccttccttcttagggtggagccggcatcccttcccttttgggagctgtccaggagccccgcctgggggtgcagagtggttctgtccagccacagctgtggcttttgccactttccggagccagctctggaggtgtgaactaggtcagtgcctgctcaccaggcccagcccaggatcaccagacaagagtagggctggcagagggtgggagcctggatcctattaagtaaagcaccttagcaccccaggggtggggcagcctcctacgtgcccagacacccgtgccaggctgcctgggacacctggctctggccggccgtgggtgcgtgtgtgcagggtgtgggggccggcctgcctggggagtgctgtcccaggtccctcaggcatgctgcctggagacagtggggtgttgatattgctgtctttttgaagtgttctgagcctcagatgcatgtgttgggacttttcagggacagccctgtggaatggtcagcagccgttccctgtttcctccctttaaataggcggcaagttgggacccacctcccggggtgggggtgatggtgcagggagcctggtgtgtttgattagggcatgggcggtgtggccacaactgtgtgtgtcaccacgggacggacccccggaccctgtcttgggaggcgagctgctctgcctggggtggccggtttcctcccctggagcccagggaggcagttgtggccctttctggtgtcttaactgggtgacttgattctgggagcttgcccggtccccactgcccagggtagcttgtgaaaaccaaatgtagctgcgaggcagacgtggagcccgatgccctgtgtgggttctgcaaggcagagctggagcccgatgccctgtgtgggttctgggtgggcccaggggaggtcagctgtggccggtgaggctgtgctctcacctgacccccctcaagagccctagagagagtcgctgcctgtgggaagggtggacaggcccagctgggggcccccgtcggggggtgttgtggcgcagggcctgggcctgcagctgccctggaggagctcccccagccctggcagaggtggtcctgggcttgtttgtcctcacttctcatccctgactctgccagggttggagacagcaaggctaggtccttccggggacacagagggtgactggcttggcattggcactgggcagagtgaggacaggactccagcccacctgcttgggctgtgctgccatttcccagcctgggcacgcctcccaacctctggggcctcagtgtgctcgtatgggaagtgggctggttatggcctgctgcctgggctcctgcagggctggtgtagttcaacttcacaggaggctctcggaggcacgggaaaggccctggtgtgccccgatgcccagctcagggagttggatgcccacagccctgagggcctgtctgaagctgtcatctgtcccaggggagttgggaagacccgaatgcctgtggtgaggtggatgcccccaccctaccctgcagccccacccccagtggccttgagtcacctgctggagaggaccttttaggagagaggctgagcatgggccaggccttggtttctgcaagggaccatttgaagtgcagggaagaggctggaggtgcttcggtcccacagccccctgcccactccctcctgggagctggtgccccctgaggttttggggacagaggagggctgccagcacagtggggagggcagaggggtctctaggaaggtgacctagggggtgacatctgtgactctggggcaaggccaggggtctagacgtgtcagtagcgaggtgggttccagcacccatgaggccagtgtggctggagggatggcagggccaggtgccctgggtaggggtgttggggaccctggctagagtgtgggcagcagatggggtgggggaagagcctccttgccagggtcctgtgggccagtcactggtgccacaggggtctccctggtgggcctctgcctttcttctttttgagacaggtgtcattccgtcacccatcctggagtgcagtggcacgatctcccggctcactgtagctgtggcctcctgggcctaagccaccctcccacctcagtcctgagtagctgggactacaggcgtgcactgtcacacctggataatttttgtatttttttgtagagatggggttttgccatgttgcccaggctggtctcaaactcctgggctcaggcgatcctcttggcttggcctcccaacatgctgggatgacgggcatgagccaccgtacccggccaggcctttgcctttctaggggtgagaggtggctgccttagtgtttgggggtgggaggaggctacagggcttcagttagcaccccctgcccagagggagctcctgtcccacacagcccggtcctgggtgagtggctgggggatggggtgctgggctcctgctctgcacacatgggtgttcccccaggatacctctgactttgacacatccctgcttgtcctggctttgctggtgggtttggagctctgatgagcaggtcaggtcttagggaacccctggctctgggatccagggcaggtggcccccagagaggagaggagaaatgtgggcacctatgggcactcactggaggggctgtggggagggtaatggtgggcccaggtcagggagtgggcatggccgtcctgaagttatttctgagtctagcttcatctccccctccttcctgggttctgcccggagctgtccctgcagtcccccttgccccatcctgtgctctgtggattgtttctccccacagctgctgggagccctgggctccccacgtgctcttcctgggcaggcaggtgaggccaggcggggcttggggtgcacaggctgtgggtggggtgggctgaggcctgcctcatggataggtcccaccttctctaggctgtgcctgggtttctgggtctccctctgggccggccctgcagtgtctgtggatcctggggttgctgcctgagcaccatcggccttagcctccctaaaggcaccctctcctgagcctgtccccactcagcatcctcgtccagcccatagctcctctgcgggggcagctctgggacacgggcttctcacgtttatgaagcaggcatcacccagtggctttgcggctgtcccccccaccaggggtgccttctgattggttggggcctcctgggactgggggctgagcaggggtcctgtgtgggacgcggctcctgaggcgctgaggggtgttcctcctgcagaccccctccagacacggctcccctttgctttgagagagcctgggctcgctcaggggtagaagtgggatggccctacaacaggtgtggactcgcttccctgtaagcacctagagcatgtggatgtgtacagggcagagggagggggctttgtgtggaaagggcttcctcctcctgttctgaggcctagagtcaggtgtgtggggcccttgctcctccagcccagcctgcctggtttgatgtggcttcctgggcctcactctccttgtctgtgaaacgggggtgatgaggactcgtccctgtggctgcggggagtgagtggtgggctacagggaggctcccagtcccaggtgagggtgtacgcatgctggccgttggggtgtgtgctgtgtctgcaccggtggcttactctgagtttcatgggggcaggaaagggcggggtactggtggcacccccggtcaggtctgtgtctgagctgagggctgagcagctgctggtcaggtcttgttggcccagcagcggagggggtggctgagacgcctctgaccgaaggcattggggcgagggatggcagcctgagctgcagccaggttgggtagggcagctggaggccgcaggcctctgcgtcaacctggcagcgccaacctgcaatctgttggcgtcttctttttttttgagatggagtctcactctctcgcccaggctggagtgcagtggcacagtctcggctcactgcagccttctcctcccgggttcaagtgattttcctgccttagcctcctaagtagctgggattacaggcacgcaccaccacgcctggctaattttagtattttaatagagacggtttcaccatgttggtcaggctggtctcgaactgctgacctcatgatccacccgccttggcctcccaaagtgttgggattacaggtgtgagccactgcacctgtttaagttttgtatttttagtagagacggggtttcaccatgttggccaggcaggtctcaaactgctgaccttgtgatccacccaccttggcctcccacagtgctgggattacaggtgtgagccactgcgaccagccctgttggcgtctttgatcctgggctgaggagctgagaagcttctatggcctgagggtcacacacacctgcccacacacctggccttcacccttcctgctagggggtatgtcctctgccaggagctgttgctcttatggggggaccaggggcctttgccttgatcagatggagacctggctggccacaaaacagaacacacccacctacaaagcacgtggcccagagatgtcctcgtctcccggccgctggctgaccagctaagtcctggcactgcagggcctgcccaggccgaattggggctgagccagactccctgcagtggggcccggtggcactgggacctctcacagcctcttttctgtcttgcaggaaatggctaattctgtctacctggttatggaggtgagtgccttgtggtgccaggacaagtgcaggctgatggccatggccctgggagccccacagggagggacatggctggggggagggtgatgagcaccttttctttttttttgagatggagtctcactgtcgcccaggctggagtgcagtgctgcgatctcagcttactgcaacctccacctccgggttcaagcaatcctcctgcctcagcctcccgagtagctgggagtaattacaggtgtgtgccaccacgcccggctaatttttatacttttagtagagatggggtttcgccacgttggccaggctggtcttgaacctcctgacttcaagcgatctgcccaccttggcctcccaaagtgctcggattacaggcgtgagctgccacgcctgctgagtatcactattgatgtcttccagcagggactgtggggacacctgccctgggctgggcaggtgcctgcgggctcagggagtagtgtccaagtgtgaggggtggggaggctgggcagggctgggaggtgggccctgggccctgctgcagcctgatgcgtgtctggtctcttgcagtactgcaacggtggggacctggccgactacctgcacggtgagtgcacagctgcgccacctgggctgccagccggtcccacagggcccgcacccagggccacactggcccagtctgggaggcagcctggctcgagtgggtccttggctcattgtgagattggctctttcttgtccccctgggcctcttgaggggatgcagggagctgagctgctcccggctgttaaggatgcagtccctccgctggcctcccccttgcttgaggagacagctgtgaccagaatagcccgaggggagccgcacaaaccaggggtgggggctgttgtcttcatagtgtggctggaaggcggctcttggcccacccaaagttgagccctgtggcggatgggaggggatgtgctgcacggggcggggcggggcagagggaaggacagcaggggggcggccgcgcccgtctgttcccaggctctctgggtgggggtccgggccacagtgccggcgggcgcgggggtgggtggggcgccggcggcctcttgggggtgtcctgagggtctggaggtggctctgggacagttccggggacttgggcctgagcacccgggagccggcaggactgctcaaacgccggctcagacccgcgtcgccctcatagcgctggggcgggagtgcggggctggtagatggacaggacccgctggccccctcgcctcgccccacgcgaggaggaccccacggaccaagcctgggagacagacgctgaggccgcgcgtagctgagactggggctgcgggtcgggtcgggctgtgcgcggctggcacctgtctggatgccgggaagaggggcaggagcgggacccgggcggaaccgcggtggcactgaggctgggcttcggcggcctcccgtctctggagcagctgcagcccggggctgagtggtggggccggcgcgccgggctctgcgcaggagcttcaggtgcgccctggtctcggcggcccgtggtggcttgtgcccctcctgacccggggtttcctcccggcctgcggccctgcctggcgctctccatccgtgtggcgggaccggcctggctgcgcgggactcacccctgggggaggaaacacggcccccaggccctgagccgcctctccccgcagccatgcgcacgctgagcgaggacaccatcaggctcttcctgcagcagatcgcgggcgccatgcggcttctgcacagcaaaggcatcatccaccgcgacctgaaaccgcagaacatcctgctgtccaaccccgccggccgccgcgccaaccccaacagcatccgcgtcaagatcggtcagcccgcgggcaggcaggcgggcccggcggggaggggctccggggccggcgccggtcctgacgcttctctcccgcagctgacttcggcttcgcgcggtacctccagagcaacatgatggcggccacactctgcggctcccccatgtacatggtgtgtttaccttggccgggctgtgccgggtgggcgcctctctgggcttgctggttggttggctggcgtgtggtgcgctctgctctggttggctgtggcctggcgggcaccttctgtggttggcgtgcgggggcctcacactgacccgacttctggtcccgcaggcccccgaggtcatcatgtcccagcactacgacgggaaggcggacctgtggagcatcggcaccatcgtctaccagtgcctgacggggaaggcgcccttccaggtaactgggcttggccctgctccccacgccgcaccgtcagtgcaagtgtccgccagctgcggtcagacgccccctgcgagccctgcccgcgccccacgagctcccctcgggtcctggctggcggggcgggcgtccaggggtccagtggggaaggggcctcggtgtcccccagggagggcggcgccgccggcggtgactgggagctgcccccggcaaggcctccctcgcctgtctggtcgcctgtctagtcgcctgtctggtcgcctgcctggtcagaggtgagggcagcgccggggccgagtgggtgagggctgggaggccgcgttctggggggtggacaccccgagagaccgtcggcgccccctccccgcccccatgctcatacctccagcagcaaacagccgcgctagcacccggtttcccccgggcttcgcagcgtctggggcaggggccgactggggacgaacgcaccgagaccccgtgggctggtcccgctcggccgcagccctggcagtcaggctgtccccgtccccgcaggccagcagcccccaggacctgcgcctgttctacgagaagaacaagacgttggtccccacgtaagcaccctcccgccttcccttcccttcccccgcgggctccggccccgcaggccctgctcacaccagcctcctcttgccccagcatcccccgggagacctcggccccgctgcggcagctgctcctggccctactgcaacgcaaccacaaggaccgcatggacttcggtgagcacccaccaggggcgcagctggagtcccccaccctccttccttgcatttgctgatgtgagcagggcccaccggcttcacacccagccccatgtgcacactgccctttccacaagccaagcgcaggcaggggctccacctccgcccgggcaggtgcccaacgcggctggagctcaggccgtggggaggcaggggcctggggtcagagctggggtcctcctgaggcctcactcctccttcctcctgcagatgagttttttcatcaccctttcctcgatgccagcccctcggtcaggaaatgtgagtttctgtgggtcctggggctccgcatgggccctgcatgcaccccttcctccccgggtttggttagggcactgagtgtggggcagagggagcaggtcttgagctgcggccagctcccagggagggcaggacacccggctccttgctctgctgcagcggggaccccaaggccaggggttcgcatggtgcagcaggcttgggatggggatggggtgttggaggggctggtgctgccctgtgacagtcatagggtggcccaggagggagcctccctccttcctgctggtcggggtgtagccggaagtggaggggatatggttgagcttgtccagtctgtgggttggctcgagggtgaggaggagacaggaggatggcccagactgacctatgcatgtttatctcagccccacccgtgcctgtgccctcgtacccaagctcggggtccggcagcagctccagcagcagctccacctcccacctggcctccccgccggtgagttgccgccccaggggcttggcagcttctccctccactcagcagtcaggggctccagccctgggcccccgcggggacgtgctgtgacttctgttgtctgtgtgagtcacgaaagacatggatgagttcattctgtcagatgttgaagccccacaaacgggtgacagcccctcccaacacccacagccctcaggtcccagaggccgatagggcggctgtttggtctggtcctgtctttggttttgtgctgacgtggacagaagcagcgtgtggccttggcccactgacacctgcacccctggcctccctcgtgtcttccattggactcaaagcatgagtagggttgcagggtgatggccccacatgatgatggcactccttgtgtgacatgggaggggtctgcagagcacctgagtcggccatgaacccccgtccctctgtccatctgactgggagcctggctctcaggcatggtgttgtggctggtggtgatgagttcatgtctgggctctcctggcctggccccctgctctgtgaccagggaccggtcctctgaccttggttgtctgcctgtatcatggccgaaagctcagatgtggcgaggggagcgtggcagcgccctgctgtagggagctgtggcatccgcagacctgccctggggcacttggggctttagccaccaccgcacggatggtgtgccctgggccttagcatggtgctggcctcagagcagggcccaccggggtggcagcctctccactggacacgccttccatggtacctcgttctcttggctatgccgatggaaaagtgaggtgcagagggcaggtggtgaacaactccccaaaacagggcctcccagagcttctgggagctgagggcttcaacccacccaggctgcatggtgagagtggctcgtcggggggcctgtccctgcgaggtcaaagctggcctttgagtggagtgctctggaagtacagagaagagcggagcacaggaagaaagacgtgcccagcccttctcagccccagcgccccgatctttactggggctctgggccatcccaggagggggaatttgctcccctgagtgtgtaggtccctgagacctgctcaccagcccctccgttgactctcagtccctgggcgagatgcagcagctgcagaagaccctggcctccccggctgacaccgctggcttcctgcacagctcccgggactctggtggcagcaaggactcttcctgtgacacagacgacttcgtcatggtccccgcgcagtttccaggtcagggggcacgctgggcttggaggtgacgcctcaggtgcggcggggacagtgcattgcatgtgttggatgcacagtgtgtaacacatttccacttatgggcagttaggatgggcccctgggagccaccggcatcggcccagcttggttggggaggccgtgtctgttaaaaccactcctggaatcaaagccgggtcctcctagtggtcagtaggaggtcggaggccataggcctggtctccttagacagtgctgctcttcggatgggtgggggccgctcacctcatgcccctcccccgccatgtacccctaccttgtttctcagcaactcttgttgcctctacaccctgcaggtgggtttattccttggcttttggggaaccccccgctccataatggccaggggctgcccacgtgtttgttgaatgaaggtgcctaaacttttggagcaggcctggggtctgtggctcctctgaaggccctgcactctgtccctggctgtcccaaagctcctggaggtctgggttggcactggtccccgtgtctgccagggacacaatgactcatgccgagccctccgcctctcccatcagcatggcttctgcgggggtggtgaggcccgagccaagccccagacagacccggggagggccttggtcctttgccagctgtcagggcaacaggaagacggacaccaggggtagggcagagcctccttgggggtgggaacctgggtattcctggagggggttgggcccagacttagggctgtagatgcctgacctcccccgcccatcctggagttagctaaaggctggggggcagggccccaggggtctctggggctgaggagacaggaggcgcagagtccaagtggggataagcgggggcaggtagcgctctggtctcccggagctggcctggggctggcagggaggatgcagcctggactgtaccacccaggctctgccccccgcaaggccgctgtacgagctgaggcccctgcaaggtggagtgtgcgtggggatccagcagagagcctcggtggggtggggtggccctgggcaggcggcaaggactccaggcccagccttgtctccccctgcaggtgacctggtggctgaggcgcccagtgccaaacccccgccagacagcctgatgtgcagtgggtgagcccccatcccttacctctgtattttaggggagagaaactgtggccttggaagtggcccgtgttatttacaatgagccgagatcgcgccactgcactccagcctgggtgacagagcgagactctgtctcaaaaaaaaaaaaagtaaatgccgttggcccgtggtggctcacgcctgtaatcccagcactttgggaggccgaggcggatggatcacaaggtcaggagattgagaccatcctggccaacatggtgaaaccccgtctctactgacaaaaaaaagaaatgcaaaaaattagccaggcgtggtggcacatgcctgtaatcccagctactcgggaggctgaggcaggagaatcgcttgaacccaggaagcagaggttgcagtgagccgagattgcgccactgcactccagcctgggtgacagagtgagactgccccaaaaaaaacaaaaaaatgcccttggcctcccttctgccccacaggagctcactggtggcctctgcgggcttggagagccacggccggaccccatctccatccccaccctgcagcagctcccccagtccctcagggtaagcagggccccaggctgggtggatggggctgtgaacagtcccccggctggaggttgggcttcctgtgtgtcgcagccagcccaggcctgctgtgtccagaggcccctgccttcttctcccaggcctcgcaggatggggtctgctgggtcgtcctgcagaagggactatagtgggaggagcattgacaggagtaggtgaatgaggaaaccaaccagggacgccagggccagcacagtcgagcctgtagggccaggaatggccagggccccggccagggtggccccccactggctgggtgcagactgggagtccaggtggggtgcaggtgccacatttctggtgtgtgtagaggcatggaagccggctcttttcagacctggcatgggtctcagggtggcctctgccctaactaggaagtctgggcctaggctttcttctggtgccccagctccatgacctcagcctcttgtgaccccagtgtctgtcatgatcctgacctctctccaccacagccgggctggcccgttctccagcagcaggtgcggcgcctctgtccccatcccagtccccacgcaggtgcagaactaccagcgcattgagcgaaacctgcagtcacccacccagttccaaacacctcggtgagtgtggagcccccaggtagccaggcgtggctggggccttgtgtggcaggagcccttccacggctcccatagagggacagggtcgtcatccatgtgcagttgtgcaggctgcgcactgcgtaactcagcaccaccatttactttgttgatgtcttgggtttctagagttattttgacagttttctgatcagtaaaatctctctagtttataaaatcaatattgactttggccagttttaacagacagaagtaaatggtgggaggaaagggtacctttcttttaactcacagaaggctgtgtgggccagtgggtgtctggcaggggatggagactttagggtgagggtgccttgggttggcaccccgggcaggaaagctaaggggccaactcctcccacacacccactgtgtggccggttacctggacagagtgcattagaggatgagccatctgtcagcactgtagccacttggcgtggcatggggtcctgggctgctggggcctcccctcctaatacctgccttgtccccaggtcctctgccgtccacaggtcaggcagggctgctgaggcctcccctcctaatatctgccttgtcttcaggtcctctgccatccgcaggtcaggcagcaccagccccctgggctttgcaagggccagcccctcgccccctgcccacgctgagcatggaggcgtcctggccaggaagatgtctctgggtggaggccggccctacacgccatctcctcaaggtgcgcctgcaggctggggcctgggaaggggcgtctgtaggcagtgggtgaggaggctgtctctgtcccagctggaccctgacagatctctcttttccccaagttggaaccatccctgagcggccaggctggagcgggacgccctccccacagggagctgagatgcggggtggcaggtcccctcgtccaggtgggtgcagtccggaggggggagggggtgctaggctgacctccctcgctcacgttgtcatcctggtctaaagcccttgctctttccaagtgaaaaggagtgggaaggaagctggtggaacagaagccaactgcctctccacctcctggctgtgtgggctggggcaagtttcttatcccctctgtgccagtcttctgtgctggctgagggtcaggtttaagagtggcgcctcagctactcgggaggctgaggcaggagaaccgcttgaacctgggaggcagaggttgcagtgagccgagatcataccaccgcactccagcctgaatgacagggcgagaccccgtctcaacaaaagaaaaagagtggggccttggagtgcgtctaccccaaggggctccgtgtggtagcagtggggcctagggctgggccgccggaccggaaggtcgtgacgaggcgtgtctctctctaggctcctctgcacccgagcactctccccgcacttccgggctgggctgccgcctgcacagcgcccccaacctgtctgacttgcacgtcgtccgccccaagctgcccaaaccccccacggaccccctgggagctgtgttcagcccaccacaggccagccctccccagccgtcccacggcctgcagtcctgccggaacctgcggggctcacccaagctgcccgacttcctgcagcgaaaccccctgccccccatcctgggctcccccaccaaggtaatgggcactgccatgtgtgcaggggcacagagccctggggaagatgtgtgggaatggccagtcctgaacaaagaccgaggaaggcagctctgtaccttttgacccccgcctgggctcatgctcaggctgctcccacatgcctgccagttcctgcggactcggccccttccccaggcaccgggccccagggctgcagacctgcggggcagtcttcaccccatctctgtcctcctaggctgtgccctcctttgacttcccgaagacccccagctcccagaacctgctggccctcctagcccggcagggcgtggtgatgacgccccctcgaaaccggacgctgcccgacctctcggaggtgggacccttccatggtcagccgttgggccctggcctgcggccaggcgaggaccccaagggcccctttggccggtgagttgaggggacaggccttggacgggcttctgaggggcagcctctttcccctgcattgttctgctgggtacttctggggggtagaacaggaaaagcccagccttgcccttctgtgggtgcccagtgtggctgggtgccagagagcctggcccacctgtggctggccctagacccacagcaggtccccgtcctgagcctcgccatgcccgcctgtaagctggggtgacaggagcgcctgcctctcgaggtgggccaggagaccgtgcatcatgtgtgtctggcctgcagagggacctctcgaggtccagttagggtggggtgggccgggcacccagcacagccctgcacactcccacaggtctttcagcaccagccgcctcactgacctgctccttaaggcggcgtttgggacacaagccccggacccgggcagcacggagagcctgcaggagaagcccatggagatcggtgtgtgggtgggtggggctcggaggctgtgggatgggggtcggaggctgtgggatgggggtcggaggctgtgggatgggggtcggaggctgtgggatggggctcgaggctgtgggatgggggtcgggtggggcttggaggctgtgggatggggctcgaggctgtgggacgggggtcgggttcggctcggaggctgtgggacgggggtcgggttcggctcggaggctgtgggacgggggttggggggagctcggaggccgtgggatgggggtcgggttcggctcggaggctgtgggatgggggtcggcgggagtcaggatgctcctgagcccttccttgctctcccagcaccctcagctggctttggagggagcctgcacccaggagcccgtgctgggggcaccagcagcccttccccggtggtcttcaccgtgggctctcccccgagcgggagcacgcccccccagggcccccgcaccaggatgttctcaggtgagggctggctaggctgaagccctgtcccttttggggtggtggcagcgccctagcggacgggggcatcctttaactcgggtcactggactacagccccccagagcccaggggtgcctgaggaagcagctcaggcccctgagaaacccctgctctgtctccccgtctgcgaaatggacgtggttctggtatccacccctcagaccacccctgccactcaacctgtgagcggtaggcgctcgttcccatttatccccaaaacatgaggtgagcagggacggtgtctggatcatggcctccttgcccagctgccgtgggctgtgctgtgttggtcaggagttgccctgatgagcacaggccgtgcagacaggcgtgcccctcggttccccagccagtggtgtgtggggatgctctgggcctggggcctggctgggtccccactgcgggttctgcctggggaggggtgggcttgtgggcgtctggtcctggccaggggctgccatcgctggggtcacctgccagccccatagcgaggatgggggactgccttgccctttgaggtccttttgggccttgggcccagctgtggggcacagtagcacaccaagccacgcacctaccccattccagacagtggcagctgccctcctcccaggcagatctgggctgggggtcgggatacccagagggtcccttggtgggcaccgcagcccttggcctgaggtggggagctggggacttgggggttgtggtgagtggcaagaggttgaggagtggctctaggggcctgctgtgcttctcctgttggagcattgggatataacaggtgtaaaccgaggcagaggcacattgggccctggaggtgtgggagtctgtgggggatggatgggggccacggtgtctgctggtcctggtgtgcccctcatcgccctctccctgcagcgggccccactggctctgccagctcttctgcccgccacctggtgcctgggccctgcagcgaggccccagcccctgagctccctgctccaggacacggctgcagctttgccgaccccattactgcgaacctggagggggctgtgaccttcgaggcccccgacctccctgaggagaccctcatggaggtgagggctggagtgagcaaaggttcccattctggctggagggtgtgtggggtgtgtggggtgtcgggtgtgtggggtatagggtgtgtggggtgtcgggtgtggggtgtcgggggtgtggggtgtagtgtgtggggtgtagagtgtgtggggtgtggggtgtcgggtgtgtggggtgtcgggtgtgtggggtgtcgggtgtgtggggtgtagggtgtggggtgtagggtgtgtggggtgcagggtgtgtggggtgcagggtgtgtggggtgcagggtgtggggtgcagggtgtgtggggtgtcgggtgtgtggggtgcagggtgtgtggggtgtcggctgtgtggggtgtacggtgtgtggggtgcagggtgtgtggggtgtcgggcgtggcacatcccagctgcccgggctgcagcaggggagggtaccctgccctgcctccccaaggcgtcatcggtgagtctgaagggagacaagccccttccaagcccgggcagcacttgccgccctgacggccgcttcctgcagcaagagcacacggagatcctgcgtggcctgcgcttcacgctgctgttcgtgcagcacgtcctggagatcgcagccctgaagggcagcgccagtgaggcggcggggggccctgagtaccagctgcaggagagtgtggtggccgaccagatcagcctgctgagccgagaatgggggtgggtgccgccagggctggggtggggcgggtggtggcctgggggccaggaccaaccggcctcctctgatctgcctgccgcccccagcttcgcggaacagctggtgctgtacctgaaggtggccgagctactgtcctccggcctgcaaagtgccatcgaccagatccgggccggcaagctctgcctgtcgtccactgtgaagcagggtgagggctgcgaccgctcagcccacatgccgggttggggaggaagcccaccttgcaactgcctgggtgacagggtaacagggaggctgcttgagtaggcccctgtgcagaggtgcagaggccccggggcctggcccagtgtgcagagcacagaggccattgggtcggacagcaccctggagcccagtatgcagagcacagaggccgtggggtcggatggcacccgggacaaggtgcggagcctggccacaccctcaaggccacggggagccagggctgtggcagggagggagggacgtgctcgctcagtgcaccgggcagatcatggccactccagccctgccccgtgtctgctgcaccctgagctgaccaccctcgtcctttgcagtggtgcgcaggctgaatgagctgtacaaggccagcgtggtgtcctgccagggcctgagcctgcggctgcagcgcttcttcctggacaagcagcggctcctggaccgcattcacagcatcactgccgagaggctcatcttcagccacgctgtgcagatggtacgggacagacagacaccagtggggcaggggccaggaacttccaggcccgccgtctccactgggacgggaccttgatgcccacagcgtggtgagactttggggggtgtcacttctggaggtcttgaaatgacagcattatgcacccccagcctcctgcaggcgctcgcagctcggctgggtgcatccttgattgtacgggtgccgtggcccatgtgcatcctgcctcgccccgactcagtttccccaattgtaaaatgagagacttggtcttcaggcctcgtagtcaggtgtcagcctccagaagcagcacctggtcccggacaacctgcctggaagtgtggtgcactcaggtggtaccacgggcaaagactccctgcttgggctctgaagagctccctctgcctctgaggtggtgcccccttttcgtttattttttgttgtttttttttaagagagggtcttgcactgttgcccaggctgaagtgtagtgtagccgctaactcctgggctgaaatgatcctcttgcctcagcttcccaagatgctgggtattacaggcaaaaactcatgagtgcctgagtctccttttttaagaaaatttaagcatgtagtaaaaatccagtctgaacaaacatgggaaaagtcagcctccctcctgccccccttcccgcccaggcaggccaggcagcagcagtaatgacactgactgagcggcgggcactctgttgtcctggggccgggctgagagcgctggccagggtcatctggttccaggcagtgtctccccttggccctgtgaccatcccctctgcacagcaggctgcaccagcacttatgtctccacgtcactgccctgagcgcctatctgccacccctgggccgctgccgtgggtgcagggcagcccttgctgggagggagtggggtgagctggccctgtccagcctctgtcctcgcccccaggtgcagtcggctgccctggacgagatgttccagcaccgtgagggctgcgtcccacgctaccacaaggccctgctgctcctggaggggctgcagcacatgctctcggaccaggccgacatcgagaacgtcaccaagtgtgagtgcccggctgggctgggggctggggactctgggcgtctccctcacactcccctctccctccacaggcaagctgtgcattgagcggagactctcggcgctgctgactggcatctgtgcctgacctttctggcctggctgggccccccgtcctgccgagccctgcagagtgggctctgtgtgctggctggactcctcgggacaagcccatggcgctgatcgctggtgctgagccctgccctgggccccacggacagtcagcctgccggcctccctgcagctcacggggcagaaccagcacatctggagccacacagcttggggggtgtctcccatcttttacaggtggggatcacagaatttctgcccctccagctgcctggctcagcaggcgtgggtgccaccaccctctagccccagggcagccccggaggacaggcaagggcctgagaccactgccgactcaaagccaaagcgagctcctgcttagggaaggtcagcaggcactgtgcccaggaagagcctgcggcctcggcgtcccccagtctccaggagcctctccctccgagatacccacccagctttgtcaatcacccaagcactttatgcatatagagacagaacctggacctcaccagggactgctgggcagcgattcctggcagtggcctggtgtttgtacatacacatatgcagacacatgccagggccccccaagcccgagcaccggaccacgttgctgcccaggtctggacctcagcgggagaactggctccggggggagtggggccctgcgctagaggcagaggcagttctttgttcaagcgttcctctggggaccggcagcagaggcaccgtgttctctcagccctggatacgtcttgtaatctttcacactttattcctaaaacgtgtcttatttttatgcagctcattttttctttaaaggagaaaacttgtaggtgtttaagaattggttttgggagggcgaggactgggccaggttagaggcagatggcacaggggcgtgtggcgggcgggtgaggctgctttgcacacctgtgttggtggctgtcccctgccgcccctccctgtggcagcagcaggacaggtgtgtgcccagcaccctccctacctgggcctggaagcagatgaggggaatacttcatgcaaagaaaaaagtaacatgtgcaaaagctccccgtccagctttgacagtcagttttgatgtcagctcctcggcagggtaggcctgatgacagccctgtccctccctgcctctgccttgcccaaggccacggagggcatctgcagagaggcctgccttccggattccaggcgggcatgccctgcaaaccccgcctgggcctcccttggtctgcccagccctcgattagccctgcctgaatcagtagatacttgaacgagtccccagtctgcgggaggcagtggtggggccatggacccatgcggggggttccagggtcacacgccacataacagacaaaaatacacacacgtgtgtttttctttgcaatacttgaaatattgccactgtgcttggacttagaagaagaaaatccccgtgacttcttcctcatcaccttgatggctttattctcaccttgtggggcatgtttgtatttattgcttcatggccgactggaatcctgagtcctgggaagctggcactgcggggatcttgcccggtgtcctggtcctcttgcttccgtcgcggccgcatgtgcgtgtgtccaagcaggtcctgggcgcctcaactgctgcccctggttgaatgttctcttgatagtgctggaccctttgtctattttaaagcgaattttgtgtgatttcctgccctttgcgttatattgtataataccaacgtaaggaaataaacctttggaattgttgggctggtgtca

SEQ ID NO: 757 - DNA, 26289 bp, Homo sapiens
tggcactcatatttattacaggttggcaagagtgaggttcccgaggcagtgtcactcctcatcgtgcattttttgctgcaaaaagaataagaggtgtgagggggcagctggcaagagggagaagtgtgtggggacaaatccctggggctttcagaggcctaagggagatgcccttggagggagaggcagggccccagggatcctgtggtcccacgttagaggcacttgtggtttagggggatggaactggggatctctgcagaagttccagtcagtggggggctgttttgagcaggagagtggattctcaggttatgtaagctatgggaccctcagaactgcctacatatagggcaagcagtgcccactctgaagggcacccatatcagggggcatgctaatgtggaagtgactagtgaagcccaggggagggacccaccttggcaccaatgtcacggctcttggctcgaagcttgttgacctgggactcagcgatgtccgcccgctcctctgcctcatccagctcatgctgcaccttgcggaacttggacaggttggtgttggcttgctcctcctgtggtgggacagtggggatgggtgaatgagctggagatgggctatgggattctcagcctctcaacctgaggttccagctccctgtccctgaggcacccatacctcatgcatattcctgcaacagccttcccaagggtatcctgcaactgccttgcactcttctcaaacatgtccagcactcagagtccttcacggccatccactgccccagacaaatcccatgctgcccgatctgggccccttcagaatcctgttttgctgcacctgtcccggaccccagcttcctgtgcaggcatgctaatcagcaactcacatccacccagatgtcttccccactgccctgtggctagctgggtccccttctaggcccaattccaccgccaccttcctgccttcagcttcggctgccccacgtcctgcactagcatctacactgccttctgttgggttatggtatctgaattgtaagcagcttgtaggtggtgcctttgttaattcagaacacctgacagctctgagcataccagatgtgtcaaacaaatgtttgagagttaaagtttatagcaaactctttgtccaggcccctctgtaggagatattcattggttctcacaaatagtaggtgtgttgatgagaaagggaagaaagctctgaactcaccgcctcctcggcctggcgcttgtaggccttgaccttcagttgcagcttgtccaccaggtcctgtagccgcagcaggttctttttgtcttcctctgtctgggggtgggagggtgggagaagctggtttggagggggagcaaatgcaatcacctttccctcctccatcattttactcttctccccttgcctttgctgcccctccctgcaatgatccaggtcaaagaggtggtggggaagattctctgactctatcgtaggtcaaaggggcaatgcaaggttgtcagtcagggatccacagagcaatgaaggctgaagtcataaagctagaagtagggggaggggctcagaacctaatggaattccctaatgtggtaatataaaagcaccaggtctgttccagctccagtatggtggataaagctccaacctggacttacataggttctcttggccagtagttcttgaccagaaaaagaatgcagaaagaagggggtattatcataatccagattattctacattctaatatattgtactgggccagaattcaggcatcgggatcactggctccaacgtcactcgatcattcctatctctttatcattgtatgtgccaggatgccatttctacttctgtccacaaatcactctgtggttctgtatctgtaacctctttcttgtgcctctggtatccatctatcaaatggactgacaccctcgtctccttggccttttcttcccaggtacactgaaaataacgggccaagggcacagctctcagctatgcaagtggaggttttagagcattctagggtcctctttctctgtggccttctctttgtgtgccagaagttctatggaagatttccgggtcttttcccctcccctgactcttatccccacagtcgaaggtggaaggattctttgaactgttctgaagtcttcatggtagcacttagagttattaaaaaaaaaaaaaaagaaagaaagaaacctggggaaagactagttagaagagttttcaggaagtagaagtagattcttcatttgctggaaaaactcatagactcaagtcaaactgactgcagagcgtgagaagaacgttaaatctaccaacagcatctcaaggaggaggtgagaggagccctgtgagggcggggcagtggggccagagaagaaacttccacatctactcctggtgtctggcgtccgccgcacctggtaggtgagctccttgatgcgccgctcgctcttcctcatgcccttcaccgactctgcgttgcgcttctgctcggcctccagctcaccctccagctcccgcacccgcgcttccagcttctgcagctgcttcttgcctcccttgagggcgatctgctcggcctcgtccagccggtgctgcaggtccttaatggtctgctccatgttcttcttcatgcgctccaggtgggcgctggtgtcctgctccttcttcagctcctctgccatcatggcggcctgtgtgcaggagagaggtggcaaggaacatgggccaggggccggggccttttgccccccaaggatctcctttctcccatcaggccctcaaatccacagaactgcagagttggcttggtgttacagcacagtggcctggcctggacccaaggccttgtttctgtctttaggggaggcggaaggtgggcggtcacttacatccgtgatggccttcttggccttctcctcggcgtttctgcactcctgcactgcctcctccacttccgactggagctgggtcagatccgactccatcttcttcttctggttgatgaggctggtgttctagacatggagagagaaaaatgatcaaatatatactacactttgttacctgatttcataccctttctccagaaagaattaaaggtggtcattttttttttaaaacaacaagcccacttttagactattgatcgttttgtacctgctttcccttttcctatgaaagtgcatacattctagacattgtatctaagattactaaactctgaaaaaagacttcaaatagcaaaaggtctgcagtattaccctggagctctttagcaacatgtttacgtaggagcatgacaatattccaaggaagatggaaacaactttttaccaggacaatattccagagatgtttatagctataccaagaatgtagtggggtaaggaagaggggatgaggtaagtggatgatgtcattctcacacatactagattaaagaacaaaactccacagggcactgcaaaaggtgagcacaaagtctcattgcagagtataactgaaaacagtgtgggtgggattgcagaaaatggtgttctagccagcttggtttgcaagagatgcagttatgcttctttaaactcccaaactctcatctttacagagcaagccggaggctgtctttcagatcaagaatatcaaataacaggatacattccactactcccagatttgtggctttggcaggtatcagcaatcaatcatgaccctcttagcttctaagtagagaccgctttcttaatataatggttctgcagccaccacagatgagagttggcctaagagaggaaatgatttgtgaccctggctagatgtgctcacttagaacatctggcttttctagatgtcctgggctctgcactcagtaggtttccacaaggtggctcctgaccccctcacctgggaatgcagcagctgcacccgctcgctggtctcaatcagctcctgctccgccagcttccgggaccgctctgtctgctccaccacggcacgcagctcctccagctcagcctgcagcaggttgttgcgccgctccacgatggcgatgttctccttcaggtcgtcgttggcacggaccgcatcgtccagctggatctgggtgtcctgagcatcaggagagtgggtgtgagcagaagccagcctcggtgcccttcactgagggcacctgtcagaggtccctgcagtaacccaggggcaggaggaatctggtgcctgtatccagacaccactgcttctccaggccacatggaggccagtcccctgaggggacctcccgcccccatgtaccttcagcaagctctggaggctcttgacttgcttctgggcctcggcagccatgcggttggcgtggctgagctggatctccatctcattgaggtctccttccatcttcttcttcaccctcaggacctcgttgcggctgcgtgtctctgcatccagggaggtctgcagcgagtccaccacccgctggtggttgcgcttggcctgttccatctcctcgtccttctctgccagcttccgctcgatctctgccttgatctggttgaactctagctgggcccggaggatcttgccctcctcgtgctccagggaggcctgggaaggggtggggcgagggcgggcagacagggcacagggcagggttgagagggaggatgagaagatacacggtgtcagccaggactatcgcccagagaagaagagctgagaagagatggggaggtgggatctgcaccccatgcccaccacggtgctattggggagaaagtgctggactctctgggcttcccctgtcaagaaaagggtttggacctcacaattgccagaccctccagcactaacactgcataaattcctgacctgtctaaagtattatagaaaatggaggaatttttataaccacaaatacaaaattttatcttgttttccaggtccctcaccctttcctgagaaaagttagaagcccagaaaactcagggctattcccaggtgcttagaaatgaagagtaacaatagctaatatatattaagtgcttaaatgtgttacctcatttaatctttataataatcatgtgtaaaatcatatgaggtatgtacagttaattccattttacagatgagaaaactgaggcagagagagattaaagattttgcccaacgctgcagtgaaagtcctcaagctgtgttccaactcaggcctgtttgactctggaaccccacactcctacccactgtctaagtggttattattatggccagattccaacttttaaaacctggtgggaaacaaaacctttggcctctaatcagactgacattttcctttgtgcagaccttggctttggaggcagtcatgggtagtgaatagtgggtagataatgttgaacaaagaatatggaatgaatagattttgtcctggggtcagggtcacccccaggtgagggagaagtgggagacagcggcagaacagggatggggtgcagggagttctcggccctcacctctgcctcctccagggctgactgcagctccagcttctccacctccagctgtttgcggaccttctccagctcatgcacattctttcctccttctcctagctgctcagtaaggtccgagatttcctctggggaccagagggccagaaagctcaaagcctatgttccccctgcccctgcatggccctccctcccaccaactcatctctggcctcttggacccccagcacaccctgaaggttcttgttctcccgcttgaaggtctctaggtgctccagggactcctcgtaggcgttcttgagcttgaagagctctgtgctgagggagcgagcctccttctgtgaggactccagctcagactgcgactcctcatacttctgcttccactcggccaggatctgcccggggacaaggctcactcttcagccccccagccttagctccccagccctcctgcttcccagtgccccagcccccagcctcagccgcatgtccaagatctgtccctggtcccgagcctgggcttagccctcctcctccacctccaaggaggttgcctttggcctctcactgaacccctcatgcccccttgccctgcatgctggctgcggcccccgcccatggtccaccttgtcaaagtttctctgcttcttgtccagggctgcagcagcagcattggagcgctctacgtccaccatcaagtcctctatctcattctgtagccggtgcttggtcttctccagtgaggagcacttggcattaacagcctccacggcctcctcggcatcctgcagccgctgggccagcttctttctgcccaggtgagggtggagggtgtgtgtgtgactctactgggcaacactggagccttgggtggacctccttccaccccctccctatatctccttgagacaccgtaagtccagcctagcaggagctgagcctgctcatgcctggaacagagtccgccagcacgggctgcccaggcgtcctccctacctgcagtggcatctgggtgtcagtgccccctgccctcaccccccacacaggctgatcgacggtagctcctctgaccaacaagctttttgctcgtcttatacgtgagcatcaggtataacccgggccaaaagctcgcccgtcacaggaagtgggtcagggccagccagagttcacagagcaaagagttcaggctttcttccaagcacttctgttgccctccgagttcctcctgtctcttccacttccgtctcatgaccactttgcctgtccccaccccaggtcctctcgccccttcctctctgagagtcaggttaagggggtatctggagctcacttggcctcttcgagctcctcagtccgctgaatggcgtccgtctcatacttggtcctccactgggccacctccgagttggccttggacaggacgcgctgcagctcggccttggcctctgtctcctcctcgtactgctcccgcagcaggtcgcagtcatgccgggccgactgcagtgcatgggccagggcgttcttcgcctggggaggggggggggcaccaggaggtgggagggactccctgtgccccattctctagattctcttcttatgtagtacttcaaccaagcccagccttattcaccatgtgggctgatgtggcacctcactgtttgaggagtttcccagtctgctcaccccatccccttacgaataagaaaagaggcattaaatgacgcttagctgcagggcagaacctagactggagggtctttcccttgcagaggactctttccagctccaggctccatttctggcactgagatgaattgccccagggctgccatcaagcctgcccaccctccccactgggcctcaccttgccctcctcctccagctgccttttgaggtcctccatttgctgggtataagagagcttcccccgggtcagctgcgagattagcgcctccttttcctctagctgccgggccaactctcctggaggtgaaatgaggggcttgtgggccatttcacaagtcatgtcctgccctaggcagggggttggttaggggcacccaccattctcggtctgcagcttggctcgctgggtggtgaaatcattgagggagcgttgggcctcttctagcttcacgcggtactcattggcctggtcctccagcgtccgagacactttctccaggtttgccttcaggaagcaagacaggaagggtgagtgtgggaggggctgagtcgaccagaggaaggaagagagggtcagagatggggaatgccagagggcaggagggggacacagaaggtgtgggagggcgcagtctgaagagagacttgaattaaagaaaggaggaacatgaagagatagagagggtgaggagagccagagaggggcaggggagacaggaagagagaccaaagggtgatgaagagaatgagaatgacaagggagatggcagacagagagagaaggcatgggggaggctccgctgtgcaggggagagggcgaggggaggccgagcagagcctgccttggccttgatgatctgctccatgttggaggtgacgtcatccagctccagcttgaactcgctcttctccttctccagcttctgcttcacccgctgcaggttgtcgatctgctcgcccagctcggccacgctgtcggcgtgcttcttgcgcagggccgcggcagtggcctcgtgctgcagcgtggcctcctccaggtcccgccgcatcttctggaactcggcctcgcgcttcttgttcatctcgatctgcacggacgtggccccgccggcctcttccagccgctcgctgatctcctccagctcccgagacaggtctgagcgcagcttctccaccttagccctggcggtgcgctcggcctccagctcctcctccagctcctcgatgcgtgcctgggtcagacacaaagggctcagacccaccgcctggacccctccactggaatccccccggctctgaaaagctaccaggaacttaggttcctctcaagcagtggttctcaactaggggcaattttgtgccccagggaacagttggcaatgtctgattgtcatgtcttggtggggcttgctactggcatctagagggtaggggccagggatgctactaaacatcctataatgcataggccatcaataggaatttggctgaagctcccaagggcatctcagacccagtgtgagcatctgcagccccaaatcctgagaacctgtggttgaagggggatcctggtatcctgtgagatcaagaagttcagagtccccagattcactaggctctgttgcgctattcataagacgggaaaatgagtgcttgtattttacaaatatttgtgacaacatgcctcgaaacaatcagatacctttgcaattctccaagttaaccacaaagtccaatcaaccatattccttgctctcccaggcttgctgtgtttatgcccagggctgggtttcaacatgattgctcccttccaggccaggaaagtgctagcaggctactctcctcttcacctcatctccttatcctctttaagtgcccttacctcattttttgggccttagccttggtcttgactaaattgggagaatatcgtatctaccattttgatctgttgtctggctagccaggagcaaaacgggggttcagtggaaatcccttcacctcgggttatggacagctttaatggactgttcatggatgggtcctacaagcagcagagaggaccaccatgcctctgctcccaggatggagaaggtgggacttctgagcaagatcttggggatgaaggaggagccatagcctattgccgagagctgatgagactaacaggactgttattctgtgtccaagaggccaaacaagttgcccagacctagggtagaagaacctgaggatggcccgatattctagctaaaacccagaaggggcatccaagaagatgggagggcaaattactaatgaaggcgggccagtccctgtgcagccccagaggagtggaattgtgttcatacattacttgcagcctgggccatgggcctcaagtgcagaggggagactacctctttctaccagccacagtctgccccaaagtgagaggacaaggtcccgccccagtagccgagttcctgttgcccttggggtcactatgtccagacctggccatgtagcttctgtagctctataatggggatggcagtggacttccaggtctcttctgacaaacccgatactaaaagcacattagggtttgaggttcattaaagctaagggagactatggctgttcactaaatcttgagctgcagaggaatgagaaggccattgagaagacaaaacaataccttcttaggctagtggctggctgacttctctaaattgggctatattaatatgatacttgtatagaatttcctagttgacaaaatggtttcaaatacattatcccctctggtcctgtgtggtaggtattgtcagtctcattttacaggtgagaagagaatctgaggatcagggagggtaagtgacttgctcacagttgttggaattggctcttatcatgagtgccctatggggactcagcctgggttagtggctggggttagtaccgggaagaatatgaacagagcagctcacaggaaggtgctccttgaagccttttttttttttcaccctgcgttcagagggctgaactaccagaggaagggttagaggagaatagagctctatcatttgtcttagagtagaaagtccctgaggcagagcagatctcagaaggagaagccctttagtaggtatgagtcccccttctcaaacagttttgctaacgtaatgtattcttgctctatgggggaaggctagtgttcctgagcgcctgtaagtcagggatggttgggtctatgaggctgcctggagttccagatattgtgtagaaccctaagcagctgctgcagcctcagttacctcagggctattgagctcccactttcatgcactgggaaaaaaagtcacctggttttccttcagtttcttctgtagttgaagggccagcacctgctcatcctcaatcttactgttctgctgattaatgtcaaactccttcctgcaggagaagggtgggggtgggggagtgacaggtagccttccttcctctggggctcattctcttcttggccttagtatgccagaatcggcacctccccctcccctcgccagcccagaaagtggcggaagagggctgtgattgaccttattcccagcatacccaaggcaactgtggccagtggaggcgcagcaccctgcactctatctaccaggccagacacctccattagcccctcctggccaccacagtctcctacttcttaagcttttcttccagctgcagtttatcattttccaggtccatgatgctctcctgggtcagcttcaggtcgccctccagtttccgctttgctcgctccaggtccatgcgcaccttcttctcttgctctagggatccctccagctgttggagggaagaaaataagcaaagtgtggaaaacatgaaatccatagtgtatgctcttttgcctccttctaaacttgaagtccagtgggattggaagtcaaaccaacagagaaatcctgcaagcacaaaggattcagagacctactgtagtgaggaactacagagagcaaaaaagcttcaggggccatagaagttaattctagggatcaggactttctgggccattggtgttgcctgcaaaatcttgctctgagagcaggagcatggttcttactactcacatcatccacctgctgctccagcttgaccttagacttggacaggctgttgaccttgtcttcctcaacctgaaggtcatccagggcctgctgatgggcctcttgtagagctttcttctccttggtcagcttagcgatgatttcatccagcccagccatctcctctgttaggttcttcacctgccgaccaaaaacccatcccctttagggtcaaagatcaccagcctggagacatctatggggacctccatgccaaggaccaggacaacactctagtctgggagtcttgaggagacctgggctgaagccagagggagctgccctcaccttgttctctgttgcatgcttctccttctccaccttggccagtgtcagctccaggtcatcaatgtccttcttgagctctgagcactcgtcttccagcttgcgcttcttggcagtgagctccgcgttcatctcctcctcatcctccagcctctcattcatctcctttactttggcctccagctgaatcttgtttttgatcagctggtcgcagcgctcctcagcatcattgaggttgtcttgttcctgggagaagagaacagggaggaagctgatggttaaagagaggagacctagggtcttaaaaagagctggcactcctagactcccagtccctggttgtgagatgggctataatctaggggaggggaggagagggctgaagagataatcacgtggcctcaccgcctgcacttggagctgcaggtcattcttctcctgcagcagggacaccatcttctcctccagctccttgcggcgagcctcggacttctccagcgtctctttgatgcgcccgaactcttccttcatggtggccatctccttctccgtctctgcgctcttcagcagcggcttgatcttgaagtagagcttcatccagggccaattcttgacccccatgaaggcccgaatgttccactggattaccagcagggcatccctggcaaggaaacgtggaggcagggtggggcactataaaagagagcttcccaatcatgggccctactaagcaagttcgtaggcacgtagacttccttcttgtgcacacccacctccaacatcactacactgaacatggagttgcttgataaatatttattaatcaatttgatgaaagggcagtttatatcctcccagctgggatattagtggtaatggaaactaccacttatagaatgtctactctgtttggtttttctattctcataagaacttcaaatatgttaaaaattatgtaggggtttacatataagaatgtctataataagtatgtaagttatgcagcatgaaagcaaaatgactatccatgaacctaccactgaaacaggagctgaaatgttaccagccattgatctacctgtgcgttccttcctacacccctgtcaccccgccaggagcagccgccactctgaatcttatttttcctttccttgctttttcaaaaattactttaaccacatatgaatgtatctttatttttattttactttatttattttgagatggagtttcactcttgttgcccaggctggagtgcaatggcacaatctcggctcactgcaacctctgccacccggattcaagcgattctcctgcctcagctcctgagtagctggaattacaggtgcctgccaccatgcccagctaatttttgtagttttagtagagacggggtttcaccatgttggccaggctggtctccatctcctgacctcaggtgatccgcctgccttagcctcccaaagtgctggggttacaggcataagccactgtgcccagccatatgtatgtatctttaaacaatgaatggctggttttgattatttatgagctttataaaaattgcatcatactgtatgtatccttccaagatttgcctttgtttactaacaatatgctttaatgttcaaacatattgtatcatgtagttggagttcacatcttttcactgttttataatattccactgaatgactgtaatactatttacccattcccctgtggatggaaattcaagttgttttaagatctttgctattatgaccaatgctgctaaaagattatttttcatgtcatggtgtacatgtataagagtttctctgtaggaatgtactcaggagtggaatggagaagtatgcagctgttcaacttttttttttttgagatggagtctcgctctgtcgcccaggctagagtgcagtggctcgatcttggctcactgcaagctctgcctcccgggctcatgccattctcctgcctcagcctccagagtagctgggactacaggcatctgccaccacacccggctaattttttgtatttttttagtagagatggggtttcaccatgttagccaggatggttttgatctcctgacctcgtgatccacccgcctcggcctcccaaagtgctgggatttcaggcatgagccaccgcgcctggcctgcagctgttcaactttaaaagatagtgataaactgttttcctaggaagttgcactaatttacacatctgtaagcagtgggtcaggcttcttaatttttgtcagtctagtgatttttaaaacttttaaaaattatttttcctttcattttatttttatctacttgtttctttcattttttaaaatttgtagaccatctgagcaagcaaagtctagtgttttaaaatggtatttcattggtgtcttaatttgcattttcctatagagaagtttctttaaaaaaaaaaaaagaagaagaagaagaagaagaagaatttgcaatgagattcgaagtggtaaagtaacttgcccaggccagctggtaggtctgaacccaggtcttctgacccacactagttgacattgcggatctgcctctacatctctagtgcatgcctcccttttcctcctgtctcacctgcgttccactatcttcttgaactcaatgcgcatgagctggccccgggcttgggcctgcatgcgcgtgatgatgcggctcagcctctcatcccgcatctcctccagcagcccaagcagccctgccttgaagaacacctgcaggcaaggggtagatgcaacaggccgcagcctcagaggggagtatccagggtggaagaccctggatgagctcccaggtgacccatcaccccatgccttctagaagtaagagtaaaaatttgacaaacaagaccggaatgaagcctgggtttcagcccttgataaggttgataaggaagccagaattaggcttctgcctcctaaactcctctctgctccactcaacatggccacctgccctgcaaccacccagtggggctctagactcaccttggtgtggccaaacttgtactggttgtgatcaatgtccagagagctgagcagcttctctgtccccttcctgctatcaatgaactgtccctcagggatggccactgggttcaggatgcgatacctgaggagggaagtgtccagagtcacccatgctctgcagtgatctgctctgcccacagaattccagggtcacctgcagatcccattcccatcagggcagcctggctccccctgttctatgagctctggggcaccctcatacccacctctgccggaagtccccgtagaggatgcggttggggaagcccttcctgcagatgcggatgccctccagcacgccattgcagcgcagctggtgcatgaccagggggttgtccatcacccctgtgtcaggagggaaggggaaagggtcagccttagggtaaagtggatgccagctgtcctccccagactaaggtcttctcctggctcacctggagccttccgctcattggggatgatgcaacgcacaaagtgaggatgggtggtcctcaggttggtcattagcttgttgagattttcctggaggcagatgaaggtggggagttaggagccacaaggaccatcccttaggcccttaaaccctggtccccagacactctccaccagaatcatcaaagggacaggggctgccacataatttgtgacgtgagttcaggcttttgtggaatctacacactaaaaaacgactacgtagccctagcttctttcctcatcaaactcaagcatcagaataggtggtgcagccagaagtctctgggctgggccattccaccaggtgtcctggcacccctgggcccttcttacccggtggagagccgacaccgtctggaaggatgagccctttttcttgcctcctttgcttttaccactgtcccctaaacagcgagaggagaaataatcaacaggagctggaaaataaaggagcccttgggcagaggcagagctctgctgctcgcttggtagctctgagactttgggcaaggaattctccaagattcagtttaccatgaggatgacagtaacaacttcccaaagttgtaaagaggattagataagaccacgcctgtagggcagctcactggtgcttgcccatagtaggcactgacatacatcagtgcccttagctctccctctacttgcccttccttcttatatctttccacattctagttctcctcctcctcctcctcctcctcttcttcttcttcttcttcttcttcttcttcttcttcttcttcttcttcttcttcttcttcttcttcttcttcttcttcttcttcttcttccttctatttttgagatggaatctcactctgtcacccatgctggagtgcagtggtgcaatcttggctcactgcaacctccgtcgcccggattcaagcaactttcctgcctcagcctcccaagtggctgggactacaggcaggtgccaccacgccaggctaatttttgtatttttagtagagacggggtttcaccatgttgaccagactggtctcgaactcctgaccttgtgatccacccgcctcggcctcccaaagtgctgggattacaggcgtgagccaccgtgcccaacctctacttttcttcttacactttatcctcttcatttcaagccacatcctttctcttccttttctgaactggaggctcttttgttcagtgtcctctcaacatttgttgagaactcccacatgcatcgttccctgctgggcatggtacagggatgcatgtgccaccctcactgacctccagttactccccatcttgaggaaacatgagacagctatatcaacactcataacacaaagtggagaacggcaggtgctacagaagcccagctggactgtggtgaggtgagccaggaggtggcttgactcatgggctcccctgtgcctgcctatggagtcatgtgctttgaagcagcaggaccctggccctttgtgtcttcagaagtcccctggcccagtgcaggggctgcctgcttaccagtatcggcagttgcgtaggaggagaagagagtggccatgagcttgagggaggacttctggtacagggccacaacagtctcgttgagaggatccttgtttttttccagccagcccaggatgttgtagtccacagtgccggcgtagtggatcagggagaagtgggcttcctgcttccccttgatgttgcgtggcttctggaaattgttggacttgcccaggtggttgtcgtacagcttggccttgaaggtcatgtcagtggccttggggaacatgcactcctcctccaggatggacatgatgcccatgggctgagggcagggtgaagaggcaaagagagaatcactgagcacactcccaggcttccacagtcccataccctgacaggaaaaggaatctggagccagtagcgctggcctgctgaaggggcgctgtgctggtacctcttaccctaaaacaggaagccaatattcctggaatttaaaaagccccttcctcctcctttctgcccagtgggtccaacaaagagtcatgcactcctaatcaccccccacaaggcccacagtgcctcacagcacagccccttctctctgatggctcactgccccaggggcaggagggcagggacagatgtgtgtcagaggcaccgggccaggctctgtctgtatgacaccagtagcaattcttcaagggttagatagaaggatccaggttctttaccacactctgcacttccaaaaacctggtggttcttgatttttcttggggcaggaatccttttaagaatttgttgaagctaaagactgtctctccagaaaaacgcatgtacacacacacacgtacacacacacacatgcacaagcacacacatgtatgtatgaatgtacacatgcttttttccacacacagttttatggcattctgagggctctgaaacatgagaactctggttaagaatctggataatgacccaaagcatgtggggaagctcccatttcatgaaggccgtggctgggctgggtgtgggtcagacaatccgggctctggcctatgctgacaaagagcagaggttcactgagagcaagtcagccccagcctatggggcctcccgcctgcggccttgtctcttctgaggaatgcccataagcaagagggctggagactggcttatttctcaaccaacaggaaggtggtgggaggccaaacatctctaatttcagcctaggatctttccatgaatgacgcttctcatgggcggtcagaggggccaggggcctctccttcactacatctcactcttaagacactgaggggaccaccacaaaggggcataaagtgcaaggtcctgggaaaggaagagtggggggatcatcctgttcatgcccatgacttcacagtggggagaagctgggcctggagaaaggcctgggattcttgggactctagtttcttgggtgtagaagggactcagccaccactttgtctggatggcagaggagggggcataggtggtgaggccaaggaggcaccttctcgatgaggtcaatgcaggcctgcaggtccatgccaaagtcaatgaatgtccactcaatgccctccttcttgtactcctcctgctccagcacgaacatgtggtggttgaagaactgctgcagcttctcgttggtgaagttgatgcagagctgctcaaagctgttgaactgcagggggcatgaggggtgggagcagtcagaaagtgggtgtgagtggccattggggctgtgcccgtgcactgtgccgagcccagcagggtatggctgtcccctccatgtcagggcagtggaggagggcttcccctgaagacagggacaatgactgcctctgtcaccacacagtccccactgccttcccatgtctggtccacagctggctctcagcaaatggctgttgaatgtaggagcaagcgagtgattgttctcccactcccaggggtcccaactcacgtcgaagatctcgaagccagcgatgtccaggactcctatgaagtactggcgtggctgcttggtctccagggtggcgttgatgcgcgtcaccatccagttgaacatcttctcatacactgccttggccagagccccgatggagtagtacacctgctgcacgctctgccccttggtgacatactcgttgcccactttcacccgagggtggcacagccccttgagcaggtcagctgagttcagccccatgaggtaggccgacttgtcagcatctggttgagagggaaaggataagtgagcacttcctttttttttttttaagatagaggcttgctctgtcacccaggcttgagtgcagtggcacgatcttggctcactacagcctccacctcctgggttcaagtgattttcctgcctcagcctcccaagtagctgggactacagacatgagccaccatgccaggctaatttttgtatctgtagtagagacagggtttcaccatgttgcccaggctggtctcaaactccttacctcaagtgatccacctgccttggcctcccaaagtgctgggattacaggcatgagccactgcacctggcctgagtgaacactttcagggagtgagcctccttccctgtcctggggccaagactttaggaagcatcaggtccaatttcttttccttaaagaggaagaaatcaaggcctggaagagcacagggcttgccttggttactcaaccaacgtgtgcctgagtcaggctggagcacagcccccttatccggcccatggcctcttgccacaactggctcttctcagctctgtctctacatctgtggcatctctgggtcaggtctttcacaagcactgctgtgggcatatccccaccttcaccatatccctcgcctctccagggcaagggtgtggctgaggggctagatgtcctctgctccctgtctccttcgttctctaccccagtgtctagccctggactggccatgctgtcttctccatccacatgttacccaatctgactggctgagagtatatcagacagtaccacgctcctacccccagccatccaaatgtgccacccaacatgggtatttctctgtttagaggaggagttatttggtgtaatttcaagaatgttgtaataactgttggtgtgttatcatgaaccccagcttgacactttgatctgggcagacttggagaagggtccctgaaggtagggaggaatgttcttgggcacctgtctagcactgtttgcaccttcacattttctcaaaggacctcacagtagccaccagaggagtgaggaaagattgttgatccatttcactgaggaggaaactgacacaccaatgccctgggctatgtcctgacccctggcccactgcctcccaaacaacatggtatgagcccacgaggggcttacccaagggctgggcaggcaaaggccctgcattagtgatggtgatgtgcagagctcaggggctgtgcttcctggggctgggggagtcttgggcacaggaggaaaattccccacctcagttctggtgagtgcagctggggttgaggagttgggattgtggtggactctctgtctgcccacgtctcccacgtccctgtccctcaccatcccacaacacaccccactgccccacaagcctcagagtctctgggatctgagtcccgcagagagcctggtcagcacctcaggccttcccagggctgcctgcctgcccctcccaccttcggtgccgtctggctccgcctgctcctcccgctgcttctgcttgaacttcatgttcccgtagtgcatgatggctcccgtcagcttgtagacgccagctttctcctctgaagtgaagcccagcacgtcaaaggcactctgggacagagcgagagacaaagaggggggttggagcggtggccccaggagctcctggggtccctcgaacggccgcagcagccccctcactcacatcggtggccatgagctcctcggagtcatcaatggaggccacggacacctctccctgagacacgaaggcgtagtcgtagggattgttggtgaccagcagcatgtctgcaccaggcaaggggtgaggcaggggcaagggggcaggcggagggcagggaaggggcaggtagagttgggaaagggagggaggggcagggaggggtaagggacggggtgaatggaggaagggaggacagggagcagggagagaagagaagtcagcaaggaccaaggagtgaacccagaggaagtgaaagggtagaagaggggccctggcaggggctccagtaacaaggaggagggagggtggcaggggagtgacacatgggagatggggaggcaaataaagaggagaaggcaaagacaagccgagggaggagtggagagaagggtggagaaggagtgaggtgtgtgactgcacagggaggcgagaggagacgcaggtggtcttgggagggaagcgagagggagctggcggagtgagtggagggagaagggaagtgagcagcaaggtggggcacagtggggagcaggagggccctgccctgcatgcaggagtcgttggggtgtgcagcagggacagcagtgggtggggggtggcaggcaggttcacccagcaactccggcttcttgttggacagaatctggtagaagatgtggtagtttctctcagctttcagctggaagatcacccgggacttctccagcaggtctgaggtgggtggaggggaggaaggcaggtgaggaaggaaagagagtagagccagaaaaaggtggccatgggggcagagggcagggggcacccacagcttgatgaagagggccaggcgagaagatgtggcttaaataaaaaggatcctaaagcccagaggcaaatgcagacaaaacaggagatggcaggaatgatgagactggccgccaggcagggagagaaggcagagggggacctagagggtggcagcctccctgctggtactcacaggtctctatgtctgcagaagccagctttccagtggccccaaagtggatcctaatgaatttcccctggggacgaatgggacagagtgagggaactggcgggaaggacagagtgaaatcctggccctctgttcagcccagaagccctggatggttctggaaatgtaaacgacctctttggtgtctcagttgagtataagtgaagccgggcagaggatgccaccctcacacactgtgcagggacctcctagtggaacctcggcccagaggggaacacatacagaatgcctcctgctcatacctctcatatgatctcacctaatcctcccagtaatctgcagggtggatattagtccccctgtttcacaggtgaaggaactagggctcagagaggtgtaaggacttgctgagcaagtggaaagtcagacctttggctccaaagcctatgctctcttcccaccaacgtgtgcatgttgatatcccaaagccagatacagtacaatcaactgggtgtggcaaaacagcaccccctttttcttgtcaaggctggatgaggccactgggagtggtcaaaggcactcacaaagcgggaggagttgtcgttccggacagtcttggcattgccgaaggcctccagagcggggttggcctggatgatctggtcctccagggtgccctatgaaaggagcagaactgcatgggttcatcctccatccacctccaggcagtggtgagagggcagggaggctgccctggccctgaggaatgggggtgcggggctgggtgaaccgctagtgggtctgcgactccacaggatcctacccagacctcagggtgagtgtctcctgtcaggaaggtcttccatactgggctgaccatcgggagcccagctcagtgtggctgtccccaccacgtcacagggaggggagggttaggggtaactcgggtcagcctgccccccaacccctgttctgccgagcctgtgtcccccatggcaccttgttcgcattggcattgtccttcttgccacggtcacctatggctgcaatgctggcaaagtactggatgacacgcttggtgttcacagtcttccccgccccggattctcccctgggggccacagagaccaatcaaaactcaggattcctactgttctccatacagggctcagcatcacatgctccccttcccagcctggccatcagagcccagcacccagcaggatttgcctgacatggttcattgctctggcacccctctaatgagagctcagtgccccatgctccctgcaatcccagccttaaacctctcctcccaactacaccctaggcatcagcgtgtatgcccccagcccagtcccttctgtgggaggatggcactcgctcacgtgatgaggatggactggttctcccgatctggaagaaaaaagaggagaagcaatggggtcagggctgaggatctgggtgggtgtctgggaggaggagcagagaccaggggccaccaggctcacctgtcagcatgtactgataggcgttgtcggagatggagaagatgtggggcggggcctcactcctcttcttgccccggtaggcggccaccacctcggcattgtacaccggcagccacttgtaggggttgacagtgacacagaagaggcccgagtaggtctggagcaggagacaaggctgggcatgaggttggtggggagagcctgggacaggcagtggtggcagccaggcatgtccctgttcactccagctggctctactcctcctgcagctgactaggggtggaggggggaaggggacttgggtcccttgggagtctctccccctcttcttgggagagcccccctggcttatttaggcctccacgcagcacaggaagcctctgcagtgtgcaggagccactcacatatatcatccaggccgcgtagcgctccttgaggttgaaaagcaccgcgggctcgtgcaggaaggtcagcatggccatgtcctcaatcttgtcgaacttgggtgggttctgctgcaacacctggtcctccttcacagtcaccgtctggagggggcgcataagcaggaggatgagtgaccacaatccctccgggacccttgccagcactgcccactgacctcctcccaggacacagggacttggccttgctccccttgctctgaccagtgccccggcccctaccccgatgtcccctgggacactttccccaggtaatttcccttcccattgtatctcccatcctagagactgtcctagggtacctttctcttgccagatccccagaccatcctggggacaccctgtgcccatgaccatcactcttcagtccctatgttccaagggtcttggggcagacctggagattggcagctctcagatctgtgcacaccttatgctgaccccgaggctgtctcccgcgggcagcgctttagggtatctgttgctcagggcaaaccttcacccctgctggaaaagtagttcacccatctactccacactccccatccatcactgttggtgtggtttgattggcagcagtcagtttgccatgccctgatgtcattagatcctgccagtaggtattccagtgttttttatagtggagaaatccgtggctctaaatgactaaatgatttgcctgcacagtgactagcgggtggcagagctgggatcagagtcaaaagccccaggggattgtggcctgttattctacacttcaatgggttgtaacattcagtcaacgagttcatgaggcacacagccctgagccgcagctggtaaccaggggtgattctcttggctggtgtgagcaaaccagggaccagagcttctgagtgccagtcaaggagagtgctcagctcaaaagtttctgatctttgtgttcatctgggtctaagaattactcttgatttgggtgaacggaatttgagaaagtggactcatggaggaaactgaggcacagggaagagggatacaagtgcaagaagggggcatcatttaatgctgtgtctgtgccctctttatctacaagacccctcttaggcgaacactgaggttcttcttcctcagcatcctctctggcagggggaacatggccctgggtggcacctgttgcaccagctcaggtcaatttgagagggatcagattctgggctcctcaaaggagcatgtcctggcatccccactggccttggcttttctccagccctctcagctccccctgcaagtggctccacctctgcatcttctttcccagacctccttcccttctgccccggcgccatgccctactcaccttcccattctcggtttcagcaatgaccttgcctccctcccgggacaaaatcttggctttgacaaactcttccttgtcatcgggcacgaagcactcagtgcgaatgtcaaagggccgggtctgggcctctagacgctccttctctgacttgcggaggtactgggccgctgccccaaagtcagccatctgggcatcggtcatcttggtgcttcccctgggtcagagacaggagggctatgttactcctgagggagcccaggctccagcgagtggctttgtcctctgcagcccccctccctacccccgctcctctcctccaccctgggagaggcacctgctgttgcaccctcccctactcagggctctgcttctcctgccctctgaggtgatgctgaaggacaatctctgtaaggggtttccctggggtggcattggctggagtatgctaagggttggcgctgagtgcttgggacagcagacccctggtccagcaatccggctcccaggagaagcatgccccagtctctgcagagaaaatgggggcagttctcacctggttatcccttcacggagaatcctgaagaatctggaccgtgggtggagcaaggaacaacagaggtagagccgggcagagagaagaacagatgaggagagtgaagaacaacagaggcaggccacccggggatggaggcagccccagagcgcagacaggcaggacagaccagggagtcagaaagggaaagacgcagaggcagaaaagaaagggcaccgagtcaatatgagtgcgagggacggggtgtggaaacagggttagaagcagagaggcagggaggtgagaacacgtgccaagaaggaaggacaagggagagagacaaagaagcatgattgtgacaagtgtcgatgaagaccaagaggcaagataaaaccaggatcaagggaaggaagccatccaaaggaggaaggaagatggaaagatggagacaacatgtaggagactcagaatgatgcagagaaagaaatggagagtcagagaaggagaaaagaggtttctgggtttcctgtggaacctccttgtgtcagggggaacttccctgggcctggagataggcagttttaatagagcccttaggcctccaactgacctgcaccccactcctggtgaaggaggtccctcacggtgggggctctgtggacgggctgcagggcatcccaccccaaacctcctcttacctgggccgcaggagtctctctatct

SEQ ID NO: 758 - DNA, 22925 bp, Homo sapiens
atctcggcttcaaggaaaattgctttattctgcttcctcccaaggagctgttacacaggctccagcatggggctttgctggcacctccagggctgagcagatcaagatgtggcaaagctactcctcattcaagcccttttgaaaggaaacaaagtccaatcagtccttggagagatggtattgggcagggacagggcatgggaacaaaggtgagaggggtctgatggtggggggcctgctttgtgggcaggtggaagcccctgtggcagcagcacatgtgtttccagggatcgatgttcggggggcaagttctggagggtagggttctggggttggtcagagggaagttgcctgggcgagaacaaagccaggcccgggttctctgggatgtccattttaggtttgagttacaagattgcaggacaaaattaggtggaagggaactggaaactagcagttggggggaaactgggatatactggttgtatataaattagggtcttctagggtggcacccctccctaaggctgaaattcccagaaccactgaaacttagagctgagctgggagtggtggctcacgcctgtaatcccgtactttgggaggctgaggcgagtggatcacaaggtcaggagttcaagaccagcctggccaacatggtgaaaccgcatctctactaaaatataaaaattagctagacatggtagcacatgcctataatcccagctacttgggaggctgaggcaggagaacccaggaggcagaggttgcagtgagctgagattgtgccactgcactccagcctgggcggcagagtgagacaccgtctcaaaaaaaaaaaaaaaaaaagttagagctggaagaatccttgaaatcacagagaactgcattaccttggcctctggggccatgtggctcaagtgtgtggaataaatgaaaaggaagcatcccgggtttgagggtgctctgtctgggtatgcctgctgtgggggtgactagcaaagcccaaaagagggacccaccttcgtgccaatgtcacggctcttggcccgcagcttgttgacctgggactcggcgatgtccgcccgctcctctgcctcatccagctcgtgctgcaccttgcggaacttggacaggttggtgttggcttgctcctcctgcgggaggtgggagcatgaggtgagagggggcctgggttctcagactcctggcttgggggacgagctctcctatgcctcccctgggcctagtccccagcagggtcactcaccgcctcctcggcctggcgcttgtaggccttgacctttagctgcagcttgtctaccaggtcctgcagccgcagcaggtttttcctgtcctcctccgtctgggggccagagggtaggcagggggtgaagatggcacagtcatagaaggtagcatcccctccgccctgccctgcttcatctgatatcctgacccaattctactttctgatcctcactaaacacttgaattctccttataatttcttaccaaatatgtgtaaatattttaaatgatctgtaccaggaaagagtccaaagaactagtgggactcctgaaattatgcacaaaattgtgtgtgtgcagtgctccagggagcaggtttttcagggtccggggaccccatgcgggatgaagtcccctgctctggacctcggcacatgctgggagtgactttggggctatgagtgtgatggaatttcctgggctgcaatgcaggccaggaaaacactgacttaatctaagttaaggacaaagtgtgcttagagagatagtgacatcctggattggaaaagaaacaaattctaattcagagtctgattctagaaaacacctcagaaagctagagtccacactgccctgggcaatgaaaaagtttttatgcttgtttgaatgggatgggtgtgtttttggtgtcttttgggggtgaccctggctacatatttgctttctggtgagctgtactgggtgagctttgtctggaattctgtgtgtgtcccctggcgatgggctaagagtgggtgttgagatggagctcccaggccaggaggctcagagactgacctctgagctaggggacattcagagtggggcagggctaggcaaagtgaaacgggggctgcattcccatcctcgccctggaagaggctaagagcaaactcttcattctcctcagctggttgtcactgtggctatggtgccagggctctgcctggagtcaccgcccgtcgcacctggtaggtgagctccttgatgcgccgctcgctcttcctcatgcccttcaccgactctgcgttgcgcttctgctcggcctccagctcattctccagctcccgcacccgcgcttccagcttctgcagctgcttcttgccgcccttgagggcgatctgctcggcttcgtccagccggtgctgcaggtccttaatggtctgttccatgttcttcttcatgcgctccaggtgggcgctggtgtcctgctccttcttcagctcctctgccatcatggcggcctgtgtgcaggagagaggtggcacatggtctggtcaagtcctcacacacttgctgcccagcccacggagagacactggtctggatcgggtcggtggagtgggggacttacatccgtgatggccttcttggccttctcctcagcattcctgcactcctgcactgcctcctccacttcagtctggagctgggacaggtcagcatccatcttcttcttctggttgatgaggctggtgttctgggttgggggagggttgggcagagcaggaaaagcattgagcatctatgcatagctctcaagccttgcttgctgagccccagcctgtgctcccttcaggaatgagcaggggagctgctcacctgggaatgcagcagctgcacccgctcactagtctcaatcagctcctgctccgccagcttccgggaccgctctgtctgctccaccacggcacgcaactcctccagctcagcctgcagcaggttgttgcgccgctccacgatggcgatgttctccttcaggtcgtcgttggcacggactgcatcgtccagctgaatctgggtgtcctgaggatcaggagagtgggcatgagcagggagccagcctcggttcccttcactaaaggcacctgtcagaggtccctgcagtaacctaggggcaggaggaatctggtgcctgtatcaagacactactgcttcgccaggccacgtggaggccagtcccctctgggtgagtaccttcaacaagctctggaggctcttgacttgcttctgggcctcggcggccatgcggttggcgtggctgagctggatctccatctcattgaggtctccttccatcttcttcttcaccctcagggcctcgttgcggctgcgtgtctctgcgtccagggaggtctgcagcgagtccaccacccgcaggtggttgcgcttggcctgttccatctcctcgtccttctctgccagcttccgctcgatctctgccttgatctggttgaactccagctgggcccggaggatcttgccctcctcgtgctccagggaggcctgggaaggggttgggggaggggatgcaggcagacagtcagggcacagggcagggtgggggcctgctcactaatcatggatacgaagtgacttcaagagtggtgtaagtggttcaaagaagcagaaggtggaggaaaagagaatctaagagaaaataaaaataagcctaagagaaagtgattcaggccctcacaggggagagccagctatgaagacaaggaggaaaatgaagagaaaagtgttgccaaggaaacagaggcaatcaggtatagagtataaaagaaaacagagggaggcagaggtgggaaccgggaggtatgtggaaatgggaagctcagctaagatgcaatgggtaaaatgtttatgtgaagagagttcagtgactggtcattcattcactccacaaatcttcactgaatgcctactatgtgccaggctctgtcctaggctctggggatgggacagtgaacaaaacggacaaagcgggggatgagaacagggaccaaaagcctggagctcagctccctgcaccccgtgccctgcacacacacacacctcggcctcctccagggctgactgcagctccatcttctcggcctccagctgctttcggaccttctccagctcatggatagtctttccgctggaacccaactgctcagtcaagtcggagatctcctctgtgtggggaacacggtaactcggttgagggctgctgaggtccagtggagttggagggacacgcctctttgcccagacgcctcttggagcccttgggtggcaccatatgggaacactgccagtgcagcccctccccagcctcttgggcccccagcacaccctgcaggtttttgttctcccgcttgaaggtctccagatgttccagggactcctcataggcgttcttgagtttgaagagctctgtgctgagggagcgagcctccttctgcgaggactccagctccgactgcgactcctcatacttctgcttccactcggccaggatctgcccggggacaaggctcactcttcagccccccagcctcagccccatgtccagggtctgtctcaggacctgcctgggctcagccctcctcccccacctccaaggaggatggctctggcctctcactgaacccctcatgcccccttgccctgcatgctggctgcggcccccacccagggcccaccttgtcgaagttcctctgcttcttgtccagggctgcagcagcagcattggagcgctctacgtccaccatcaagtcctcgatctcattctgtagccggtgcttggtcttctccagcgaggagcacttggcattaacagcctccacggcctcctcagcttcctgcagccgctgggccagcttcttcctgcccaggggagggtggcagagggtggggaggatggagggtgtggatggggacaagaggaaacaacatgaaccttctcaaagacaatccttgaaacctcagaagtgtagctggagaagcctgaggacaggtcccaggggccgagaacatcaggcagaggatcccagcagggcgtggagacccaggcaccctctgaccctggcccagcctctgcgctatggacattgaggaggtatgggcttctgcagccctccccactgcctttccctgccacagtgccctgccccagacggaagcactctgccctcagacaaaccttttgttcgtcttatattcggatcagaaacataattcgagcaaaaagcttccctgagaggagaaggaggtggggccggggcagagtcctcctgtgttgtcaaacactagctaagcatcgcctgtgtgggatctgctgaggctggggctgggctgagtcctgcctgcaaaggggcctcagccagaagtcaggctgctcagaactcacttggcctcctcgagctcctcagtccgctgaatggcgtccgtctcatacttggtcctccactgggccacctccgagttggccttggaaaggacgcgctgcagctcggccttggcctccgtctcctcctcgtactgctcccgcagcaggtcgcagtcatgccgggccgactgcagtgcgtgggccagggcgttcttcgcctggggaggggtgggcaccaggaggtgggttcagctttctccataaagcaaccccacccttgcccttctcctcaccccaatctcaacatcatcccttggcctcatctatgtccaaacccccagtggacctgtcatggtttactgtttgctgataacaaagaatgccaatacagcagtgaactatttaagaaaagcttcatggccattggccctgagctcctccccacaccagacatggtcatcatcaccgccattttacctggctggggagagggaaacaggctcagaaaggttaggggacttccctaacctaagatcactgagctataagaggcaggttagtatgaaccctggagttttttaaaaatcatgttctttctcctttttcatgagtccagcaaagtgctaggaataggctccagttgaatttctttctccagttttcaggtggccctgcaaatcccaggacccatttgtgcagtccctacatcccctagccgtgcccgggcaaggccatctcgtgcctccctagttcattttctctcctccttctcacaccctgcctcccgtccagggatgcagcagaagcagagggcctcagcctggggagtagatggcatgtggcagggtttgggctgtgatttctttttagaattcttggagaactgttggtccacagccagccttattgctgggaagggaagtgatttgatgcaaggctagtcagtgtgctccttgcttgggccaggtggcccgagtctagcccttaccttaacctcctcctccagctgcctcttgaggtcctccagctgctgggtgtaggtgagcttgcctcgggtcagctgggagatcagtgcctccttctcatccagctgccgggacagctcacctggggaagcaccattctagatcagcactcctctctatccccacctcctcctctagccctcaggccccattttctggagagactctgtgtctgtgtgtgcgtgtattggcttgtgcccgaggctggagtggctcaggaggttggggagactgtggtgggaaccatggagcccctgctctaggctcaccattctcggtttgcaacttggcccgctggctggtgaggtcgttgacagaacgctgggtctcctccgccttgctccggtgctcattcatctggtcttccaaggtccggcacatcttctccaggttagcctgagaagggaaggagagttatatgatggatgttgggggcggggggaatgaaggggtgtaagaggtgcaactgaaggagaaaagaagagggaaggtgtgaaaagaaggaggggatctgagaaccaggcagaggaagggaagtgggaaaatgaaccatgaaggaagagacactacatggacagaaaggggaggtgggaggaggaagttggaggaggggaggccgagcagagcctgccttggccttgatgatctgctccatgttggaggtgacgtcatccagctccagcttgaactcgctcttctccttctccagcttctgcttcacccgctgcaggttgtcgatctgctcgcccagctcggccacgctgtcggcgtgcttcttgcgcagggccgcggcagtggcctcgtgctgcagcgtggcctcctccaggtcccgccgcatcttctggaactcggcctcgcgcttcttgttcatctcgatctgcacggacgtggccccgccggcctcttccagccgctcgctgatctcctccagctcccgagacaggtctgagcgcagcttctccaccttagccctggcggtgcgctcggcctccagctcctcctccagctcctcgatgcgtgcctggtcagacacaaagggctcagacccaccgcctggacccctccactggaatccccccggctctaaaaggctctcggcttctctggaacagcaagtcagtttagctcttccagtggagaggtgggaattaaaggatttggggaagatagtttgaagagccttcctttaggcgagggcctgacagtctacatgctctttattggaaggaaagtggttgaaacttgctcttaaagatggacaaagagacctgtgttctggggatattttaagcagtttagtcataaaaaaataacaaaagttgaaaatgagagagccgtatttgtctgaccagacaactaaagacctaacacagcttctgctctagagtaaggaggaaagtcatgccatcagagtcgaaggactcttaaaaacctccatgtaacaggggagggcatggagacccagagatctggagtgggctcccagaggtcacccaactaaggcagagctgagacaggaagccaggaattctgccctccaggcctgtgaccttttcagggtctctgtggatcacctgaccccttttggatgtatccatgggcacactgtgatagctgcgtgcctgcctccatggacacataatcagttcctgtaatgctgtgaacaggacaccctagaggagggggcaggggaaacagaaccagcccagggactcagcatcccgcgtgggtgtccagacctcacctgaagctccttgagcttcttctgcagctggctgccgagggcctgttcatcctcaatccttgcgttgagagcattcagctcaaagtcttttctgtggggaaggagggatggtgaggtaagggagactcgtggggcctcaggagggtccaccagtggttgaaaatggtaatgatacaggtaaagagtaggatttcattagaaaaacagcttctgggggtgatgtaggatccctggaagtgtaacacctgcggtgagattgaaatccaacaagaatgtaatgggaggagtgctgtagacagggtgatggggcctgggctctacaggacattcccatctttggtccttgttttctcataatgtaaaatgagggggtcggactagattgtttcaaaggtcctttttagctctgatggtctttaattttgtcactattgctttgggtaactcagctaacctttctgaaacttattttcctctttggtaaagtgaaattaaagataccatccttaaaaggtgttttgagaatcaaataggatcgtgtatttattcatttattcaacacattctgtgcctgggaaggtatgaagattcctgtgcaaacacaaacttgatgaggatgtagattatgatgattctcaaagcctttcaaagtcctgagcctgaaacaccataagaccttcaattatcaaaatatgttctgcaagctcactgtttaccaagtctggaaagtctatacattttggaagaacttacactaagaattggaaccacaagttaagcaaaacaaagaaatggccctgatcccctgacttctttaatgtgagggcatttcttggtgccctgtgggctctctgtgaaaagccacaaagggactttcctaagaggctctcatgtggagccttcctccatgtcaaggaactggtctccaaagagagatgtgtatgaagggggaaggctgttattttcattcccactgagtgcctaacaagaagaaaggactcatgggatacaatggactttttgccagggaggaccatctaactaaccctgatatctgggactaggggaggaaagcccttgcctgggaggccttttcccatggtttgcgcctccacttgtggaggctgcgtgaggttgttgcctcagaggatggctgtcttgggtctgcttgtactgttatgggctggggaggaggaagggcagcagggaggggacacagtactttttcagccgctcatccagctgctgcttgtcattctccaggtccatgatgctctcctgggtcagcttcaggtcgccctccagcttccgcttcgctcgctccaggtccatgcgcaccttcttctcttgctccagggatccttccagctggtagagagaaggagccaggcccagtgaggcaaagcatcctgacttggtgattttgttgttcagttacctcaggacttggtaaatctttgtgttcaggacttgggaaaccttccccagagtgggccaaatgttattaggggactgtgagattgcctagatataggggatgctgaatcaatattttatagataaaggaataaatgactgtgggatgaaaccccaaagccgtattctttctttctttccctttctttctttctttctttctctcctttctttctctccttccttccttccttcctccttttttttttttttttttttatggagtctcactctgtcgccaggctggagtgcagtggcgcgatctcggctcactgcaacctccgcctccctggttcaagggattattctgcctcagcctcctgagtagctgggactacaggcgcacgccaccacatccagctaatttttgtatttttagtagagatggggtttcaccatattggccaggatggtctcgatctcttgacctcgtgatccacccgccttggcctcccaaagtgctgggattacaggtgtgagccaccgcggctggccgccgtattcattctttcagcatcctataaacacctactgggcatcaggctctgtgctaagcactgcagtccccaaattgaatagatctaagttcctatctaaaggaagcttgtagtcttatggctgagatagaagcttaaataattaaaatacagagtgataagtgagtcaacagacatatgtgcatcagagggaacaatgatcagattctgccttaaatattggaatttcaaaaattctacttggggagcctcacaaaatttccaaagaaatttatcatgttcttatgagatgaccctctaaatcttgtgtcaaaggcagagatatatgggattgcacttaaattaaataagaaaactcatctctattattgatcataccagtgagattagatacataattcagaattgatcaccacctctgacttttcattccccagctcctttctagaaagatatcagaaaagttaacatcctctaaccctacccccctctaaacataaacacaaacacacacacacacacacacacacacacacacacacacacacacacacacagagctctgggcacagatagacatggcatatctaggccccacaactctcaatctactcacatcatccacttgctgctccagcttgactttggccttagtcagggtgttgaccttgtcctcctcggcctgaaggtcatccagagcctgttggtgggcctcttgcagagctttcttctccttggtcagcttggcaatgatctcatccagcccagccatctcctctgtcaggtttttcacctgccgaccaagaatcccatctcctttagggtcaaaggtcaccagcttggtgccatctgtggggagctccatgtcaaggtccatgctgctctctggatgccgagtggctagcctgggtcaaggtcagtatggtctgagagtcctgatgagacccgggctggagccaaagggagctgcccttaccttgttctctgttgcgtgtttctccttctccactttggccagtgtcagctccagatcatcgatgtcccttttgagctctgagcactcatcttccagcttgcgcttcttggcagtgagctcagcattcatctcctcctcatcctccagcctctcgttcatctccttcaccttggcctccagctgaatcttgtttttgatcagctgatcacagcgctcctcagcatctgccaggttgtcttgttcctgaaggtgaggaacagaggggaggctgttcagggggtaaggtcctcattcttgcaggtagagggaaggagaggcacatcactcaaataggagggtaactctaggatatccccacttggcaagagcttcagaagtatggggaggggaagagtttcaggatagtataacttgggaacactggggaggggagcagagaggaaaggaaccagaaatcttcatctggacctcttcctctggtctcctccatcgaagggtgggaattgcatttgctgatgccaagcacttatgtatgatggcttaatgaaatggacagctttattccctgtctagaggaaattgaggctcaaagatgatgcatggtctgcccaaggtcacaaaataattaagctgtgtatctaggttgaacccaagtagaaagcctgtgcttttaaaagtcagctcttttccctctgccctttcctcctcctgagggacctctttggaggtctttagaagtgttgatcccagagtcctctgactgaaggaacaagacagtgagcccctgtgcagggaggtgcagggttgtgggaagtgaaggcagagcagggtggaagagccaacagtagcccaggagcctcaccgcctgcacttggagctgcaggtcattcttctcctgcagcagggacaccatcttctcctccagctccttgcggcgagcctcggacttctctagcgcctctttgaggcgtgtgaactcctccttcatggaggccatctccttctctctttctgcactcttcagcagcggcttgatcttgaagtagagcttcatccagggccaattcttgacccccatgaaggcccgaatgttccactggattaccagcagggagtctctgcaggggcccattgaaaggagtgctgagcctcctgcctccttcctacctgaggtcctgaaaccttgggaatatcccatttccttcatccctcccacccttcctgaggcctctgaccctgtgactgcagtgtgttcatatgagcccctcctgcaggtctctgtgtttgaagatctgctgagctttttttcctgacactgcccctgaaccagcctgggcctcagagaagcgggaaacctcctcttgagatctctcacctacgttccagcagctttttgtactccattctggcgagcacacctcgggactgggcctggatacgcgtgatgatgcggctcagcctctcgtccctcatttcctccagcagccccagcagcccggccttgaagaacacctgcaggcaaggtgtgtgttggccatgactagggaggggtacgagggaaagagatggtggggattaccttaggaagggtaacagcctagaaaaggattgcagggaggaggtcaatggcagctggagctgggatgaggggagtggtgctagatgttccactgggaggggtagcatacaggtaagagattttgctaagatgattacaacaggaaaagcatcagaggagtcaatggaaaagagatgtcttcctttaattaattagtctcctttcctcaccttggtgtggccaaacttgtactggttgtgatcaatgtccagggagctgagcagcttctctgcccccttcctgctatcaatgaactgtccctcagggatggccgctgggttcaggatgcgatacctgaggagggaagtgtccagagtcacccatgctctgcagtgatctgctctgcccatagaattccagggtcacctgcagatcccattcccatcagggcagcctggctccccctgttctatgagctctggtgcaccctcatacccacctctgccggaagtccccgtagaggatgcggttggggaagcctttcctgcagatgcggatgccctccagcacaccattgcagcgcagctggtgcatgaccagggggttgtccatcacccctgtggcaagaaggaagtaggaggagtctgtgagaacactggactgaagttctgggttctgatcctggctttgtcactgattagcttgtaatcttagcaagtcagttagtaataatcatttgtttcattttcttctagccacatttttaactaaaaggctttcacattccttttttatatgattcacacctattatcataggtggtagccagaacagatatatccaatgttctagatgagtaaattaagcccagaggggttatgggactggcccaagttcactaagctgatcaagaacagagccaggtcttgaacccaggtccctgagcctctgtctcctaattagccaaaaatggattaacaatttgaatatgtctcattgggggattaagtggttctgcaggtaaatttaaagttgaactaagattctgtcttggacaaccagctatccaaggggttgtagggccactgatgaggtaatgtccatcagagtgccttacacatcaccctcattacacactgcaagtgcaaggtagcgctgagagggaggtaccctgggaggcctcatgcgggatgggaggagaagaatgtggtttggaaaccactgtggtggtaggtagggagatgtcctaggaggtcctgttcccagggcggtgtatgcccagcagtgggttggcctgagtttgtggcctcacctggagactttgtctcattagggatgatacaacgtacaaagtggggatgggtggagcgcaagttggtcatcagcttgttcagattttcctgtggccaaaaatgcaatagagaaaagtaaagaaaatgccagaaagagatgcaggaagaagagaggagaagaaggaaggaaaagagagatggagagaattcgagaagtcacagagatgaaggggccctgggggcagacagggataaggagagagggtgggagacagaagggaaagaggagagaagggagatgggaagtaaataagtgaagaggccaggagatgacgggaagagaagacagagtgaaaatggtcccgaatgcaccaaggagacagggaacgggaggagtaggggatgaacaaggcagggaagggtggggctgggtggggttgggcagatggggagccaagttggctggggctgtgtcccactcaccctgtgcagagctgacacagtctgaaaggacgagcctttcttggccttgcctttgcccttctcaatagctgcaggaaggagagtcaacaaaagaagcatcagtgtggggaggtagggtgtgagtaaagaatcacagcccctctttacatccttgctggcatttggcccctgggtgagggccttcaatgtggctgcctcagtttcttcacccagttccatcccactgagtctgtaaaccttggggtacaacctgacattgaagtggtggggtgtagcaattgacctggctcagaaccttggcagaatccctgctcctctgtaccgggagcctcagtccctacttacgcgcatcagccccagcatagttggcaaacagggtgctgagcagcttgagggaagacttctgatacaagcccacgacagtctcattgagaggatccttgttcttctgcagccagccaatgatgttgtagtccacgatgccggcatagtggatcagggagaagtgggcttcaggcttccccttgatattgcgtggcttctggaagttggcggatttgcccaggtggttgtcaaacagcttggccttgaaggtcatgtcggtggccttggggaacatgcactcctcttccaggatggacatgatgcccatgggctgaggaagcaggagagagcatcactgagtgtccttcacacaggtggacatggattctgctctatggtcaatatacttgctcgtggaggtgccatgttgggtgttaaggtagtaggctcagctctgagtacagttatctactgactggaaccggttcaaggtggaggattttgtctgatgacagaaggacctttgtgaaagtctgggaatatggattctatcgatgctgtacacaccactccacgacccagatgcctgagatgctagggttgaaaataggtgcactcttatgatcccctacaccaccctcacacttcctgatccttggatgcataaaccaggcccaataaacatgcaggtgtgggaggtcatcatgcaggtgcccatcctccatgtgtccactttcaagcccctgggaaatcagctgtccctggtgccaccctgtcctgggtgctcagcacaacataggctctggaaccaagggctcggatccttcagccccttctatttttatattccccagaagggagaggggctgctattttgtctatggtgttcttgttgggtgtgcagggagaattcaggtggtaaggccaaagaggcaccttctcgatgaggtcaatgcaggcctgcaggtccatgccaaagtcaatgaatgtccactcgatgccctccttcttgtactcctcctgctccagcacaaacatgtggtggttgaagaactgctgcagcttctcgttggtgaagttgatgcagagctgctcaaagctgttgaactgcagggggcatgaggggtgggagcagtcagaaagtgggtgtgagtggccattggggctgtgcccgtccactgtgcctgagcccagcagggcgtggctggtcccctccatgtcaaggcagtgaaggagggcttcccctgaagacagagaaaatgactgcctctgtcaccacacagtccccactgccttcccatgtctggtccacagctggctctaagcaaatagctgttgaatgtgggagcgagtgagtgattgttctcccactcccaggggtcccaactcacatcgaagatctcgaagccagcgatgtccaggactcctatgaagtactggcgtggctgcttggtctccagggtggcattgatgcgcgtcaccatccagttgaacatcctctcatacactgccttggccagtgccccagtggcatatatcacctgcaaggtggaggagagacccatattgagcagggttgttgggaagagtgaacttgaaaactctcatcccaccatgccagtctccctaccctgcccacccattatcatctgaagatggacccacctgctggacattctgccccttggtgacgtactcattgcccactttcacccgagggtggcacagccccttgagcaggtcggctgagttcagccccatgaggtaggcagacttgtcagcctctggaaggaaaaggcaagtagcaaagttggtaaagagatgactgctggccaggtgtggtggttcatgcctgtaatcccagcactttgggaggccaaggcaggcggatcacttgaggtcaggagtttgagaccaacctggccaacatgatgaaaccccatctctactaaaaatacaaaaattagccaggcatggtggtgcatgcctgtaattccagctactcgggaggctgaggcaggagaatcacttgaacccaggatgtggaggtggcagtgagccaagatcgtgccactgcgctccagcctgggcaacagagcaagactccatctcaaaaaaaaaaaaaaaagaaaaaagagaagagagatgactgctgagcagacatggccctccatgacttgacagctgcccccaagaatccctgcctcccaccttcagtgccgtctggctccgcctgctcctcccgctgcttcagcttgaacttcatgtttccaaagtgcatgatggcgcctgtcagcttatacatggagtttttctcctctgaagtgaagcccagcacatcaaaagcgttctgtagggaggccccatattggcggaccccagaaaaagaagtatgatgggtaagtgagatcccttgtaagttggagagaaaacttgtctccttaatccctgtgggttctgagactcccatacccagtggggagctccaaaacaaaggatgtaagatgcagggaactccaaaacaaaggatgtaagatgcaagagcagagcagacgtcagttggccgcagccccagtgtcagtggccacagcttttctgagttacccacttatgcttcctggccctacacttgcttcctgcctggccttccatacctgtctgcatctgttcacctaacagcccctccagccccatgccgtctgcatggccttccctcctcgtcctgctccctcggtgatgcttgtttcttggcttgtgtgtctctctgtctcatggctttcagctcttcctggtttgatagaacaccagatactggccagtcctgtctcacctcatccattccccagtacaccctgatcacagggcacattctggctctcaggaggtccataccactttaaacaaccaatggccagcgtcttagctctgcttttggacccctgtttgcccctcactgccaatcctcccaccccctggctgggtcctcacacactcacatcagtggccatgagctcctcagcgtcatcaatggaggccacggtggtctctccttgggagatgaatgcataatcgtaggggttgttggtgatcagcagcatgtctaggggaaaaaacatggttagggtgggacacaagcccccggctctcatggaggctgctcgccacagcacatggcctgaggaagagcacaggacagggcttggcttggccccacatcccactgaattgaatccagcagtgccatgaaacccagggcatgccagctgagtccagccacaagcagaggggaccaggttgccatggagatagttggtctcagtcggtggctctgactcacccagcagctcaggctttttgttagacaggatttggtagaaaatgtgataatctctctctgctttcagctggaaaataactctggatttttccagaagatctgtgaacaggtggggagaagaaggagagaaagaaaagttagggtttgggcacaaggaaaattaatgataaatgtagcaagcaaaaggcagagggaagggaagagccagagagactagttggacagacacaaagagatcacacagagagatggaaacagagacccagaaggagagaaatagtctcagagagaaatcccagagaaagacacctagccatgcagagacagaaatggagaaagatgcagaggaagtctcagagagagacagatatgtagacctgaagacagagacacctacagacagagacttaaagaggagaaaaacagagggagggaggggagagagagagaggtcaagaccagatggtctagagcaagggtgagcttaggctgagcctagcagattcatggcactcacaggtctctatgtctgcagatgccaactttcctgttgccccaaaatgaattcgaatgaatttcccctggagagatggaagagagtggtgatgagttgggggaaggctcatatctgagaccattcctccaccagtccaagtcccaaggccaaggtcagggaccactcacgaagcgggaggagttgtcgttccggacggtcttggcattgccaaaggcctccagagcagggttggcctggatgatctggtcctccagggtgccctgcagaggccaagaaggaggcaggtgagagctcttctccctccctttctgcggtacaggaccttggagggcagcaggcctaccttgcccgggctctggtccttcttgctgcggtccccaatggctgcaataacagcaaagtactggatgaccctcttggtgttgactgtcttccctgctccggattctccgctgtgaagacaggggcttattgggcagtgaacaatactactggagaccagcaagcctcaaatcaggagagaatgcctgggcctacccgagagtaggagccctgggcaagaagctgccaggttatctacacccaaaatccacaactgtcttctgatgcacagaggtcagggctggcaccaggaaggatgccaccagaaggcactggtttgggcaggctgagcctgtgcttggctgggcaaagtaaacaggggagatgggcctgggctgttttgggaaaagttggtagggctggaagaatgggaaatgtttctgaagggaaagaaaatgcagaggtgaagacatggcgataatgagcttctggataaacgcgtgatgagttggagagtgggtgaaggaggtgggagaggaaaaacatgaaggggatggaaagcagaaaggaagagggagagcaaagagaggggtcagggtaatggtcagagaagaaggagatgggcacgaggttggggggaaagaggctgagtctatgcctcggggcctgggacacctgatggggctggaggctgggatcagggagattctgaaagggaatacagtagcagctacactcacgtgatcaggatggactggttttctctgtctgtggggagagggtggggaggaaaggtcaggagctgcacaggatgctctcgtggggcttctcccttccttctccctctccctcccggcctatcccagttcccttcaggaagacccttccagggcctctcacctgtcagcatgtactgataggcgttgtcggagatggagaagatgtggggcggggcctcgctcctcttcttgccccggtaggcagccaccacctcaggagtgtacaccggcagccacttgtaagggttgacggtgacacagaagaggcccgagtaggtctggggatagaaaaggagcagtgacttgccagttgcgaagggggagggctggtgattttgggagttagagaaagatcccaggagagaaagaagagaaaggaaaacctctgcatgcactcaatctgagtaatgccagtccccagagtgttggaattgaaccaaggatgttgggacgaggttagagtgtaaccctgcctagacacaaacagaagacactcttggctcctggggtggacatggatggagcaagaacagagatcccaacgtagggccaggtgcagcactcacgtagatcatccaggagccgtagcgatccttgaggttgtagagcaccgcgggctcatgcaggaaggtcagcatggccatgtcctcgattttgtcgaacttgggtgggttctgctgcatcacctggtcctccttcacggtcactgtctgcaagagcccccacccaagccctcctgtcagcctgggctttccctccttcctcaagagggttaggagttggtgagtgacagggcaatagtgctcaagagagaaggaaccaggatctcacagggaagacagaagggatattgggaaggagagggctctttggagggtctggattcttccccaaagggaaggagaatgggaccatcctcaggtctgcatgggcatggggcatgggtgtacccctctctgtccacccaggtgtacaggtggccagggtggactctcacatcagcctgacacccaccttgccatactcggtctcggcagtgactttgccaccctctcgagacacgatcttggccttgacaaactcctgtttgtcatcaggcacgaagacatccttcttgaggtcaaaaggcctggtctgcgcttctagccgctccttctctgacttgcgcaggtagggggcggcagccccaaagactgccatctccgaatctcccatggctgtgcctggagtgagcagaagctggctgccctcccatctgcccattcttcccttccctccctgggctctccccttcagtgggagccccaaaacctagcaccatgctcaagagtcaagaggagttaccagtgagtcccttcctctttgaggttaccccttaaccagaggagcagcctagcaaacctgccagggtaaaaggaacaactaactattgttcaagctggggctctcctaggggaaggaagagcattctgagctccctgtaggagcagaaatctaactatttccatctctgaccctcatctatccctggaccccctggtcacaggtaagtagctcttgatagccaagatattctctccagcacatggcagaaactagagttccataggctggctttggggctctaatgcccagtcttactagattttcaacactctagcttcagcttttcttacctgggctactcaagtgtgtctacagatgaggaaaggggccaaggcctgcaggggacctggagagagggaagaggctgtgtcagggcaggctgtgcccaacctgaccagtcccaccttcctgcttctccctggctctgttcttcagcatccaccctcttccaaaacaaggtggaaagggtggtcagcttctctggtcccatccttcttgtttttcaaaccctattccctttttcctcaagaactagttctaacagcttcctggtgtcaactcaacctgaaccctaatcctcttcactcctgcgagatggtcccacccctgcctgtacccatctagtggtacctttctttgagccatctgagagacaactaatggtcacatttgttcggcactttccagtctaaaagcacttcaatgcactttctcctactcagtcttcaccccatttgacagatgaggaaatcgaggttaaatggcttgcttggccaagagcccatgacaacaagtgggagagccaagacttgaatgcaagtctgatgactctaaagagacttcttttccatcctgtccccattttgttgtcagactttgtggacattctcagagagaagacactgtgggcttcctctcacagacacacccatcacatagccaaacaccctccacaagccctctgatgaacactcatgcctgctgcttgggcatgcctctcacatgaagacaggcttccttcccatacctcaatccgcaccccaaccccagggtgccatatatgcctcaacagcaaatgtgcacatttcaggatgtgtgccacgtaagtagatcacatcactgcgtgttcttcagtacacaaagacctggaacatcctacacccccgtgcctgtgagttccttctgcagagggtacagatactataacagtcatgactcgtggaggcatagacaagaacctctgcatgcatggacaggggtagctacacattccaggcctcacagaatcacatgaaggcatacacacttcctagaatccttctccaccattctttctccctccctgcaaaggaacctcctcgttcacagacgtgatcatacacccacatctcccacttgatatttctgtatcagtcagtgaggtacataccctttctcacattcagactatgcaggcttgtccacacacacacacacacacacacacacacacacaccctgtaatgcatattggtcccatatgctcagatgcagatatcttcccctaggaactcctgtggcacatacgcccatgtttagacctgcacatgtgtgcccagtgactggacctggtactctgcatgaagtcctgcatgaagcttgctattccaagaggaatcccttcctaagcctggagcccccttatcccagagtaaagcctccagctcccgctcctacctgagagcagcagggaaagacacagagcaggacagagctgtg

SEQ ID NO: 759 - DNA, 78 bp, Homo sapiens
tctgccctcagacaaaccttttgttcgtcttatattcggatcagaaacataattcgagcaaaaagcttccctgagagg

SEQ ID NO: 760 - DNA, 1396 bp, Homo sapiens
gtactaccgaataaccttaatcaaaccatttacccaaacaaaagtataggcgaaagaaattttacccaggcgcagtggacgtagtactgcaaggtaaagatgaaaaagttaaccaagaataaaatagcaaggatagacccttataccttctgcgtaatgaattaactagaaataactttacacagagaaccaaagccaaggcccccaaaaccagacgagctacccaagaacagctaaaagaacacacccatctatgtagtaaaatagtggggagattcatgagtagtggtgataagcctactgagcctagtgatagctggttgtccaagatagaatcttagttcaactttaaatttacctacagagccacttaatccccctgtaaatttaactgttagtctaaagagggacagctctttagacattaggaaacaaccttcatgtagagagtaaaaaacattatccccatagttggcccgaaagcagccatcaattaagaaagcattcaagctcaacatccaaccactctaaattctaatcacaccactgaactcctaacaccacattggactaatctattactttatagatgcaataatattaatataagtaacatgaaatattctccactgcttaagcctacatcagaccagaataacccactgacaaattaacagcctaatattaataaacaactcaacaaatttattattaccgatactgttaatccaacacaggcatgctctaaggaaaggttaaaaaaaattaaaaggaactcggcaaattttaccctgcctgtttaccaaaaacatcacctctagcattattagtattagaggcaccacctgccagtgacatatgttcaacggccacagtaccctgaccatgcaaaggtagcataatcacttgttccttaaatagggacttgtatgaatgaccccacgagggttcagctgtctcttacttccaaccagtgaaactgacctgcctgtgaagaggcgaacatgaataaataagatgagaagatcctatggagctttaatttattaatgcaaacaaagctcagataagcccacaggccttaaactactgtccctgcattaaatattttggttggggtgacctcggagcataatttaacctccgagcaacctatgctaagactaaacaagtttaagcgaattactatacatatattgacccaataatttgatcaacggaacaagttaccctagggataacagcgcaatcctattctagagtccatattgacaatagggtttacgacctcgatgttggatcaggacatcctaatggtgtagctgctatcaagggttcatttgttcaatgattaaagtcctacgtggtctgagttcagaccggagcaagccaggtc

SEQ ID NO: 761 - DNA, 3610 bp, Homo sapiens
caggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtc

SEQ ID NO: 762 - DNA, 3645 bp, Homo sapiens
cctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataa

SEQ ID NO: 763 - DNA, 3587 bp, Homo sapiens
taccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcac

SEQ ID NO: 764 - DNA, 30904 bp, Homo sapiens
tgcgcgcggcggcggccgacggcggctgagctgtgctgcgcggcgcggcgcggtgcggcacggcacggtgggagtgtctccggctggcttgcaggtgtggcccggcccctcgggagggcggggagggcggggagggctcggctggcgcggggagggactggagggcctagaacagctccgcctgtgtgaggggtttcctccctgcgatcagccggtggccggcgtgaggcccacacagtcagggcctcgcatctgggcgcccgccgcccggtctctcgctctcaggtaccccccgtccgggcagacagggctgtcatcctgtcaaaagggaaatcccaaacagtccaggtcccacagctcagaaatgtggtgacaccggccccagctctcacctgtccttcccaatttttagggaaagtgcataaagacggccctaccttgcctacagtatgcaagataactgcgaattagtaattcacgttttatttgatatgatacttaatattatctagctttgcaactggaaagtgaggtctgggtccacatgtgcaaactggtttaattgattggccaaatttacttaaaaaattgaatgcatcctccattaaggaatgaattagatgacgagagatttcttttggagactgacaatttgaagtcttttagcttaatatctgttagcttggctttgcatctcttccttttccataactttttctttcttcttttttttctttctcataagaaagcttttggccaggcttggtggctcactcctataatcccagcactttgggaggccgaggcgggtggatcacctgaggtcaggagtttgagaccagcctggccaacatggtgaaaccctgtctttactaaaaatacacaaattagccgagcgtagtggtgggcgcctgtaatcccaactactcgggaggctgaggcaggagaatcgcttgaaccccagaggcggaggttgcagtgagctgagattgtgccactgcactccagcctgggtgacagagcaagactccatctcaaaaacaaaaacaacaacaaaaggaggagttcttaattttttttgtttttgtttttctttattttctatgtttgagacgacttttacttctgctgtgggcatcaagtttctcactgttaggttaagaaaagccgtttctcagttatttcacaaatattattatcaagaaaacctaagactgttattcagatcttttcaagttggctccagtccttcccccaagcatgtgaatcacagagcttcaaaactaatggaacttcagggaaaagacgatataaactttgttaatactggaaattcaaattgagttggccataagtgggatgtcttttttaataatggggttaaagctcgtgtctactgagaaatcaggaaaaaattaactccagaggaaaatcatgcatcagatttcagttttacgagtgaggtgtttgtttccacaaagaatatatgcgcttgccttgcctttttaaaaagaattaatattgtttcttaaaggtacctgaaacttgtgtgattatgtcttatgaaagacaggcactttaagttattcttatatttgatttttatggtgtcatattgtcttttttttttttttttttgagacagagtctcacttcatcacccaggctggagtgcagtggcacaatctcggctcactgcagcttctgcctcctgggttcaagcaattctcgtgcctcagcttcccaggcagctgtgattataggcgcccgccaccatgcccggctaatttttgtatttttagtagagacggggtttcaccatgttggccaggctggtctggaactcctgacctcaggtgatccacccgcctcggcctcccaaagtgctgggattataggcgtgagcaaccatacctggcctcatactgtgttttgtgtgtgcgtgggcatattccttcttaggctagctatactgagtcattcttgaggagtgttgattatttggcatattttcactggggtgccctcaatgaattggaccctgtacatggggaaacagtgggactgaaatagttacagtgcttgcccctgtggaggctttattctagctaataatattggtaaattaatagtgccaaaggcaatatgagaacgtggaacaggagaacttggggaggatgtcaggaaacacatctgaaaaggaacaaatgtttgaaccttcaagatgagttgtacgtagctaaacaaggggtctagctgtggagtggggtagcggaggaaacttgagagaacattccagatgtacagtctttcaggcagtacgaagcctgctgtgttccaggagctgagaacaggtagagaaagctaaagtagagaaaataaagtactgaatggatgagccaggtgagagagggaggcaggtccctgaagatcatggttagcattggatcttctttttatttattttttttctttcagacagagtcttgctctgtcacccaggctggagtgcagtgtgggatctgggctcactgcagcctccacctcccgggttccagcgattttctggcctcagcttcctgagtagctgggattacaggtgtgtgccaccatgcccagctaatttttgtattttaagtagagatggggtttcaccatgttggccaggctggtcttgaactcctgaccccaagtgatccacctgcctcggccttccaaagtgctgggattataggcatgagccaccgtgcttgacctggaccttattctttttttttttttcttgacatggagtcttagtctgttgcccaggctgcaatgccgtggcacgatctcagttcactgtaacctccgcctcctgggttcaagcaactctactgcctcagcctccctcccgagcagctgggattacaggcgtttgccaccatgcccagctaatttttgtatttttagtagagatggggtttcaccatattggccaggctggtttcaaattcctgacctcaagtgatccacccaccttggcctccagcctgagcaacagagtgagactcaaaaaaaaaggtttacatcacagttggagagagagaggccaaaatcgtttaagaaataaatatcaaatcacaccttcatatgggcagtggaggaaaagtagaagatcttagaagtattttgagggaagctagaagttaaaatgttcctttgatgacatgggaagagtcagtagcagtcactagaggctgttgtttgaaaggtgccttgggggccaacatgttgcttatggagataaatgtcctgtaagggttttgattgtgaccactctgctggagatcccccaaaatgctctgcttccgtcctcaccccttcttttacctcagtgtctcctttattgcagggagaacaccgactgagacctcaaaccctggctccagtgtcatggtgaggaaactgggggctcctgtggctgaaggggtggatatgtaggataactatgtcctctgggccctgtcttctctctcgccacttccgtccccaactgaggaagaaagggaagggtgagtgaggagcatcctcatccctgccctaggggacctagggacttccttctgtgcctgacctctagaggtggcatggaagaagagtcccacagcagaccctggggctctgagcggagctcctccagggccatccttgtcatccctggtgagacctattgaaaacacatgtggccatagaaatataaattcagcttaaattaattaagattcagtacatttagccgggcatggttgtgtgtgcctggaatcgcagctacttgggaggttgaggtgggaggatagcttgagcccaggagattgaggctgcattgagctaggattgtgaccctgcactccagcctaagctacagagtaaaaccttgtctctaaaaaaaaaaaaaaaaaaaaaaaaattaaaaagtttaagcgctcagtttctcagtcgccccagtcacattgcccaagtgctcaacagccacatgtgctggtagcccctttctggaaagcacaggcatggaacattcccatcatcagagagtgatgtctgttggacagcactgctctgaagaattctgcaattaaaaggattctcagatgaggccgggcgtggtggctcatgcctgtaatcccagcactttgggaggccgaggcgggcagatcacttgaggctgggagttcaagaccagcctggccaacatggtgaaactctgtctctactaaaaatacaaaaagttagctgggtgtgtggcacgtgcctgtaatcccagctacttgggaggctgaggtaggaaaatcgcttgaacccaggaggtgaaggttgcagtgagccgagatggcgccactgcactccagcctggacgacagagcaagactgtctcaaaaaaaaaaaagaaaaaaagaaaaagactctcagatgcaatggaagtcctactttcacaagtatataattaaggacgtaagtcttgggggatcccagggacttcacagaaattaagctttcaatcccaaatttgtgatgctgtgccaatttgtaataaggagtttaggaaaaactctctaagcagggagggacaggctctgccatcacaagtcagtggagttacacagagagccataactttacactttaggatttatccaaatgttaaaagaaagtaaacatttcagcttggtggcccatgtgatctctgtcacaactattcagttctgccgttgtggcctcaaaacagccattgatgcattgtaaataaatgcacgtggctgtgtgccaagaaaacattatttacaaaaataggctttaggctggattttccatgcctgctgtgtctgaacattttctcttctccagtgataaccagtcgttctgctcagtggtgggggtggtatttgccgagccagaatgtgtgtgctgttttaggaatccgtcacctttgaggatgtggccgtggagttcatccaggagtgggcattgctggacagcgcacggaggagcctgtgcaaatacaggatgcttgaccagtgcaggaccctggcctccaggggtaaggctggcgtcacctggctccttcctgtacgcaggcactaaatgcttcttaagcgcctgccatgtgaagaagacagacgtggcttaggctttgtggcacttagcgtccacaggatgacaaagcttcatctgttgcattgacttctttccctctgtagtaaggccctgtttgggtctccttgaatttggccccaggcttctgaggtgagacagcctcagccccttggggcagaggggagggtgtttgtgggttgggtcctgagttcattagctattgggcaagatccctttgctacccatcacacttgctcagcccagagaatctgaagcccatattgaagctgaaggagagtttgagttgagaaacaagagtttgttttcccctgcaagccctctctctctcagtgcctgtgtctttcttcatgtgcaggaactccaccatgcaaacccagttgtgtctcccagctggggcaaagagcagagccaaaggcaacagaacgagggattctccgtgccacaggtgttggtgagtaccaggcaggctgtggatcccccgacccccctggttgggtggtgtgccttgggaagtgtcaagagcattttcaaaggccctttgttctgaggggacatcgaaggccattcggagtgaggtttctcaagttcctttagcttctcttctattttcactttctagccctcctctcctactttcctttggtttcagaaaaagatttgttctaatttctcttaaaaaattagagggccaggtgtggtggctcttgcatgtaatcccagcactttgggaggccgaggctggtggatcacctgaggtcaggagttcgagaccagcctggccaacatggcaaaaccccatctctaccaaaaattagccggatgtgatggtgcacacctgtaatcccagctacttgggaggctgaggcatgagaattgcttgaacctgggaggtagaagttgcagtgagccaagattgcatcactgcactccagcctgggggatagagcgagactctgtctccaaaaaacaaaacaaagcaaaaattagagctataagtcacacaccatgaaattcacccctttaaagtgtgcagttcagtggttcacaaccttgtgtaaacatcaccactacccaattccagaacattttcatcacgccaagtagaaaccctgtccccatgggcagttactccccattacccctccctcagcccctggcagccactaatctgctttctgtctctatggattgtcctatatagacatttgtatatggaaatcgtatcataagtagcctttggtatccggcttagtataatagttttgtgttgcaagtaagttagactgggtagtttataaacaatagaagtttatttgactcctggttctggaggctgggaagtctaaggctgaggggctgcatctggtaagggccttcttgcagcatcataacatggtggacgagatcatgttgcaagagaacaagagaggcccagactggtttttacagcaaggccactcttgagataactaacccccttctgaagtaatcacagggcagattcctcgtgacctaatcacctttttttttttttttttttttttttgggacagagtctcgccctgtcacccaggctggagtgcagtggtacgatctcggctcactgcaacctctgcgtcctgggttcaagcgattctcctgcctgagtctcctgagtagctgggactacaggtgcacaccaccacacccggctaatttttgtatttttagtagagatggggtttcactgtgttggtcaggctggtcgagaactcctcatctcgtggtccacccacctcagcctcacaaaatgctgggattacaggcgtgagccattgtgcccggccacctaatcaccttttaaagttccagctctcaatactgttgtatgggaattgcttccaacccatgaactgtggaggacacacttaaactacagcagtatctgtcttctttcacttagctttatgttttccagatccatccatgttgtagcatgaatcagaacttaattccttttttaaggctgaataatatacattgtatggataagctatattttgattatttgttcatcagttgatagacagttggattgtttctactttttagctattgtgaataatgttgctgtgaatgtttgtgtacaatatttcttttttcttttcttttttttttttttttttttttgagatagggtcttgttctgtcgcccaggctggagtgcagtggtgcaatcataggtcactgcagcctcagccttttgggctcaagcaatcctcccacctcagtctcttgaatagctgggaccacaggtgcatgccctcatgcctggctaattttaaatttttttctagagaccattcttcctatgttgcccaggctggtcttgaactcctgggcttgggtgatcctcccaccttggcctcccagagtggtgggattacaggcgtgcgccaccgtgcctggccttgtgtacaagatttatgtagacatgtacttaattctcttaggtatatactgaggagcagaattgctggctcatatggtaatgctatgcttaacttcttgagcaactgtcgtaccactttccaacacaggtacaccattttacattcccaccagcggagatgagagttttgatttatccacattctcgcccatacttgtcatccaattcctctttaaatttaacctttttatgtatgttctttgtctagttctttcttactcttttttctaataacatctgctttctggaaatagtctcagtcctcatagaattcttagctaggaaattgcctctcattttcccctcattcctatgactgccagagtccacacatagccctacatacagatgctgtcttccctttcaggatcttcccaagtctaaggtcagtattaaaagctgggctgggcatggtggctcatgcctgcagtcccggcactttgggtggatcacttcaggtcaggagttcgagaccagcctggcccaacatggtgaaaccctgtctctactaaaaatacaaaaattagcctgacatggtggtgcgcgcctgtaatcccagctactcaggaggttgagacactagaatcacttgaacctgggaggcggaggttgcagtgagccgagatcatgccattgtactccagcctgggcgacagagtgagactccgtctcaaaaaaaaaaaaaaaaaaaaaattagctgggcatggtggtgcatgcctgtaatcccagctacttgggaggctgaggcacaagaattgcttgaacctgggaggtggaggttgcagtgagccaagatcgcaccactgcactccagcctgggtgacagagtgagaccctatctcaaaaataaaaagtaaagaaaacatgtggctcatgcctgtaatcccagcactttgggaggctgaggtgggtggatcacaaggtcaggagttcaagaccagcctggccaagatggtgaaatcctgtctctactaaaaatacaaaaaaaattagccagacgtggtggcgggtacctgtaatcccaactacttgggaggctgaggcagagaattgcttgaactcaggaggcagaggttgcagtgagccaagattgcgccactgcactccagcctgggcgaaagagcaagactctgtctcaaaaaaaacaaaaaacaaaaaacaaaaaacatgtatgtgtgtacacacacacaaatatagatatatatatatatatatatatatatatatatatatacacacatatatattttcaattttatgccactatttctttttgaaaggagtttattttttcccaattcatttcagactggaaatctcaacttgaatatatgtattcggtattaaaatttgaatatttatattcaacattaaaagaaaaagcctatgtgtgtatagtgtgtatatatattcacatatatatgtgaatatatattttcaattaatgtcactatttctttctgaaaggagttcattttttctcccattcatttcagcctgggaatctcaacttaaacccgaagagttgccttctatgcaggatcttttggaagaagcatcctccagggacatgcaaatggtaagatgcacggggttttccccggctcccagcatgggagaagttgaggaacacgtgaggtggaaatacaggaccagagccagggagatgttagcagcatgggtgtctcttggaagggaaacagtgtctgaggggagtgcctgtgacttctgaatttgggcaaacccagactgttgctcaagactttttttttttttgagacagagtcttgttctgtcacccaggctggagtgcagtggcatgatctcggctcatttcagcctccacctcccaggatcgagtgattttcctgcttcagcctcccgagtagttgggactgcaggcgtgcaccaccacgtctggctaatttttgtattttttggtagagacagggtttcactgtgttggccaggctggtctcgaactcctggcctcaagtgatctgcctgcctcaagattctttttttctagaaggtttcctgaaggaaacattttaataaatgtgagtcagacattgagcgtgcgaaatacgacttcctcctcagcaactgtcagaaaaacccctcctggtagagaagccccattgtgaataggaggcagccctgtggtagagctggcaacacactcgacgaactccagctgtctaaacaaggcatggcttgaaaatgctgagaatatgctcccggtggggaggacccctgggcactggcacagatattggcgagctttccaccatcattcacctctttttttggtttttaaaagacagggtcttgctctgccacacaggctggaatgcagtggcatgttcatggctcactgcagcctcaaactcctgggctcaagcgatccttctacctcagcctcccgagtacctgggaccacaggcctgagtcaccatgcccagctaatttttttctttttctttctttttttttttcttagagatggggtcttgctatgttgcccaggatgatctcgaactcctggcctcatgtgttcctcccacctcagccacccaagtagctgggactacaggtgtgagccagtgggcccagccattactcacctcttgtcaggagcaagctccacctggagaaaaggctcctgatgagttgaaaggaggcaggaaatgtttctggaggagctgtaacctggatgtgggtgagagaactggcaagacagaggccactttgattggaaagaatgtgggaaagttgttgggcatccttttcttcttaggagaccagtctagatcccacactggaaggaagcccttttcagtgtggaaaaagccttccatatgagcttgtacattaatagtacaggagaaaatatacacggagtccccaccatcccccctttggccctgaatttcctccgcctcaaacaagaggaccttccaaagtttgagttcccattcctgagtattggtgaaagttagagttagggtttggttagaaggaggcacagagctcagcctcacccccaagtggggcgtattagtcccagggtcagtgagaaccccgggatccctcagtcagtgccccttcccctgtgtcatggatgggtgtcagcatcagagcgtcagggatgccccacacagtggatggggtgcagtggcctcggttttagagacccacattcaacttctttgccagggaagcttctggaacacagagaagcctcaaccctgtgcagcttggtgtgggctgcagatcagccaaaactcacaacctgcctggctgcaacagacccctgggcagctgacagccctcctcactccccaggccctcctcgcccttggtttacactcttgttttggtggagaacaccctccagtagctccttgggatcaggtgcttgggttttgagaccttgacttctgagaatgtcttatcagggctgctggattgcaggttcctcatccgatgtggtggttgcggtaagcctcattacagaacatccttttttctttcttttctttttaaatagatatggggtcttgttctgtcacctaggcaggagtgcactggcacgatcatagctccctgtagctttgaacttattagctcaagtgctcttcctgcctcagcctcctcccgagtagctgggactacaggcacgcaccactacacctggctgattttaaaaaattgttttggagacgaagtcttgctgtgttgtgcaggctcccattgcagggcattctgtgtgtcatgtagcccccagtgcttgttgaatgaaggaaggaatggataaggtgttgcagaaggcatctccagttcccatcctccacctccatgtctctcttgctcagcaggtggaccccatgtgaagaaaggagagagggagggagaatgagcaacgagggcccggtgccctctttgtttctgtgggctctctcctttcagtacagggctccagtgccctccacagaactccacacccagcccagcaagcccctccataatgggtgctgagagtggcaggcatggggctcttgttacatcagagccccaggaaacaggcggtcacagactattctgagtgggcagaggaggtccacctatggacacacgtttagagaagctgaggagttcatccctgaagacatccagcccgtgagtagtagaggtgggtttggagctaggagttgaacccagacctaaccgcagagaccacagtctcagctgtcaggttctactgcctgacgatcatacaacctgctgctgggttgatggtgctgaccctttaggtagcccttccaggccatgccaggcatcattgtgccttgtcacaatcattgagaccctgtatggtggctccgagacctccctgtcacatgggaaaaagtgctgatggccagggacagattgagtccccatggcctccctctctttggtcggctggtccagcagagggaccagtgaagaggagggtgggaaactgctcttagaagagtcccaaggaagccaggcacagggcctcaccccagaatcccagcaactccggaagctgaggtgggaggaccactggagcccaggattttgaaaccagcctgggcaatatagcaagaacccatctctgcaaaacatacaaaaattagtcatggctaggtgtggtggtgtgcacctgtagttcagctacttgggaggctaaggcgagaaaattgcttgagcccaggaattcaaggctgcagtgagccatgtgtttgcaccactgctctccagcctgggtgacggagcaggattctgtctcaaaaaaagaaaaataaaactccccaagggaggctgaggaacaggcctctccaggctcagcccttcttctgtcccaggcccaccccacagctgcctcttctgcagacacctggctccttgaggctgcagtgttgctgctttcatcctctgctgcatccgcagggcctgcactagcagtgcccatgtcttagtctgttctcaccctgctgataaagagatacccgagttgggtcatctataaaggatgcaggtttaattgactcacagttcagcatggctggggaggcctcaggaaacttacaacatggcggcaggggacgcaaacacatccttcacatggtgggcagcaaggagaagtataaacaaaagggggaaaaaccccttataaaaccatcagatcgtggccgggcgtggtggctcacacctgtaatcccagcactttgggaggccgaggcgggcggatcatgaggtcaggagatcgagaccatcctggctaacatggtgaaaccccgtctctactaaaaatacaaaaaattagccgggcgtggtggcgggcgcctgtagtcccagctacttgggaggctgaggcaggagaatggcgtgaaccccagggggcggagcttgcagtgagccgagatcgcgccactgcactccagcctgggcgacagcaagactccgtctcaaaaaaaaaaaaaaaaaaaaccatcagatcttgtgagaactcactcactatttcgagaacagcagcatgggggtaactgcctccatgattcaattacctcccaccgggtccctcccatgacatacggggattatgggaactacaattcaagatgagatttgggtggggacacagccagaccatatcagcccagtacatatttgttcgacaaataggcagaacgcctaaaaacagtttctttaagttgagtgacctgtgtcaaaatgattctgatggaaacatttgtctcaaaatgtacccgtgggattttgatttatgacacagagaggccaatgtcattggaaaattttgattacttgtatttcctgggaggacagggcacaccatgccacacaggtccacacagggaagcaccaaggtcagcctggaggcagaaaggagcgaggggatagcccaggccagagcctttcttggagtttccacagggtaaaccactcaggatttgtcagtttgaataattttagtggaccttgggggataggtgctgtccctggttgatttagggcaggggaaatattggctgggtgagagtgagataaggagctggtacggcatgtgggctgtgggtcacgggatttggagatgaagttggcaggcagtttggccctgtgaatgatggatgccctgtggacaaggacagcattcctgttcagaaccaagatctcccgaccttgctttcttttttggtttttgggtgacttaaacagcagaaacttattttctcacccttatggaggctggaagcccaagatcaaggtggcggcagggctgggttctcctgaggactctctccttggcttgcaggtggccaccctcctgctgcctcttcacacggccatccctctgtgccacacctttctatagtgaaatgtctcatagcctcttcaggggctctgtcctaacctcaggtctgtctttgtatctgcagtgtgttcaagcctcgagaccctcggtggtagctggtgactgccgtaggtggggagtagttactaggtctgaggctaccagatgtcagacctgtgtaccctgactttttttttaagacacaatctcgctctgtcgtccaggctggagtgcagtgttgtgatctcagctcactgcaacttctgcctcccaggttcaagtgattctcatgcttcagcctcctaaacagctgggagcttagatgtacactaccacacttggctaatttttgtatttttagtagagatgggtgtattagtctgtgttcacactgctgataaagacatacccgagactgggcaatttacaaaagagaaaggtttaattggacttacagttccatgtggccagggaagcctcacaatcatggcagaaggcaaggaggaacaagtcacgtcttacatggatggcagcaagtaaagagaccttgtgcagggaaactccccttataataaccatcagatctcgtgagacttactcattatcacgagaacaatcatgggaaagacctgtccccatgaatcagttacctcccactgggtccctcccacaacacgtgggaatccaagatgagattttgatggggacagagccaaaccatatcaatggggcttcgccatgttggccaggctgctcttgaactcctggcctcaagcaattcttcacctcagcctcccaaagtgctgggattatgggcatgagccactgcacccatccccatttgccttgacttctggcagccctaagccccaaaccaaaggtctctcgggctgagaacagctgtggtgccaactctgtcctgctcagcaccctcttgtcttttgccaggggccggggctgttcctgaggatgcagctggtgccctccatagaagagagggagacaccattgactcgagaggaccggccagctctccaggagccgccttggtctctgggatgcacggtaagcctgggagaggttcactgtgatggcaccaggtgcagtcaggaaggcctggggtgtgggttgtctgtaaattgggggaggggagggaaaggagggtgtttggggcctgtaggaggcccaggctgtgggcttggggtggtggagtctgtttctgtgttgaatatacttgtccccagggtgatggcgggctccagggcgggtcctgggggagggtctggttgttggactgtaggccctgcctttcctggtccagccttttttcttcctgtccttccaccccagccccactgcttccataacctcgaaactgacaggaactggcaggtcctatgacctgagggctgggcaagggagcatccaggctcagggaagtgaggacctcttggctcagggccctgcgtgtccttaccaaggcagagagagaatgggagagagatgccgtaaggcaagggtccctaacccccaggccgtggaccagtactagcccctagcttgttaggaaccaggctgcagagcaggaggtgagcggcgagcatccatgcctgagctccgcctcctgtcggatcagcagcagctgatcctattgtgaactgtgcatgcgagggatctaggctgcaggctccttatgagaatctaactaatgcctgataattgaggtggaacagtttcatgctaaaaccatacccctaccctgctttgtggaaaaattgtcttccatgaaactggtccctggtgccaaaaaggttggtgactgctgctgtaaggcacgtcctgagccctgcatgaggagaaaaggcctcttcccactcgtccctgccctgttccctcccccgagggacctgctgcatgtaccccccaacctcccatccaccaccaagtcctgctagcgttatttccaaaatgtaacccacctccagctgcctctcctgtccctgctgctgccatcctgcccagagccaccgttagttctcctggactccagttctgctcctgacaggcacctgggctccaccctggacacagaggccagagggatcccttagaagtgcaagtcaggtcagacgtgtttcctgagcgagcagctgccagcagagaagagaccacatcctactccaaggagaggtcttcctcccagaaaaactcactgactgcctgctccgcattcacgcaggtccacctccaaactccatcttccctccacccctcaacctcctggccatccactccccacttttttcccagcttttccctgacttctggagcctccttggagggtgccaccttccccagcccctgcctgggtgccctctctccaggccattttggatcacagtgattagctttgtatttaaggattgggtaaatcctgacaaggtaaatgggtctctctcttcttttattaatatgttccccaaagcaggatcaaatatgcacgttcatttggggtgagcaggtgtgagtggccccctcagcttcttgactctaatctgtgacccctgtcactctgtccagggactgaaggccgctatgcagattcagagggtggtgataccagtgcctactctgggccaccgcaacccatgggtggccagggattctggtgagtgagtgctgcgtggaacacgtggccagagggccctgctgtccttgtgttctgtccaggaacttgtatcctatcctgcctgcatttcctctgactgcaggcactgccgtggcaccatagagaggatacagaaggcctctctcattatttgtgtgtttaagtgggagggcacttccagtgacagatctttaagaaagagagggctcactcaaccacagcaaaggccagacctctctttgggcaacatgaaattcttgactacacgataatgttgattttgaaaaattatgattgaatttactagaaatggcctgtgttttaactgtgtttttataaatgaggttcaggccggttgcagtggctcatgcctttaatcccagtgctttgcaaggcctaggcgggaggattgcttgaggccaggagttcaagaccagcttgggtaacatggtgagacccctatttctaaaaaaaaaaaaaaaaaaaaaattagctgtgcatggtgcctctcaagtcccagctacttaagaggctgaggcaggaggatcgcttgagcccaggaggtcagggctgatgtgaactacagtcgctttattgcactttgcagcctgggtgacagaatgagtccctgtctctaaagaaataggttcaaagccacttctcctgagaagtggggaagaaattaattctagaagacaaataacattttaactttaacagtaaggtgtttgttttcttctagttggccttctagtaagaataataagctttgtttcttttttttttttttttttttgagacggagtctcactctttcgcccaagctggactgcagtggcactatcccggctcactgcaagctccgcctcttgggttcatgccattctcctgcctcagcctcccgagtagctgggattacaggcgcccaccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccataaactttgtttcttaaaagtgccatccactcttgtgtctggaatctctgttttcttcttgacagggaacaattcttagatctaagtcttgtgttgctcttcagtatatttttggtaagtcttctgggccaggctctattttgttacttcttctttttttattttattttaattgagacagcatctcgctctgtcacctgggctggagtgcagtggcacgatctcggctcactgcaacctctgcctcccgggttcaagcgattttcctgcctcagcctcccgagtagctgggattacaggggtgcgctaccatgcccggctaatttttgtatttttagtaaagacggggtttcaccatgttggccaagctggtctcgaactcttgacttcaggtgatccgcccacctcggcctcccaaagtgctgggaccacaggtgtgagccaccgtgcctgacctattttgttacttcttgaagcgggtaacaccactactgtcatccgatggtgagatggggaccaggaaacagtcacaaagaaaacaccgacccctcctccgtggagctcacggtcagctgggtggtcagagttcgaaatgaataacagagtccagtggaagtgtgttatacaaggacttcatctcaggggacgggagagttctgggaaaggatggatatttaagcttaggccagggtttctcaactgcagcactgctgataatgggctactgcagcactgctgataatgggcctgttcactctcagctgtgggccgtcctgtgcattataggatgctgagcagcatccctggcctcaactcactagatgctacgagcacttttcctctatgagtttgctagggctgccatatcaaagttccaccagctgggtggattaaacagcaaaaatatattgtctcaccgttctggaggccagaagctcgagagcaaggtgttggcagtgttggttccttttgaagcctctccttggtgtgtagatggccatcttctctctatatcttcacatcatcttccctctgtccatgtctgtgtccaaatgtcgtcttcttgtgatagggtttggatttgtgtccccacctaaatctcatgtcaaattgtaatctccagtgttggaggaagggcttggtgggaggtgactggatcatgggggtggacttcccccttgctgttctcttgatagtgagtgagttctcacgagatctggttgtttaaaagtgtgtagcacctcccccttcactctcttcctcctgctccagccatgtagcacgtgcctgcttcccctttgccttccgccatgattgtaagtttctcgagtcctccccagccatgcgtcctgtacaacctgtggaaccaggagccaattaaacctcttttctttataaattccccagtctcaggtagttctttatagcagtgcaaagcagactaatacgtcttgtgagtacaccagtcatattgggctagggcccgccctactgacatcattttaatttaattacctctaaagactctatgttcaaatatggttaccaggggtgagataagatactaggggttaagacttcaagatatgaatttttgaggtaatacaattcagctcataacagccacataccccctagtcatgaaaagctaaaatgtctctagatgctgcagactgaattgtgctccccttctccaagttcatgttgaagccctattgtctcccccgaaggtgccattggaaatgggacctctaaggaggtgataaaggttaaataaggtcataagggtgaagccctgaaccaacagaactcatgcccttacaagaagaggaagagacaccagagctctctcgcccatgtgaggacacagccagaaggcagccatctgcaagccaggaagggagccctcaccaggaaccaaccatgctggcatcctgatctcaaacttccagcatccagaactgttagcagcaaatttctgttaagtcacctagcgcatggtattttggaatgacagctcgacagctcaacaccagacattgccaaatgtcccctgggggtcaaaccctgacctagaccatgataaatactataacatttagcttggtcagctgttgggctgtcaggaggttcggagagaggatatcaggcttaggaacaacattgataaaattccccatggagcagagaactggttgcatccagggcccatggaagatggtgtgaaggcagcagggagaagtggagagagagtggtgtgagctgactgaagaagaagcagcttccagattgttcagggcttggaagtgcaggaaaagaaccttggcccatgttctaagcccgctgggagccagtgacgtgtttaggtgagtggtgcaatgcacctgtggttttaacagaaccgcaccccccagcccacctgtgaggagcgtgggctcagggaggaaagcagtggtaggtggaggccattaggagtagaatggtgctggtctagacttgggggttgagtgtggaggaggtgtgctgggttcccccaagaccaccccagtcttgatgatccactaggaggactcacaggagatgtcgtactcgtggctgtgatttattaccagaagtggatatgaagcagaatcagcaaagggggtgccaggtgtggtggctcatgcctgtaatcccagcactttgggaggccaaggtgggtagatcacttgaggctgggagtttgagaccagcctggccaacatggcgaaaccctgtctctactaaaaatgtaaaaattagccgagcatggtggtgcatgtctgtaatcccagctacttgggaggttgaggcaggagaattgcttgaacccggaaggcggaggttgcagtgaaccaagattgcgccactgcactccagcctgggcgacagagtgagatttccttcttaaaaaataaaaaaataaataaaagtaaataaaagaagtgtatctgactcatggttctgtgggctgtacaagaagcacggcaccaacatctgctcctggcgagggcctcaggctgcttccacttaggtcagaaggggaagggaagccagtgtgcggagatcacatggtgagggaggaagcaggagcgggggcagtgggggagggaagggaagggaagggggaaaggtgccaggctctttttaacaaccagcttccttggaaagtagtagaagagtactccttctctctgagggagagcgttaatcaattcttgagggatctgcccccaagtcccgcctccgacactggggattaacgttttggtgtgagttttggaggaaacaaacagtccctaaattccagactttcagaaggaaagcaggtgttcaacataaactgcattgtttgtacaagcagtttaagtggagcgagtttctcttaccagttaggggggcgggaaccttcctgaaatccaagttcccagactccacccaagggccaaccttgcaaacacatctcattaaggagcccatccaggcctgctgggttaacgcctttctgcacagtagggaagtgaggaatgatttaaaacacatagaggccagcactttgggaggctgaggtgggaggacttcttgaggccaggagttggagaccagcctgggcaacatagcgagaccccatctctacaaaataagaaaattagccaggcatggttgtgtgcacctgtggtctcgctactcaggaggctgaggagggagaatcacttgagcccaggaattgaaggctgcagtgagctagtccagcctgggtgagagagcaagaccctgtctcaaaaaaattatagtaataatgcatataaaacatttatattgaggaggttgagttgatttggtggttcatgtattcatttaccaatgacatggagcatttttgtgccaagtaaggtatcggggacaggatggtgaaaggcacccaggcttattcttacaaagcttccaatccagtgaggatgacagaaaagaaacactcatggcagcaatacatagctggttacagatgggtaagggctgcgaagaaagggaaggggtcctatcagagaaaaggagagaaggggctctttctacaggggaggagacctcaggatggggcactctgagggcgacgtttcagtggatccaaaaagaaaaggctctatgtaggtgttggctgtagcgggaatgggtgggagaggggcttgggggtgagtaccgccatgtagagacgtcatcactatttattctgattagttgctgggatctgtagagtgtcagagaggggtgagatttctgatcaaagacaggggcagcacttcctgagattgaggacatggttagggagagcaggctttgggaggacggtgatgagtgttttttttttttaagacatagtcttgctccgttgcccaggctggagtgcagtggtgcaatcttggctcactgcaaactccatctcctaggttcacgtgattctcgtgcctcagcctcccgagtggctgggactacagatgtgtgccaccacgcccagctaatttttgtatttttagtagagacggggtttcgtcatgttggccaggctggtctcaaactcctgacctcaaatgataatgctggcctctgcctcccaaagtgctgggattacaggtgtgagccactgtgcctggcctagtttttttgtaacagaaatttctctttcacaatttaggataccaaaagtccgaaattaaggtgtcgacagggccgtgctccctctgatggctcgggggggaggatcctgccacctgctttctaacagtggcctgcagcccttggtgctccttggcttgtggatgcagccctcccgtctctgcctgtgttgcctcatggctgtgtcacctctgtgtatctgtctctgtctcttctgttaggagaaccatcatattggattaagggcctaccctattctcctgtcgtctcaactcattacatctgcaacaatcctatttccaaataaggtcacattttgaagtactgggggttaggacttctcttttttggggggttcacagttcaaaccatagcagtctgttctctagtccccccaaattcatgtcctttccacatgcaaaatacactcacgtggtcccaaagttttaatccattccagcgtcaactctaagtgcaaaatctcatctaagcaccatcaactcaaagtttcatctcatctgatgagaatcccacaactcttcatgtcagtcatctacagcaggtatgagggagactcagagtgtggtccattgtggggcaaaattcctctccatctgcgaacctgtgagaaatcagaaagcaagtgatctgcttccaaaatacggtgatggggcaagcaaaggatagacattcccatttcaaaaggagaaaaaggggtcatgggtcctgagcaagtttaaaacccatcagggcaaatgctatgaggtttccaggcctggaacaaatcctctatggttggaagctctgacctctggacctcattttgggtaccttctattcctgttcccttagatgggcagaaagatttgagccaatggttggatacatggtctggtgttcagatgtgagagtcagcctggagatttgggcttcatcatgaagtttgggaattgacacccagagaatgggtgaggttgcacaccaaggcagagagaattgagggagacacgaagaggagggcctgcaacctgtggacgccagcaacatgttggagaagaagctcttacaggaaaaagaggaggctggggttgtgatcactgatcacaggctgggtgggctacaagaaggagggattggctaggtgcagtggcttgcagctataatcctggctactcaggaggctgaggtgggaggatcgcttgaggctaggaattcaaggctagcctgggcaacatagtgagacccccatctctaaaaaaataaaaaaaaaattaacagggtgtggtggtgcacacgtgtagtctcagctacttgggaggctgaagtgggaggatcacttgggcccaggagtttgaggctgcagtgagctgtgattgtgccactgcactccagcctgggtgacagagcaagactctggctcaaaacaacaacaaacccaggagagattggatgatgagcacacatcagtgggatttcccagcacggatggaggtcactggtgattccagggtggtgccagcccttggaacggtggagatgggaagcaagtgggaggggaggaagtgggcacagagggtagatagcccatgatagggaatgaagagatagaggtagcccaagggaaaagtggggtgttatggcttgaattgtgcccctccaaaaagacatgctgaagtcctaaccctgtgaatgtggccttattggaaatagggtctttgcagctgtaaccaagttaggaggtcacaaggttgggccccaatccaacatgactgtgtccttatgagaagaggaagacgccacgtgaagacagacacgcagggaggggaccgtgcgacggtggaggcagacattggagtgatgcatccacaagccaaggagccccaagtgtcgatggccgccaccagaagccagggaggggcaaggaaggactcttctcagagcgtcagaggaggcgtggccctgctgagcttaactttggactcctcgtctctaaaactgcgagaggatacatttctgtggttttaagccactcagtttgtgatactttgttacggcagctgcagaaaacacatgtggggtcagggattgggtgtgggtcaggtttaaaaaaagtgaggggaaaggtcccatcgggagggagaggtgaggatgcaggggatgagggatgatctgggagttgcttgcttgtctgtcataggccagaaggaggatgcctggtgcagagcgaggagtggtgttgatttgaaggcaggtgggaaggaagtttctttttaaggcagacttgcaggttggttgtggtttatctgcccttgatttgtggtaagtcctggagcaccactagccctgcagtgtagaggggcagagaaaggggccaggcagccggggaggaaaagctgtcccaaagctgagtcgggacagtggtgggggctgcaggagctttggagtctcctggtgaattatggagtctatggctcttgggatatggaatgaaggcgtgcgtgtgtgtgtgtgtgtgtgtgtgcacgtctatatgtctctttgtgtgctggtctgtgtgtatatgttatatatatgaacaggtgcatgtggtatgtaactgtgtatatgtgtgcgtgtttgtgtgtatatgtgtgcatgtctgtgtacgtgtgtgcatgtgattgcatgcatgcgtgtgcaagagcttgcagatatgtgtctgcatgtgtgtgtccctgtgagtgtgtgcatgtgtgtgtgtacacatgtgatcactcacagccagggtgggcagacttggggcctgtgagtgtgcccagtaggccaggcaccaaccctcatgcctcttcccttctcccctagctgtgcctgcacgtgaccctgcctggcttcaggaggacaaagtggaggaagaagctatggctcctgggctgccaaccgcctgttcacaggtaggtaagaacttcttgttctaaaagaacactgctgtgcccaaaggctggacttaccttcttcctgtgacctgtctggatcatctcatagggttggtctccatgctttcagggactgggcctcttgcagtgggtgtcagcaagggagcatgggccatgatcccaccacctcattcagaccctccccaggctgctgagcaccaggagggaaaacaaagcaaggatgtcagctgtcctcattttgtggtcttcatggtctcactgaacaaagagttgagtcattttccagatagttccctcttgcctgtaccatgctcaggtctgctggaccctggagctagaagggggacaaatctgtaagagcttcctggctccttgtcaatagataagtcctgtccagaggtcgaggacttgcaacattagttattgcctcttgctgttcttacttaaggagtggagagtagagagaggagttctagttcagagtcctgagctaagggccagattctgcgggatctcagaaccctgtctgaaagtcctctgcctgggttttcccttccccaggcttgccagcctccagcatcctctggcgtactggtgggggtggtccctggctgagccgggatggatgtgtgttttaggaaccagtcacctttgcagatgtggctgtggtgttcaccccagaagaatgggtgtttctggactctactcagaggagcctgtatagagatgtgatgctggagaactacaggaacctggcctctgtgggtaaggcagcttcatcttttctttccttttttttttttgagacagagtcttgctctgttgcctaggctggagtgtgatggcgtgaccttggctcactgcaacctccgcttcctgggctcaggtgatcctcccaccccagcctcccgagtagctgggaccacagggtgcatcatcacacctggctaatttttgtatttttttgtagagatggagttttgccatgtttcccagactggtctcgaacttctgggctcaagtgattcacctgcctcagccccacaatgtgctgggattgcagacatgagccactgtgcctggccaaggctttgccttttcatcacatttatgtaccaaccataagctctagaaattgtgcaagtctgggaaacctagtggtgaaaaaaaagataattcccaccttcatgagcttccagtctacttactggcctttctatggaatgaagatctttttactgccctgtctttctgtgactaaaagtttttgggcttctcaaaggtattccttagctaggcccttggttttgtagaccggagagcctcagtgtcctctgagacctagtgagggaacttgtatttagttgctcagtggaagagtttggctgtggccatcagaatttaggcacatgcattttgccactcccatctctagagcccctaaagacttgagaatatcggccctggtgtcagggcatggcacagtcctcgcacaacatgtgtttttttctcatgagcagctgatcaactgtgcaaacccaatgcgttgtcttatttggaagaaagaggagagcagtggaccactgacaggggcgtcctctcagacacctgtgcaggtgagcccaggcagatcaggtgagcatcagctctggtcagtaaggggagtgtccagtttggaaactgtcttatcagggcaacctattcatacctttgactgagaagcctgtttggttgagctcccttattaaatgccaccttctttcctttttccctttcctttttaatctctaaaactttgcattcatctcctagaaagatctgtcctactttctcttcatatttaatatttccatgtgtatattttatccatttcctccccactgtacattcttgctaatatttttcctcaacattagtcacaatctttgtagaatccttttttggtaaattacctactatttccttcccatgttcctctgattacataacttctcatctagccacacaccttaaaattttccttaacttttagatgcattccttctcattgcaatttcttcccgtacataggaccagtatttgggaaaaaaagtccacatgtgccttgcctacttttgaggtgaccttgatcccacagtttctttctctgtgtgcttaactttttcttccctaattcatttcagaacctcagtgtcaaccccaagaggcaattcctagccaagatacttttacagagatcctgtccattgatgtgaaaggggtaaggctcaccagggattattcatggttctctatagtaggatgagtctggggttaaccgtaagttagaaaagcagcccaagagccaagagcgattcgaggcaagaagtgtttacccagaaggaagcagtttcttgggagagagtccgtgaatgtcatgaattggtggaaaactaaatgtagatcatgttcgtacaagtaagcattttcacagatatgacacatacaaagtgtttaagacttaatttagccttacacaaattggaaaaattctgcatctaagaagctgcatgaaaataatgaaaagatagctctttgcaacagagtatccaccctattccacttgaaggaactctggatagaaatggtatggactccataaatggtaaaagtatcagatatagaactgtctttttcttacattcatttcacataggggagaatatctgtgaatctaataaggcctttggtcttcacattttccttcatcgacaggagcaacctcagcctggagaaaaactctataaatataatgaacttgagaaaccttttaacagcattgaaccacttttccagtaccagagaattcatgctggagaggcatcctgtgaatgtcaagagattagaaattccttcttccagagtgcccacctaattgtgcccgagaaaatccgtagtggggataaatcctatgcatgtaacaaatgtgaaaaatccttcagatacagctctgaccttatcaggcatgagaagactcatactgcagagaagtgctttgactgtcaagaatgtgggcaagccttcaaatattcctcgaatctccggcgacacatgagaacccataccggagagaagccatttgaatgtagtcagtgtgggaaaaccttcacgaggaactttaacctgattttgcaccagagaaaccacacaggagagaagccctacgagtgtaaagattgtgggaaagccttcaatcagccatcatccctcaggagccacgtgagaactcacactggagagaagccctttgaatgcagccagtgtgggaaagccttcagggaacactcttcactgaagacacatctgcgaacccataccagagagaaaccatatgaatgcaaccagtgtggcaagcccttccggacgagcactcatctgaacgtgcacaagaggatacacacaggggagaaactgtatgagtgcgcgacttgcggtcaggtcttgagtcgtctttcaaccctgaagagtcacatgcgaactcacactggagagaagccctatgtgtgccaggaatgtgggcgagccttcagtgagccctcatccctcaggaaacatgcaaggactcacagtggcaagaagccctatgcatgccaggaatgcgggcgagcctttggtcagtcttcacatcttattgtacatgtgagaacacacagtgccgggagaccctatcaatgtaatcagtgtgagaaagccttcaggcacagctcctcactcactgtacacaaaagaacccatgtgggaagagagaccattaggaatggcagcctgcctttatccatgtctcatccatactgtgggccccttgctaattaacttccattttgtaaaaatataaacacatggggctatgactttccctcgtaatactcctttagctgcatcctgtgtttcaatgtataatattttcattttggtttaattgtaagtattgtcttaacctccattatcgtttattctttgacccatctattatttggaattagatttttcaaaactaatatgtggatatattttcatagaggtataatgacttatagtgaaatgcatacatctgaagtgtacagttggatgagtttgacagatgcatacatgcatgtaaccaccaccccattccagatatagaatgtttctatctctctggaaggttcctgcatgttatatggctatttcttagttgcctttttgttgttggtttctaatttaattacatggtgagaagagtatgtggcctctttgttactgagtcataggtatttgctgagatttgctattaggtctggtgtggcttattcttctagctgccaacccaaattaccccttcctccttagaaaagaacctgggttttctgttcagattggcagtgtgcactattaaaaagcttccatctcccggctgggcacggtggctcatgcctctaatcccagcactttgggaggctgaggctgggggatcacctgaggtcaggagttcgagatcagcctggccaacatggtgaaatcccctctctactaaaaatataaaaattagccaagtttggtggcatgcacctgtaatcccagctacttgggaggctgaggcaggagaattctttgaacccaggaggcagaggttgcagtgagccgagattgcgccactgcactccagcctgggcaacagagtgaaactctgtctcaaaaataataataataaaaaaaagcttccatctcccagcccttcttgcaagcaagggcaggccatttcctccggtcctggctagtatgaatatgagaagtcactggatgtgactctggggaagatattgtgttcagggatggtttcatgtagccacatctctccacttcttgccttttggacaagtagacatgatttctagacctagaggagccctcctgtgaccataagggtaaaagccgcaagctaagaagagggtggccggaagtcataaccatcttgcttctgtaatctaaaaaatatttaggatagatttaatagaattggcatatttatgtgattgcagcagccctggactatttatttctggatgtcccatacatgaaaaatatgcacttcttactggtacagttttcttttgtttgtttttgtttttggtgggaggtttatttcacctgaatataattcctaactgatgcacttagtatatgtcagtttttataaatgcttcatggatggttgaaatcaatgtattgtattctacaaatgtctgctagatcaagcaaatgtgtttaaaaaccatctacacatttataaatgttgatctgtgatctagcatttattgagagaggtatgttaaactctcccaccatgattatgtattgctgaaaaatctttgtcattctgtcagtttttaaatttatgtatatacatacatatatatgttttgaagcaatgaaattaaatatagatactgacattttttacatttccaa

SEQ ID NO: 765 - DNA, 98906 bp, Homo sapiens
cacacacacacacacacacacacacacacacacacacacacacacactcactctattttgtgctgtcgtaaaacccacgtgtccagccgggaagctgccagagcgtggaaccaaggagccaggacgcggcagcggccaagcgcagcagcccacggcggttgagtcgggcgcccaggtccgtccgcactctcgcgccctccgcgggcctcccaattttctcgcttgcaggtcgggaggtttccgggcggcacaatctctaggactctcctcccgcgctgctcaggggcatgtagcgcacgcagggcgcacactctcgcgcacccgcacgctcaccgagacacccgcacgcacccaccggcagcaccgagttttcaggtaaggtgaggctggtctgggacttaagagtctagggcttggtagataggaaggttggtggtcctaggttgggggcgggcggcgagactgttctgcctcctggcgcctgaggccaacgcggctcgggcgctgcgccacgccggctcgggtcggctccgggcgctggctgagggcgggggctgcgtcctgcagccgagttctacggggcagcgccctcctgtcgggccccagcattgctggatgggagctggacgctgcgatcggggaggcagagcagggtgcacacagctccctctgtgcggcgccgcagcttcggagtaaactttgcgcccaagcggagttgggaagagggagccgcggaaccgggcggccgccggctgaaccaccggctcgggcactttctccagggtcccagtggccctcttcccggcccctttcgcccagctcacgcgccccctcttccctgccctctgcccccagttcgaggcgccggacatgctgaagcccggagaccccggcggttcggccttcctcaaagtggacccagcctacctgcagcactggcagcaactcttccctcacggaggcgcaggcccgctcaagggcagcggcgccgcgggtctcctgagcgcgccgcagcctcttcagccgccgccgccgcccccgcccccggagcgcgctgagcctccgccggacagcctgcgcccgcggcccgcctctctctcctccgcctcgtccacgccggcttcctcttccacctccgcctcctccgcctcctcctgcgctgctgcggccgctgccgccgcgctggctggtctctcggccctgccggtgtcgcagctgccggtgttcgcgcctctagccgccgctgccgtcgccgccgagccgctgccccccaaggaactgtgcctcggcgccacctccggccccgggcccgtcaagtgcggtggtggtggcggcggcggcggggagggtcgcggcgccccgcgcttccgctgcagcgcagaggagctggactattacctgtatggccagcagcgcatggagatcatcccgctcaaccagcacaccagcgaccccaacaaccgtacgtagccgcagcccgcgcgctctctcccggggcgccggcgccggcgccggcgggcgcgggtgcctgtcagggaggcgggtcggataggagtgacacggggccgggtgggtggggagcacctggtcctggccgctggcccgcgcctccccgatctctgtgacaaaagttttctggcgttggagaaggaaagagaacggatgggacggccggtggcactttggggttccctctccctccctctcctcacctgcttcacagtcccaagtgtttggggccggagtctaccgtggacccggcctaacagacctctgccctcccgccggacagtgcccggggccaggcgggtactggcagcgtgtgacagggggtgtctgggtcaggccctgcctggccttagccgggacgagggagggaccctcagcgtctctggggagcacgcagaccagggcttgtttttgctactctccaccccacctctggaggggtcattttcgggccgcggggttgtgggggaaccggcgggagctgttcgctggccaggcctcactggagtaggaattttagatgaaactgagtccgtttctccttgaaggcaggcagtattcttagatctactattcatttaaaaagaaggaaaagaaaaaaaaatgactgctacttactgagaagaaaatttctgttctcctccgattccgctgatcccgctttatccgcgcacctttgaccccgcaaacattcataacccatgttggtttatgtatttatttttagaaattagggtgactgtaatttagtaaaagacgcttactcccctcttcctccaagttaatagcaaatgcctaactaaacatcagaattcctgtagcttcggtttctatattcacaatttgaaacgcttatcacaagtacagttccatttggcggttttgaagcaaaactctaaatgaagatcaagcaatatgtactgctttatacctgcttctttttgataatttcagaagttatactgtgtttacacctatactgtgttgggagtgttaaacgtgctcccagagacttctggagataacattaaagtgtgttaagagcgtcagattgaaagcaatacaggatttgaaagatcagcattcattcagctattttcttcatctcattccttcgtctggcttctgtatgagtaaagttaatttaaaacatttatttttattcaattttgaataagttgcttcttgcaaaatgtctaccgctctgtgaacttcttaattcgttgtaaaagcaaaataagttcagttatagctctttaaaggattccctaagtcgttgatttgatgaaaaaaaaaacactgggcaactgcctcgtggttgaggtctatgaatattttcattatgttggacatagctgtgatggagataataattaccaacagaaagagcaatcgtatttacttttttctttatgaagtttgagagtaaagcactggcttaaaatagtggtttcaactctaattttgctgtgcagttgagaagacttgtatttcagagtttcagaaagttttacaacattatactctcccaacagatttcaaaaaatacttatctcctactgaatttcttgaatgtgtgtttttgaagcaagtattttaaattatgaaataaaaagatttttaaactgccttggaaaaggtatgtcttactgctaagtgaaatatagccattgcaggctgagaatgcttcatcaatcttgcaatttcacttctgaattaaatatatgctagagaagtcaccagcagtacaccccaaatccctggctgtgtgctgagctcctgtactgtttacaatgcagtctggaaaattaatacgttttcaccagagaaaacagactaattcgagaaagaattaggatagattcctaattaatatatgggtattgaaccagtttattgcctgggtaacttttttctctggttggagaaaataaattacaattttatttaaataatttatattgtgttaatcttctggtatctccttttgagccaactggattgtttcagtgtttgaagtgcaggggaaaagacagaagggaaagaaaattagattgtcctattagagttacaccccacgttgctcactaattaaagggcaattgagaaagaaaatagaaagctgagatagcgctgtgtaatgctgggagacgagatctcccattcttccaggaacttctctggacaagcaagcttaggcactcatttgaagccatgggatgtacttttacaaagatgaaacgtgattgagtttaatctaagtaggggcttaaaacaagtcagaaatgcaaatagtgggaaactcgtttcctttggcaggggaagttggcataatggttattgaaaggctgtgaaaaacagaagcttctcctcattctcgagttgtatgtgagtggaggtggagtgaaaggaagggtggaggcagagggaagctcctattaatttatcatgtatagatttccctagtttttcttttagtttttttaccatctccctctaaaagaattctgtgaagtgaccacttagcattgcttcattttgtcacttcgtacttaaaaggataggtattgagttgttttctctttttctcacaaggcgaaataaaaagggcgggatgcgggggtgcctccttacttctcccttccctttagcaaagtaactttttgcctaggatcagcaatacatatcattgctctgtaagaaaagaacttaggaacactagtttcaccttgaaactttattggcatctatggtaaatgtcacagtgatggggcttgtagctctctttcgttctaaaagattttaaaacagcagaaactgcaagctacccgggtgagcttttccagtatgttcctaactccgtatcagtttaccctgtgactgaagtacagtttccaccgaagctctgaatgctttgctgttgctgctgctgccgccttctcttaaaaatcaagtggtgcctcctgcgatataaatgggggatggggcccttccttccccgtctaatattactgccctcatttgctgctgggctgcctgaagccattgatttagtcaggctccatcggagtggcctcttcccgggttctgggagctggtgcgttgcctgctcttgaaaagtagagagagacagtcacagggcgcgcctggcgtttctgagtagcatcccggctgttctctcagcacagcccattagtttttcaggccttttttgtaaagatgtgcttccctaggacctgggagggaggcgggaactgagccactttgggtgtctcgggggagagttggaccactttgcaaattccccagttgggggaggggtctctgtcccctcccgatttactggaaccctcctgcgcagggaacaggctggaaacagcgccggtgtgtgcatgggtgtgggagcggggcttgaggcttccttgttgggaacaccaggctttccaagggtttagggagaggggctggggagagaaaagggagtctgggcctaacactggtttgtccggttgcttgctaaggggtcaaggaaagagacaaaggagggcgagtgttttctgaccttccctaatcccttcccacccaggtggaaaacgcaggtcctgtttgggcaacttcgagcccagtggcacaccagcaggctttttgtgcaaccgaggaacatccactgcgccccttctgccctgcgcctcctctgtcaaagaccagcgagcgccttagattgcagacctggtccgggtgggagggagctttggcttcagtgcgtgggcttttgtgtttctctctctctctctctctctctctcgcgtgtgtgcaagcccagcctcatcccataacacacatgatttagctattttacatctttcgttatctagcgccctgaaaccgaacatacagccatatattagattgaggttagaagaggtggcgactgtttattcaaggtgataaaatggtccatcagcagtaatctccatcgatatgtgccaccaggagatgaaggatgaggggacaagccacaattaattgccctatagttttgtaggagagagtggagccagcccagacccgcttcgatctcctctcgcggctcctattcatcatctccgcattgtatatggcagcctcgcaggggcaggggccggcgaggtttatctctgcgcaatattctctcaccctcacaaactggcgctcccatttaatttattaatacagtcatcggaagacaaataagacccacattttctccctcccaccttcttgctctcttctttttgtctctccctcttggtcccagggtcaagcccgcagccaggcagggcagagaacgcccagagcttttgcgattcgcggggagctttaaactcgcgtagagggagagttcctgagagaattcccaggagctgggccgccccgcagggtcgagactgaaatcaattggctccccttccggcggccaggcaaacctgcctcgcctctggatctgcttctagacccgctcccggggcttggaagacccctgccgggtagaggaggagggccgggtgggtggcggggtgcagtggggacgtcggatcgtgggtggtgtcggcggccacgcctcatgtcagaagagagcctttcgtgggcaggagcggggtgggaccttcaaaactcagccttcggcgctgaggcctgggcgccccaccccgcccatcgctccctttcagccatcccatctagcctatagctcgagaaggcagtggggggaccgcaggctggagccccgggggcgtgaaccccacgcgagaagttcgggcccggatgctctgcctgcccgccctctgcccggctccccagcccccacgcccctccccgcctagggcgcacgcggcactgccagcaggcggcactcccgggtcctagtcgccgggctgggatcgatgggcgccggcccctcgggtctcggcctgcgagactgagggccgcgaccttggcggcggtaggggaggatttacagccggggtggatagtggcgcccaggcggggaagcaggcttttcacctactccttgctttcctatatgcagggcgggtgagagccaacgaaggcgtcgggcaggtactggggagtgaagatgtgatgtagctctcactccccacgcgcctacacatgactgttggcctctccacacaccaaaagcccggaagcgttttatatttcacctttcctagaacgagaaatgaaattccagaaaagaaaaccatggcctgctttgccgcctttaccttaaaatagatatattgtaaagatctattgcactttaaagacattgaaacaacacagaaggataggaaatgaagagtgaaagtctgctcttaactgcacttggcctggccttctgatgccaggaggcgaacaagtctgtaacctaatgacagcaccttcctttactcagagacgcttagacaggagcattgacagatttactcaagatagaagagtatttatgaataacaattatgaacttgtacaaaaactcttcccctgattttaagagaaagtatgaacatttacttgcttccttgttaggaacctaagtagttgtattatgtattgcttggcttggaatgctctgtgtgtgtatatataatataatgacatatattatatacatttatacatagtttggtcctctcatatagcctgcttctctttcaaaccttttcatgtaggtgtttatactctgctagaatgtttgtcttcttaagcatatttgtcaatcccaagaaatgttacttgtttttaatatcctcaagctaccctgagactcagacataagttagaacccaaatgtttcagctgggggattttgtgtattaaaaaataacattggaatataacatgtatcttgatggcagttggtcaacttttctggcagaatattttgatatagcatgaagtggttcacaaattaagaagacccctgttgggtggactaattaaagttgattgactttgtctagcctgctgtggacctaacacacagatagtcttctagatattgggagagcctcagtttttcacttttaatagtagcataatgctactattaagtttttcaactctttatggagacaaatgaaacaataagttgaagacggctttagaggacttcttggagaaaggccttagccacagttttattatcatgcattacaaatattagaagtgtgctttttgtctatggaggtagtggctggagttggtacctatgctgatgtcgttgatgggatgacacgtgtggagaagcatgttggaagttgactgtctctggcacaggctgctagggaatgaaaactaaacactcttctgaccatttgcatcattgagtcaagcagaaaaaaaaatcagttaagtaactccctggagtgacttatttctatttccatgggcatattgcctttgcttattgtcatttgcttttagctatttttgcaaaggtgctgaaaggctgtctctgaagtcagacagtaacattcaaaattatagacattatctatgtattttcctatccaatctcttactttaatgtccgaaaacacaagagtgtgggaaagagagaaacctctataactcaatcatgctacagcaattttcatggcccccaaagttacttcagtgaaatatttcaattcaattgagtcatgagtttgaatgttaaatttccccagctttcattagtcttttaaaaatctctgggtttagaggccttgcagtcaggcagccttgactgtgaatcctttctctgccactttctagcttctggttcttggtggagtagtagtgcttgggaattgctttatctgcagaatgggaatcatgatacttagataatatgctggtttttggttctagacaggtgtctgacacatggtatgcactgtaattgtgtttattgtctttcatgtaattcccaaaatgtcttgaagtttttattttcacaatcaataagcttgagagggtgtgtgaagtgtgtgtgtttcagaggagttgacatatggataagtgtgagaatactcccatccaggccctggggtcaaaagcagagtctgggagaattttaacaatagtttgtgttgctggcagaggaaggacagaagagggcctttgtgcaagggaggcccagcggcatggacacttctctgctttccgaaacaagttgttgcttttcacttcagaggtctggggacatttctgagaagcttgcagccctcattcttccagctctcttgggaggagtagaggagtagctgctgactgaggcaaaggtttggctggctagagccccctccagtgagacaggaggcttacatagtcagccctcctttgctgtgaagcaaatggcaaatcgagggctcccttaccatgctgggttgcgattagctgttcctgacacaaacgtttcatacagactcacaagtttcttgggcatttcggtcatttcagcgcagatagggcacatccagggtgatccaacaggcctggctgcggccaaggctggcggcggcaggtacccgggtgccccgagggccacccgccgccccgctctggcgcatccatcagtggccagctttcaccgtgtctgccaggcgggactcgccaggtgtcaggctcagtgccataagcctgacacttgcgcggggtcgccgtggctcctcagggaagctgggccaaggaggctgggtcgcgccggcgggcgccgaggccaccttctcggggcaggccatccgcgctgaggcgcagacacggcggctcctccaggcccattaataacccggagggcgctgcgatccgacagcgcagtcgccacaggctctatttcccgtggccgcctgcctccttccagcccagttcgagtggagggatactgggcgcccactaccgcccggcccggagggtgggggtccctctcgcgcaggctgctttggagagtgtcggagagagacagctttatctacagcttcacccattgtatagcacaacagaatcgcatttagcctggagaacagccgtcggggcaggagttggtgccttctctaacaattaggctgatcgttaaatttgctattcctttcttccggcgtctagggagagcgtgcacaccaaaccctccagaacagcaccccggtcccccaccccgccccacctgtccccgccctgcttcagtgcctggagggagaactgactggtcgcttgagggaccccatttcgggcgcgcccttggagtcctggggctgcggctcctgctctaccgggctgcaggcttgctctgccccgtcccgtggcgtttgggaggcagtcgaggaagcctccgagtctctgggtcgaaggaagtgcgaatggcacccgcgatagactggccgtctcccccaccccgccccgtctggtgattttaaatcgtctcctgtgtaattgtaaaaagaggaaagctgaatacccagacgaccagtatagaatctcttcgagacagcagattgggcaagagacgggctttttttcgcaatacaaggataaacacatcctgaaactccagatagaaacctcaggaatgggcgagagggtcagaaggaacgagagacagtagggaagagagagagagagacagagacagagggagagatgcagagagactgaaacgggaggaagaagcctggaactgtcggttccgtggagagcggacatgctatctgcgcccagatccgaaggctttttggggagcctagagtcctggcccggtaccaggcagatctgggtgcggcgaattccaagggagcggcgcgggttctcttctcctcctcctctgagttgcttcggtgcccccaaggcatcaccttcctcgaaggtggcttacccaggcgggcggtgatgctgttgtctcgggagtttactcaaagatgggccgctcggggcggccggattaacccgctcccttcccttcctccttcttgtctcccgcaggttgcgacatgtgcgcggacaaccgcaacggcgagtgccctatgcatgggccactgcactcgctgcgccggcttgtgggcaccagcagcgctgcggccgccgcgcccccgccggagctgccggagtggctgcgggacctgcctcgcgaggtgtgcctctgcaccagtactgtgcccggcctggcctacggcatctgcgcggcgcagaggatccagcaaggcacctggattggacctttccaaggcgtgcttctgcccccagagaaggtgcaggcaggcgccgtgaggaacacgcagcatctctgggaggtaagtggccggctgcacagcgcctccccaccgagcaggagccttggccagcagggagccttggccggcagggagcctggcctttggctgtggcaactgcgaagagagcctcccttggcccccagagggtagcggagaatagatttctctggtcctgtagatgcctggtgtctgaagcacctgcagtaaggaggctgacagagctgggactgacacaatagcaacccagccagggaaacagcctacaggtgtctgaagacagagtcaccttaagctgcctccattccagctggaatggatttgaccgttggtctctgtgaattttgagaaaaagagaaaacagctgaggagatggagcagcggagggtgggcattagaatgtttgagctgggtgacctttatgtcccattccaagcacttccagtgtgtttctgtgtagtgagcagaaaggaacagaagcatagaggggaggaaggagaggctggccccttttctcagataaaaacaattttgtcaaagttgaacgtgagagatcacatgtttcacaactttcaaagggcccaaagtaagcaaattatattgggaatcaaagggcccaaattaagcaaattatattgggaatcagaaatcgcaaattctgctgcttctctgatgaacggaaattatgtaatcttcatcaatatggaaaatcaaaacatgggaacagtgtgagcactttggtgtaacccaattgagggtaatactttaatggcacaatcttacctgaagcaattatttaaaaataacctatttgaaaaatgtcagcctgaggtttctcccaaaacatcatggtggattattgaggttcacttctgaagagatagatgcctatcattaggtcatccccctaccaatcttagccacctccatccatggaaagttgcttatgtaatacaagatgacagaagtcatacccttaaacaatatgtaaatctgactaactgggcaagtggtataataaagtaggaatagctagaaaataaagtttcttaaatgccaggggtcaggttgacatgaacccctgggctccattaatgcatcgtttctgcaagagattgcctctcatacttggcttgctggcctgtcaaaatgatctttttcactgtgagctgccttatattcactaaataaagctcatgggactcattaatccactcaaatttttgatgagtgcccactctggccagcactatattaggccatggagatacagtatgaaaaacagacctggtatccggaaccctcctgtgactgttggggatggggtcctgaggcctgtgtctgcaaagcctcttttgatggaggaggagctgagtgtatgagtctacagcccagcagcccaaaatgaggacgtggaagccaatgaactacctaccctatagttatctgctggagtgccccggctcaaagcatctggtttggaaacattttggtttttgtttctgactaattaattgtaacctccaatgtggtttaaagtttataaaacacttttaggtacttctcatgttccagtagtgttattaggaactctaatatcatatagttaaaggtctgccaatatttttctaagaaaatcgtacagcaattgttcaatagtacaaatttactctacctgaaaatgttaaaactgaacactattatattgccctttgatgcctatctatttttagagtgccaggggacaaagacataaacatgaacaaaaatctcatagttcattgtgggttttttcccccccagaaggctttgaatgattgggatgttggcaggaggccactacacatatagactataacaatgcatattaacactgaaaactatgaaacctttcttttctacctttacttgtacttgatgaagttaaaattttgttgtagtaaagagactggggaatttagtcagtgtttttctttttcttgatacttcagtagatataaagtgaattttatctattgttcagggcatgtgagttgagtgtgctgggatggttcttagagttggttctctgttagaaaaaagacttgctgggtgtatgcttggatgatctacaggatccaactcctaaattcaggacataatctattttttttaattatctgtaacaacagttagaataaggtacatttgggaattgaagggattttaaaactttagccatacaaaatgtgtcagtctcctgggagatcacgtgaaatgcgactaactggggccaggtaacttagtgccaatatccatttgtaaaataaaatacttactttataaaataggtttcagatttttattagcataatgatttttaagatatagaatatgagtttaaaatttttaagcattatgatttatttttatgaaacatgaccgtttgaattgttacatttataatacaatattccaaatgttagattgttccttaaattttagttctttctttcaaagctaaattttcttctgaaatttaaaaaaatcatcatattattcacattagaatcagtaagtagaatacattgtaggtctatcggaaatgtttggcaataattgtttaatgactcatgtaataattatccatttcaaaaacttattcttttagatgtcttccagaatagcaagtcaacaaaatgtattaaaaaaattaaaagcagttgaatcatgattattttattttaaaaggcaactgtaatcatttctcttcctcacattttttcaagtcatttgctgatgaagaaatgtctttttatttcaagttcaatactcaggtcctgatggatcttaccagggttacttatctttatttcagtacaataaatggattgctaatcttttcctgtcactatttccaagtagatgatggatttttgtttcagtttacacttcattgtttttagtatggttgtactttattatacacatgaaggcttattacagaaacaatcagattcaccttagttactccttttatttaatcattagaagctctattttctttgtagaaaaatgactttttgttatttaacatacatcagccatggagagcttgtttggtttgtaagcatgcaatcattgttttagttaatattttctttgtgtataatcatagttcttcaaaatacagcaatttaaaggaagttaaatatcatttcattatattcagtacattttgactcttctgggtatttatgggaaattccaagagagttgttttttctttttttgcaataagccaaggtaattttttattttttatagtttaagaagattacaagctaaaagccaaataattagtcatttatttttgctagtttcttttagaatcagaattttaatgtgttttttaaacaataataaattcagatactttaaaacaaaacattacaaggtgcatcagacaatgacttgccttggttatatatatttattccaagacttggatgcatgatacatttctagctatttggacatcatatgaaataaaatctttctcaatgttttccaaagaaaacaatctttctcagcaattaggtcttattgatgagaatgagataattttatcctaatgtgttttccaataaagaagtgaaaaggcacatttgattccaacatttatgaaaacattatctcaattattaatgtgccccctttctcttgagataaattaatctagttgcacacggtttcctctttctgcttaacatcagaatttaatatgactggacctgaggaatgtacccagtgtatacttaaaattctactggaataaaatacggaagtttaaaataaggttacagtttaagataggctagaattactcaggcctttcaactcagtgcctgacttgacaagaaattttagcaagaatgacaaaataaattgcacttattttcaccctagaaaaattatcctgctaattgaaataatgtagtgacttgttagtaatacagttaagatactagaaagggctttaattttacagaacctgtcttctctttgcctgagtaaatttgagtgtctcgttttcatttgcactatgtggaaaccttcattatttttcttcagaaaatcaagggggataacataatgtgagcctttttgtgatttggttttgtgccataatattttagatttaataagagttttgctgttaagcaaatggtctatttttcatcattactgcttagcttaagtcaaaatatattaatgaaaaccaatattaaaaatatattacacattgctaaatgtttatatttcaaaaccatcataggtaattggttctagaagaaaatgaattgatttcatattttaaatatattatgtatgtttctataaatgactcaatttcatatatacagtactatacccacttatatgtatttagatgttgaaaaaattattttaaattaatcattttcaattaaattagaatcacttaaaagttgtcgcagtgatagtactgtaattatatattccatattctgctttatagactttggctcattttggcgtgattcaccaagacactaggggatagaattatgtagctgtcgcagttatattgaagtaaaaatcatgtttttcagcaatttatcatttaatataatagtctgcctgtcagtttggttttgaatatgtcaaatttgtgaaattcaaataatttctccttaaaaataaaccatagtaatgctactattatgttttaaattatgcagagtaacagctggtgtatctctctggctttgcctcatttgatttgaagatgtcttttatagtggtgcctatttgatagagtgtgagcattttgtagttttacataaactgtaaaaccatctgccacctcttggaatggtttccagcattgtgttaaaagtcaaaacttagtactttaagttgctttgaaaatgtccatttaaagttctggtccttttggtttatgtatcatgctgcacagtgccacccttggttttctaagtccgagaataattctgctttaaaaaaaaattataacagccatttggacattctcacatcagtgaggtttaatcccaacatgcatgtgacactacagtgctttagctgcaaacactttataaagactgatgagttctgtatccaccggattatttttctcattagttcagtttatctatttttacaaattgcttcttttatcaatagcattttctcaatatgaagaaaataattcacaaatatttactggtccataactgcatattttcttacaccatgtaatttttttttcttttcccacactgacttaaaagtaaggtataaaaagagaaatcagtatctcagaggttagtgggtaaatgaaacctgccctccccagtcactgcctggcagcaagtgatctgatggaaatgtcataccataacactggtcccaagaagcctgcaggggaatcttcttatttcactgtgtaaattaaagcagttttaatttgagaatatctattgtgttacccagaaatcacttacagttgtagtataatatggattaaaaattgttgtgattgaatatgaaaaactacacattactcagctggggaatatgcctacaatatcaaagtcctcttgtctcagaagatggatttaatacactggtagtatgggaaaaaccatttgctattctaaagaaccctatatgtagaacaactatgagcctgcctccttcgttctttttctttcattcttttttaggatcgtatataccccaagatttcattagttcagacattccttgtatatttacacaggaaatacagacttcggtataagtacttagcataaaagtcagagaagccagagcagaatatacttttccttgtaagcatttgccacctcactcaaataagttacagaattccattatccaaattgttacacatgtgtgacagaggttgacctttcgtcatgtcaatcctttttgtgtaggccccaggctccagcctaatggctcaaaccctgatttactcactgtaataagggcaggaggtcgagcaattgtcaggctgcctgttcgtactcttcttggagcctggttgaaggctgttaacacaaagcttttcaaagtgaatttacaaccagcaccactgacagaggccaatcagtgcaccataaatgtcaggttagtgagattgagcagtaagtaaagtactgacagcacactattggctggaatcaattggccaaggtttaactgagaagagcaatctatgtgtggcgggcttagggaaagagcatagtgtgcagcctgggtttccaggtagactccatagatttactggttagtgggagcataagggttgggacatcacacacatttgcttcagcgcatccagcatcatccatgttgatgtgatgcacaatccgggagttcagtgtggccgggcctcctgactctgaggcttggtggtaaaaaatggcgcagcattagacaaaaaagagagagagaggaaaactgttacagtacgaggctgtcagaactgggggacacatccagtgcattacagttcaatgacaggtaatttgttcaaattccaaaactgtaacagggatttccacaaagatacagacacaaataagcttgctcttttgctcttccaaaggctcagcagtgtgaaactttcatggaagtcactaatgcgtgattatgggttgagggtctgaatatccatgagatgtggtttccccaccagacggaatgtttttatcattttgtgtaatgacagcctggacaacaattcatttagctttgaaggcatcagcatgaaaacagaggaatccattaaaatgctgtatgcaaggatttataaattaggcaatttccttgattattgcaatcatttacaaaattgatcattccagtgtggtatagacagatttcagcaatgatcattgacaacaagcacattccctgacatctatagctgctggtcactaaaccaggttactcttccccccaccctgctgttcttggtctcaaggtcaggtggacttttcaaggaatcttacaattatgaaatttcatttgtcttcagaggagacccacctaggctgtgagagcaggtgcagattgttttaaaggttacatcattgtttttggagttgaattgtacttttgggggagggttttgatcatacgtatatgcttcaaatcagtagcacagattttgatatgatgccaatttaaaaggaaataatttttgcaaattgcacctgtaaatatttgtttgattgcagatctaaaattcaataatgtatttatttttgttggtatttagaattctaattatccaacagatatattgtggaatcactggattttaggtcaattaattttagaaggcctaatacattgttacaagtgtgaaatgctcaaaatgctgcaggttttcctatataagaacatacacacatcaagttcacttggtgctttatcactagccacaaaccacagagttgcttttattcctgaaatatcagaaatgggcatgccacatgaatctgcagggctctttccaatgaaagctagccatgtggtttatgcttagtacaaagtaactgactttgagacatttgtttctaatcatccttttgttttcagtcatccttttctccctttaaaactttaacacaaactgggacttgtaaaataataacactttagaaaattgtttaacacagtgttgggaatacaaacaatttttgttctgatttttgtcctgtttgtgaatacatagtaatttgatctcaaggtagttctttgtttaaaaggggaaatgttgtatttcaggaagtccagtggtttggtggcaccttgcctttatttgctaatgttgcctaagtcagaagttcattttcatttttagttagttgtaaaactgactacttagaaatttagtaaaaacgtaatattttcagtcagtgtcttgatattatctcctcatttttaattaattttttttcacagcatttctggtttctgttaagacttaaaagctgcgtggttagctctgacttgggtgaactgtgatgaggcactcagtataacacatgcttttcccagtgcctctgtacatttatttagtaaaccaaaatctatagcatgcaattgtgaaataatgatatgggatttggcccattttattaaaatgagcagtgtttttcactctctgtggtcattttaaattaaagctgcctcagataatgaagtatcttctatagaaacatccagtgtaatctaattcagtagaaacgtcttaagtgctttttaattggaatcaaattaaatgtagtcaagtcatgttttcaatgtcttgtaaagcaccaagagctaaatattgttagcacacctggaaatattaatgtttatcacaaaagaacagcattaaattatgagatatccatgtatacttcaaaatggtagatagctcctaaacaaattcaaggttagaatacaatgcttttggaacctgttgtgtttgtcccaaactaatattaaaatttatttatgatattaaaatacacaaatagtttctggggataagagtcctgaaaaatattgggctactaaggaaagcacttaatttcaatttgttgcaattaattgcagagtaaaatttgacccagataatccacaaagtggaaaatctcaaaattaagcttaaaaagcggaaattaatttttatattacaaataatgtgctcattggaaagtcgaactatgtaagggtataaagcagtggtaaccattgttgatggttttcataatgggtttttgagacatgattatataatatatagatttatttcattgagtcacagttttggtaaaagatatttgcactatctctttgatactgcaaaacatcttggaaattgcaaccaatggcactgttttcacagggttccagtaaatgtttaaatttggctcacccatgaatagattttcattttgtctagtcttatcctctccactctgtattctcctggtggaaaattttattaacagcctgcagacccttctgatattataaaaacacttctaccaatatcttcatatattttatagcacgtgtctttaataaaaacaaagcgtttctggggtctatgaggagattataatggtctccaggaaaggaaggagaaaatttctgtttcctttttatacatgaaagtgttaacaaaaaaagatcaagtatctttgaaatgctttttaaggtagggagacattaatttatccagttgtggtgagacattagtgaaacaacttaatttctttatacctcttttttccccacatgtgaaggagagtaatattgatggctatgtaaattacagagaaaatattgatgacttttgtgtagtaattgagattttcccccgttttcagttcgattttaatggtaaattttgtctctagtggactctgcacatagatataaagagtatcattatttgataaaacaaaagattgtatgtattaatggtagaccatgatacatcgtttggatttaattacttactaaaaactcaagtttaagtaatatttcagtgtaaatttacttagcaatgcttacaaataaaaaacaattatgtactaaagggataccatgcaacatggatgttaaaaaaaaccccattggatggctctcatttttaaaactgtatttttaatggagggcaacaaggatgactacaaatgttggcacatttatatttcctaaatgtacctgatttcagtaagcaaaatgctagctgaaaatcctcacaacaaagaaccaacttgcaagatgaaaatgcgagaattactcagtaacatccagaaaaatcataaggaagccctaacatgtgaagcctttttgaccacagacctcaaatcaggagcaattcattaggtaggtttgacactggatattgaattctgaatagaagatcatctcagtgtccagagtattgtgacctgtccataaatattaaatgacaacaaatcaacatagtggcatatttggcactgtctgtaaaaatgtgtgtgcagccatatgtgtacttgtgaatacagacataacagtatatcatgcaaattctgaatatatgtcactgttgaccctgtgaaaagcaagaattccaagtgacactctgcagttagaaattttagatgaaaaaataaacataattgccaaaacatgtcataaagaacaaaaattttgactaaaattaatatttttcctgatatatatttatttcatattaatcatttcctttttttttttttttttgagatggagtcttgctggagtgcagtggcacaatcccggctcactgcaacgtccacctcccaggttcaaatgattctccttcctcagcctcccgagtagctgggattacaggcagctgccaccacgcctggttaatttttgtgtatttagtagagatggggtttcaccatgtgggccaggcgggtttcaaattcctgaccttcagtgatccacgagcctcccaaagtgtgggattacaggcgtgagccactgcacccggcctactttttttttttttcttttttttttttttttgagatggagtttcactcttgttgcccaggctggagtgtaatggcacagtcttggctcaccgcaacctccgcctcccgggttcaagctattctcctgcctcagctcctgagtagctgggattacaggcatgcgctactaggcccagcttattctgtatttttagtagagactgggtttctccatgttggtcaggatggtctcgaactcccgacctcagtgatctgcccgcctcggcttcccaaagtgctgggatttcaggtgtgagccaccacgtccggcagtttttacttttatggcaacctaagcaggggtgatactcaaactatgtcacgaccaatccaggttagtccctgagcctcacataatcctagattcccacagtaatatctgtgccccatgatctgcatatcagctctgaatctaggatagctggctgaacttcagcaaagctattcaacaaattaacagtaataataataatatatattatgtgtagggtttcagatatgcaagatgaaaacattctggagattggttgcataacgatgtgaatagacttaacagtactaaactgtacatttaaaaatagttacaatggtaagttttgtgttaggtatatttattttgccataatttaaaaaaatctatgttttcaatgactttcctgcagctcagtaggtctcaacctctagcagggagtcaagcatagtgcagtctggggacctgcccctaaatgatttggactcagtggtcctgaattgggggtcaggaatctactttgttaacaaatgtcccaggcagtcctgaaactatccttaagaaacaaaacgccggcagggcgcggtggctcacgtctgtaatcccaacactttgggaggccgaggcgggcggatcacgaggtcaggagatcgagaccatcctagctaacacggtgaaaccccgtctttactaaaaatacaaaaaattgtccgggtgtggtgacgggcgcctgtagtcccagctactcgggagcctgaggcaggagaatggcgtgaacccggggggcggagcttgcagtgatccaagattgcaccgctgcgttccagcaggggcgacagagcgagaaaacaaaacaaaacaaaacaaaaaaaaaacaaaatgccagtctcgtcctttctcttccttgccccttgtggttgtttgccccgcttcctgcctcttcccttgtctttgctactcttgagctcacctggcctctcttctgcttcaggtccacagttggtttagttctgttaataatcctgtgttaattccagtctctaccttgccttcgcccctgctacatcttggctaatctcctgtggacatttccaatctcctcccttatcacctctcccacctccccagatatagatagatgatagatgtacatattaaagaactactaacagacagcaaaatgaactcccatgacttccatctttctgtatttcagaactccgcctggctaagcataaggaggcagccaaaagggcagaaaacactgcgtgtaaactgctgtgtgtaattagctcctaagtaatcagggtgtacttccagaggaagtggcccactggaaggtgtttggcagtgtacaaagggcctgggttctagctctcactgggtgtgagctatgtgaccacctgcagcacaccttaagtccctaagctcttagcagtgctgcatccagcgacactggcctttccacttctcctgccagccccttcagtgcagtcctatatcatatggagaacccatatgttccttgcatgacatttgtgatttgcagtctgttaattttccatatgccagctttatctgctaatttgctgatctttttccctcctcggcttcccattgctgctgttgatggaagtcatccgagcatgtagcctgttttctgttctttctcacacccggagagctcacctgttcttcttgtttcaattgctccccaaaagcgatgctctcagattcagtatcccgcactgatctgtcttaaatcttatatccttagttgtgaacatctccatctgaaagtcctgacattgtttcaaactgagttcactaactgctggcactcacatctcccctaatctttatccttatctttaatttatggtgctctcttagtcctttttaacctgtgaacccaacattttagagttactctaatggctcttttttttttttttttttttttttttgctatgctgtattcttcttttatttcatgtgtgcaaatttaaatttatgaagtcaatcattagtgccacaactatagcctgacaatttaaaatttggttcacttttatagtaaacaacatctcaatctaatgtttagacatttagctgattgttaaacattagctaaaatggatcttttcctgaaacagtgttgccaggttttaaaatattaatagacattatgttgtacacttttgaattaacataaaaattgaaggacgttagtgcagaaagttctcatatcccttccccactagttttttttcttttaatcacatcttccattggtgtggtacatttgttacaatgactgaaccaatactgatgcattactatgaagtaaagtccagcgtttacattatggttcaccctggtgttgtacagtctatggattttgacaaactcataatgtcatttatcaccatgtaaaagctttttttaaatgtttatattcccagcagccaagaatgcctagcatacatagagcatttaaaaattctctttatctgattgcaataacgagagctaacatacttaagctgagactatctgccaggcactctgctaagagctttgcaggggttattttaatttattctcacaatgacacaataaggtaaagactactgtactcatttttcagatgaagagccttgttagatgtaggcactgagagccttttttagatgaaggcaggtaagtaacttgcccaaggccgtatgtagtaaaggcaggatttccatgtaggtgttgtggactgtagagttcttgctcttcaccggtctgctctttgctttctgccccttctcactatctggcctgtactcccattaaattacagggcctcagcctctgccacaggcctctttattcagctgaccctggcctctggacccggaggtgagctttcttttctaggtggacactgcactggtttttcagacagagcagttatagcttcacagagaccccatggctcaggcccttgacatggttagcctaccttgtgttccagggccatgggcttcatatttattatcctagaaagtttaaactcagcattcagagaaacacatttatggagaacctaccatgcatgaggcattgtacaggtcacaaggatggaaaataccaactctggctttcaaagatagtaaagtagtagaggatcatgagtaactccagttgggagcagtgtgcaaaaagtgcttttgaggtgcacagaggaggcagaggtgacttcccgccagaaagattagggaaggagggagagtttgacctggagaacatagatggctaattcatggagtcaaggatctgaaggaaagatgcccctgggagagggtcagcctttcattggtggggctccactgtctttccaagcccaggtctgcttcctctgtcagcaacttcatgcaaactaatagaagcacttctgtttctttaccaatgtctcgctaattttcactgctgtgattttgcctgtgctatttatttacccacaagactctcttcttattctggtcaacccatctcttttactattttagagtcacatctcccaagaattccttccaggctaatcccaggtcttcaccaccctttccacactcactttccttccagcatccccttgagacttgttgaggttttgctttctctcccgatattacttgtagcctcagtcagtttggtaagcttatttgggaaatagttctgctaaaaaattaatttttttaaatgtagaattcaacattgactggaggtccttcatttttgtatgctaaatttgatcattcaggtttaagattaaggtaacagttgaggacagacacctgatagaaaaatgaatgactcttgtgactggggaggccagggtgctgaaagcctggtgttttcagaggagcatggtgggaaataaggttatggtagttggggtcagataaattagactgtgggaaagacttcattttattccaagtgaaatagattttgagtggcagtagtagcatgagctgacttatgttttcaaaggaccactctggatgcttggtggagaacagtctgtagtggaacaggggtggatgttgttaggagacactcagaggacaggacgtggctggagaaataaattaggagttgtaagtgcatagctgttgtttacatccagaagactgcttgaggtctgcttgggtgagggtatgcagagctttgactagaggaggtgtaagacatctgtagttctgtaaacctgtgtgagtcagatctgcaagtcaaatgtgggctaattaccatgtagcaggtgtagttgtggatgcctcatctcattcccctcccctgacaataaagggaagagccttacgtttgccttcatggttgctgtgactcagtagtgtagtgacgttggaatgatgctgccactcctaaatgtgttgcatctgtgaaccatggggcctttatacttcccaactgaggccataccagaatccttctccaaggaaagggatgcctaatcttacatacctaaatgttgtactgaaaatctcttttacctcctctactcatagtgagccatgctagccacacatgggtgcagatacacatgggcacacgttcacacgcacacactgttatcaaaatttttgcagtatttttcctcactttaattatgttttatcattacaagggctgaaaatatttataaaatggaattttgaaagtgtagaaaaatattttaaaaagaaaaaaacaagaaaaacaaatttggtgtaattcttattgcagttagtattttctttaaattcatagatgaaagcatgctgcttgtcctcatcataaaaccatgataagatttccccatattgaaaatctttgtgaacataatttctattgactccatactcttaatatgattgaatccaattgctcaacatttgtgttggttctttcctcctccctcttctcttccctttctccctttctttcttctctcctcctttccctgatccctctctcctcattttgaaaatattactaatcatttgttatcctgagcatattggatcatgcttgccaaaatacctgcaggaaaagacacagaggaactccctctatactaacaacaataatagtaggaataacagtgatcatttttgttgatcactttttaatttacaagagatttcatcacaactggctgactgttttgttgctgtgccctctcaaatgcagggagtgctccgtgctgcctggtgtgagtgagatagggaagctgtggatcccggaggctgcttgctcagttcctctgaaggtcgggtggagctggctcttttgacccacatgctccaggggagctttccatctgtccaaatgttagcctggaactaaacgcctccacacagtgatgaaatccctaacaaatgtagtgacaacactgaacataaggccttaatttttttcaaattgcttgcatttacagttaattcagtttgaattataagtcacctccatgtgaatgactcatgcactcattattaggagctttgcattctaaaatgtacaaaacagagaggagctggtttgcaaactcggcatcaccaaggtaatattaaactagtttcaaactaagaaagtggtttcctgtcattgcacatcttgtattccagatccagagttatcaaagaaaaccgtcatatcttttaagaacacctttggatcactgtatacagtagttattggaggggatatgtatggaaatcaaactcaattatgtagcataagtgaaaaaaaaaattatttttctgttacaagacaatttgctttaggccagttgaaaaccttttccaagtccagacctgttgggacctagagggacggtcaggctaggctttgtaagttgtgatggaagtgaaaaaatgacttcaaaagcaaataattttaacactgtataatagactggggagaaatagtaaggaaatgcccagaaaacaaccatataaatagataattgctgaaatatttggataatttcaagaaaaagtgcaggctaaatttttggacagtgaaatcagctttccataataactctgtctcccagccagtaatttccttgttctccctaatttacttcacttctctgtagctggaaaattcctttgttttgtaccctaataagctggctctgcagccactaagttctattgtgagattttgtcttgcctcctgcttttatgcacataactggtccctgccagggagctctggagcccccaaatagctttaagctttctaatgacttttcccaggggtcctccaggactgcccggcaacccaacagttcatttaaatttggacccaagtccagagtaactctagggttatgtaattttaacagttttagagctcctagtaagggggtaggggtggggcctggggaaaaaggcaataaacatacccatacccaggttatctctactagggagcttatggctaaagtagtcacaactcggattgtcctgccctagaaggcagtgggtcatttgaggtacctttggtttttggcatttttttttcctctggccaaggcagtggcttctacttccgaaaactctgtttagtggcctggcatgatggaaattttcataatcttgactggatcacagcaagtttgtgtctgaaaagtttaaaaatggggacacatgagaaaggactagataaccagcaggaaggaagatgggtttctttttggtgtccccatcacctttcctgtttggttagagtcactgatggattttcctcagattcgtcctgctggtgtaagaactctaaagctaaagttctgtttaatcttgccaaagttgccagagcaaagagcagccacggagtgtgtcacgttgggatgaatgtgaaggcctaaacagcatttgctcatttgctttgcatgtgcagtgactatcataccaagagctggaccagaaattgtggattatgtaaagtgctaatgggcgcagttccgattttggaggagcttacaatgtgataggggtgagccattcattcaattattcaacatatatttgataagcttctcaatgtgccaggcactttaaagggttgtctgaagatagcattgtcttagaaagacacagtccatgactagatggagcttacagtctgtgagggagacattggatacctgaggaagatgtttaagtgaacctgggcacctgattttgaaaatccagagggataactgaggagatgaatgaagagccagttggggaggtgagtcaactcaagcctcctctggatgttagtttgcaatcaggtttttcaggattagtgtatgtggaatagtaatcatgaagagagatggaattcaagttgggataaatggcaaatgcaaaagcccagaggaggaatgagcaagttgttttgtttagaaggttgacttggagtgtggctgtctctcaataggctgatattaagaaataaggctgataaattggagtcgcatcagtgaacttcttgaaaactaggtagagagttgcggtttgagatgcaaataggaaactacaacataatctttaggaggaaaacttgaggagggcagcttgcaaatgaagagaacatgggtttgactcaacaagtaaggtaaaactaggttttgcaagtttcaccaccatccaagctctccccttcatttgggctgataaagattacgataagtctggggacatccctgaacccttgtgaatttcaatgaccaaagcacagactgtcttacacatgagctgtcagtcagggtgcacagcacttttagggcacttgagtgttgtaatgtcttacatttggtagcattctaagtagaaggacaagaagtagagagcaaacaagtatgggtagaatggtgctggaatggggaagaggagtctaaggcagcaattttctgccctagaattttttttcttttctttccttttctgatggtgattgtggtaacatcacgcacaggcacaggtatatgaccttctgttggaacaaaagaggagtgtcttaggttttgagacaaatgaatgcatcttgctagatttgggagctaagtatcttggctcttatgcatccttccacaaatggcactgagttgtgttcaaaaatggaggaaacaaacaaaaaacaaagaagaccccacctgtgtaggggcttggagttcaaagataggggtgatggtgttcatatgatagtagcagaaaaagttgaataatgcactggagtgactgatgtgtagtaggtagcattaactgttactatctcctacccacaaataaacaaacaagaaaaaaactagcctaaaccgacatccaaactaataagaaaactaaggaatgcaaatgtttaaatgagtagagattagagtagggaaaaaacaagatgagagatttaaaaaaatgaaacaagaacaaaatgagtgataagggttaggacttgagaagaggacgtgggcaaaatgatgacagtttctgagaaggtgaggaaagaagtgaagggagagacaggtcctgaaagccgctggtgctcaggcgcccactgcaggaagggcttacagtcctgccaccttcagggcggctctgtggcttcctcagctgcaacatctacactcctgctacagtgaccagaaacttctgccggtgatgcctggccctgccccctcttggaattagaggaatgcatctgtttgtgggctggagattagagcccagggtcggggactatgaggaaagctgtctttttgggtggcctcacaagacatgcttcagaccctaagctgatacatctaaacttccttctctgataatctataattttctgtttttagaactacattgtcagcggtgtcagagagacccttctcagatgattcagccatttaaaaccagcagtaatatcttttgtttggaaattaagcaacagaaaggaattcaaacagtcaagctaagtagacgcattttttaaatgaaaatacatgagtggttatactaccaagttaagtcaagtcagttttattccagagctttaaacaaggttaaaaaattatattttaatttatttgcattttttaacttaaaattttttcattccattaaaaaaagtttaaggtttttccctcgtcctctctcctagaatgcttaatatacattaggtatcttacaaagagttattggttgattttgaatattttttattctgttaagggtatttatttatcctcagttaacttctttccaaaaagatttaaagtgggtcttagaaagccgaagtttagagatggataaatgttttgagaagatgaaaatggaaaattttaaagaggaacaaatgtgcataatttaaaaatattctagatgctgttttgaagccgtcctgtgttatgtccaaacagtgttgttttgatgcagttacctggtgtcattctcctctaggaattctgctgtttggttgttgagtggaaatggtgtgatcatgatgtgatgtttgtcctatcctctggaggcagcgtcacacagtggacagggtgagaggtgtggagttgagcagttcagtggggtggtgggggtagctgggattttattttttaatataaaattaagggcttttcctttattaaacaagtaaatgatgttcattaccaaaaattcaaaaattacaggaaaaaattttaaattctcacagctcaccatccggaggcaaactctaaaattttaaatgtatttttccttagaaatttttacatatgcctatgggcatgtagtatgctgaatagacttttaactttaaattattatctaaacatgccctagtgtaatttgtattctttgttaccattatatttaaaatattgtccgttaaatggacaagtcagaatttgcttaactgtttccttactgttaaacccttagcatctaggttaatagattttcattattttagtgagcatatttggacatgttagttaatcttttggagccgtaggtttggcttctgtatattgggaattatctctcttacagagttattggcagaaatgaataaggtaataaatgataaatagtgggtacttattaaatgtgggacctttttccttatgtttgggcttaatattgttgttttaaagatctgtgagttgatgtttataaatgttaactcactgatgtttttaaaatgaaaattacaaaaatgtaaaatttcttactttgtgcaaaagagcagggtcctgaaaagttgctttaggtccagttttgcacacttaaaacggagtatctttaaaccacttggctcccaagccaccaagaagctttttttacctatgtttttatagaaatttcaaacatgccccaaagtacagagaaataaatagtgaataagttctcttgcaccggcaacttattttgaatatttttttctttctattcttgttttctctgtttgctccaacttttctttttttgcttcattttttgtgttgttttttctttttgttttgttttgcttttttgagacagggtctcactccgtcacccagacaggagtgcagtggtgcaatcatagctcactgcagcctcaaactcctgggctcaagtgatcctcccaccttggcctccccaaatgttgggattacaggtgtgagccacacaccaagcctgttttcttgttggactatgtaaatgtaaatcccagtcaccttaacatttcacctataaatattttaatatctgtctttaaaagacacagattaaaaaaccaccacataaccacaatcccatcctcacacctgataatattaacaataacttcttaatgttgtctaagttccatgtctcttccttcccccccaaatattttttatagttagtttgtttcaataacaataaaaacaaagtcttcacattgttgaaaaatctcttgcatctcttttaatatgtaacagtttagttggggagttttttagttttttttttttttttaagaattcctgaggctgggtgcggtggctcatgtctataatcctagcactatgggaggccaaggccggcggatcacgaggtcaggagttcgagaccagcctggccaacacagggagaccccgtctctactaaaaataggaaacattagctgggcgtggtggcgggcgcctgtaatcccagctactagggaggctgaggcagaagaatcgtgtgaacctgggaggcagagtttgcagtgagccgagatcccaccattgcactccagcctgggcgacagtgcgagactccatctgacaaaaaaaaaaaaaaaaaaaaaagaattcctgagtctcacctgtaacctgctgaatcagaatcatcaggggtgtagtctgatggcagacattttataaatgttctagtggggattctgatagacaaacagccttgagaacctcagtacaaaggagtaaatttaagatacctttaaaatgagtgttttagtaaagtagtcaaccttttgaaatataattaccatctagttccctagtttatttatcttgtgaatgtaaacattttatttattggatttctctgaagcgggactaacttcttctttgggtgatgactgagatgatttatggcttctttctctgattgcttcttttgttcctggtgatcatttctcgttataggtgtttttctgctttctcttgagtactctctacttaaatccctcaatgtgtttgcatcatatttgtagttatcgatcttttcattgcaatttttttattacataggataattgctacagaaaactgggaagaggttaagcagtaagaagaaaataaaaattacctataatgtctctagttggaggtaataacttggtattttcactgtatttaattctagtttttttcttgtggcaataaacctttaaaaaaaaagtttaaaatccgactacaagaattttggtaatgtttaaaacatagtatattgtaaaatgttttaaattatgaaacattctttactacgagtttaatgattgcctagtatcccagcatatggatatggcctaattttggatatttgacttgcttaaatttttcccctggaatggaaatccttatttgaatccttatagattcttatagattcttttggcatatctatgactattttattggtataaattttttatgtttctgggttaaaatacttatatattttaaaagcttttaattttgcctaatttaccctcagaaaggttatatcagtttacactcccctgatagggtgagagtatttgcttctctgattccttgtctatattcgctactttttctattataaaccatttgtatatcttttcctctttcatattagtggcttttaacagatgacctgattatatgctttccaggcacatcacacctaaggatccagtatttggcccttttgactcttgagtgtttggaaaacaccttttggaggtctgggaagccacctgtagtcagttcaaagcttttggctctcattccagagattaaggatgtgtagaaccatgtggctggctattgagatttttcatgtagtcggttacttttacatactgcattgccacagagatcatgaaatgccctggttctggaagtggctgcatttcattggtaggctttaaaataaatccaaaacaaataaactttctcaattgtctttgggatccttggaatccacgtttgcaaaaaaaatattttacaattggttgttttattttcatttctattgcctttcgttctcttcccacatttatactgatgctttaaataggcatgatttctcgttcctcccatgcaaactcttaatgccactctgataacattggaaactttaggcccatttgatacaaacccttagatgtacttctgatttcttatctggcttttctggctgcctcagtcctgtctcttgtatcagatgagagttctatgggctctcgttagagggcaactgaaagagaaataacatggagaagaaaaggagaaagctgaggtatgggtggagaaagggagagctggggtatttgaatattctgaaaaactggagaatccatggtttagagtaggtgacattccttaaacgatactcattagagtgacatgagcaagggcagggaagacagggttcctgccaaactttgacctggtccaggtcaggccaaccttagagactgacttgccagattgaatggctgctccttctgtgttgaaggcaagttgggttgggcatccttattttgtgctgccgttgtcctgcagcacagcaatcataccataattctctgcatatatgactgtttatgtagcacaacaggaagagccaatctggtggtattctaaatatttatttcattgtagatgtccagcaggataattcagacgccctaagtccactttagacactcgcatttgtagaatgaatgttgccaaatttcagtttacttttgtgctgatcagacacacttcatatagtgctttaaaagacctcgaagtgtttttatggaacagacagacacgggaagtttggttctaaagggctaagacaaaaatattattgctccattggtaaatgtatttacccaaatctgttatttcagacaatagcccaacttagcactggcattaaatggaataaatctgttcttttactgatacggtgtctaatttagaaactttgctgtttttggcaatcacactgccttgatttaggtgggacagggatcagggattaaaatggctcttcccaagaggaaagtagacaagtttgacagcactgaaaacccaagacattgctgcatccggaaaatttatggttaagactggagaagtctggaaagttggacggctctgtcatttattaatttattggcctatgtaagatgtttttattttagaagactgatctacgacctctgaaaggatatgttttcaaactctgtattttttttctacgtgtaaaataaagatattctacatacaattttctaaaagaaaaaaaaagtaaaacaaagtgggaaaaaaggtccatgatattgcatccagatctgtgaaaaacttttcctttttctctattcacgttttgtgtattctgaaggtttgatgccagaatttcatcattaccctggagactgactgcaggcaacttacaacatttttttttttttttgaatcttgtgttgcgtttttctgaaaaccctcctagtaccttgctcaatttgtataattacataccgcaccccctcccccccacccgccggccccgccacacacacacatgagtggcaaaaaagccacagtgcatagatcccagggacttcagctgtgggttccctttgtgttcctaactcagctgggcttatagtacattttaagtcttggtgactcatagtctgtttgttgtgttgcctcatttaaattgtggcatcataaatcatttcattttttaatcatttgagtagcaaacaccccaaagcattgaagttaacaatgttaatggaggtttactttggatcccattgttttaatatgacaaatggccatgcatcaagctgcgtagcacagtttatttatgcagacataattagccctttgaaatgaaatatacagtgagccatttgccagaaattcaaagtctgctcaacatggcccatcctccaatcttactcctcctatgtgcttgataggttcaaggcagaatgtaagcaaggatactcttggctgggggaaattggaattaggattaaggaagaagttaccttgtattcagaatggaacactttcttctccatttctttgactttttgggggacttccaataggagagacttgaaaagttggaaaagaaattatttttggttctaaatatctgaagaaggggtagttccccaaaagagtctcattgaagacagggagtttcatgcactggaagacactgtcctctaacatgcaggttctggggagaaactgtagaatattctttctcagagatcttggagaacaacatatgtaagctaattttcaggatcttatcaaaactttatagggtctttttccctgtatgtgtttactttgttgtgcttatatgtgtgtgtgggtgggttggggggaggggagcaggaatagaagatgtagtagttcattcatggatgaacagttactgctttaagaactcaattacttacattttaatagctagtgcatagggaccacgttggcataacagacaagttctgggaatgatgagtcatccctcacaaattcatttcagcttcccacttttgtacatgcataagtaggcccaatcttcctcattaatctgaggggtagtatcaatgagggcagaaagaggggacagaggctgcctccagggttccataagttatgtcacagtgatggcaatcactatatctcttttgcttagcatgaaatgtcaaaggaggtgagtgaccgcttaaaagtctgggctctgatgcaccaagtgtttttttttttttctgttgaaattaatatagcatctccttaataacagagggccaggactccagcagtgagcagtggatcagtactatttgggatgagtcttttctctgggctcagctaattagttatggaattggcctcatgccagccaccaccatacatacctgggttctgacatgctctcagaaccagcctggtgctttttaagatgccagtagattcttggattccatgttgaccaaattttgtctgtttaagcaagatatatctgctggacaagagatgacacatatttctacattttcttagaatgtaggaaataggatttaattttagggaggctattcctagccaataacaagaatttccagaagttttacacctgtttctaccttcgtttccaagaaaagccttctagctattcacctaatcctagccccccaggagttactatcataatctctgtctatatagttattaataaaccttttatgttttataacgtgacacaaagtagtcttcttttggggtgaggactgttcaatgaatgttgattgttgttgccctggtgcaaatgacctaccagtaaatttccaggaaaaccctggctcccagaacttagactgaccctaccccactcccaacacttaacttttttttttttttgagatggagtctttctctgttgcccaggctggagtgcagtggtgtgatctttgctctctgcaacctccacctcttaggttcaagtgattctcctgcctcagcctccagagcagctgggattacaggcacacaccaccatgcctggctaattcttgtatgtttagtagagacaggttttcaacatgttggccaggctggtgtcgaactcttgacctcaggtgatccacccaccatggcctcccaaagtgctgggattacaggcatgagccaccgtgcctggccccaacacttactttgttttactcctatttactggaagcattgggaaaatataacagttggggaggaaggaaaacacaacaagaggttgggaagttctcatttctaatctctggaactgtaaattcagtctctgtgtgtagcatcgttgagagaagtaagtggagaattgactacttttttggggttgaaaaaatttaagcattgttagttgtgagacttaatcccattcaagttttattaacttttaaatctatgcctggaacatctatggatgaaataaagcaaaggcttttgatccgaaaacagtgcttttagagaaatgctattctaagggatttcttctttctttcttttctttctctttctttctttctctttctttctttctttctttccttctttcctttctttcctttctttcctttctttctttctttctttcttattgtactttaagttctagggtacatgtgcataacgtgcaggtttcatacataggtatacatgtgccatgttggtttgctggacccatcaactcatcatttacattgggtatttctcctaatgctatccttcccccagcccccgaccccctgacagaccctggtgtgtgatgttccccaccccgtgttcaagtgttctcattgttcaattcccacctatgagtgagaacatgcggtgtttggttttccgtcctcgtgatagtttgctgagaatgatggttcccagcttcatccatgtccctgcaaaggacatgaactcatcctttttaatggctgcacagtattccatggtgtatatgtgccacattttcttaatccagtctatcattgttggacatttgggttggttccaagtctttgctaatgtgaatagtgccacagtaaacatacgtgtgcatgtgtctttatagtagcatgatttataatcctttgggtatatacccagtaatgggatggctgggtcaaatggtatttctagttccagatccttgaggaatcgcctcactgtcttccacaatggttgaactaatttacactcccaccaacagtgtaaaagcgttcctatttctccacatcctctccagcacctgttgtttcctgactttttaatgatcaccattgtaactggcgtgagatggtatctcattatggttttgatttgcatttctctgatgaccagtgatgatgaggattttttcatgtgtcgtttggctgcataaatgtcttcttttgagaagtgtctgttcatatcctttgcccacttgttgatgggattgtttgtttttttcttgtaaatttgtttgagttctttgtagtttctggatattagccctttgtcagataagtagattgcaaaaattttctcccattctgtaggttacctgttcattctgttagtttcttttgctgtgcagaagctctttagtttaattagatcccatttgtctattttggcttttgttgccattgcttttggtgttttagtcatgaagtccttgcccatgcctatgtcctgaatggtattggctaggttttcttgtagggttatggttttaggtctaacatgtaagtctttaatccatcttgaattaatttttgtataaggtgtaaggaagggatccagtttcagctttctacatatagctagccagttttcccagcaccatttattaaatagggaatcgtttccccatttcttatttttgtcaggtttgtcaaagatcagatggttgtagatgtgtagtgttatttctgagggctctgttctgttccattggtctatgtctctgttttggtaccagtaccatgctgatttggttactgttgccttgtagtatagtttgaagtcaggtagcatgatgcctccagctttgttcttttggcttaggattgtcttggcaatgcgggctcttttttgcttccatatgaactttaaagtagttttctaattttgtgaagaaagtcattggtagcctgatggggatagcattgaatctatatattaccttgggcagtatggccattttcacaatattgattcttcctatccatgagcatggaatgttcttccatttgttagcgtcctcttgtattttgttgagcagtgatttgtagttcttctttacatcctctgagggatttcttatagagcagggtaagaagaaaagggaggagtgatattttaccgtgaaaccatataaaacataccaaattcaggacttggtatatcattatcatcaactataattatcattaacaaataacatcttcaaattctaagtatggcaaaaatctcctggggtatttattaaacctgtaggtctatcctaaattcactgaatttaggtgtgtgagaaacaccttgcgttgtaaacaagcacaaaatttgaggacattaaataaaggtacactgcttatcatatcatcatgtgtctataaatatttcctttcctttatttcattaaaaaatatctggagtattaagatgtgttccacttaggatctaagacagggagaatcagaaaattcaatatttcaaacctaagcaattcctgtttataaaaatagcatctgcactgattggcagcttgcctgcctgcctgtccaccttccttcctccttccctcccttccccttcccctttactttcccttcccatttccctttccttttccctttcccttcccttcccttccctgtcctttccttcccttctctttcctttccttcccttcctttcctttctattccctcccctcccctcccctcccctcctctccccttccctcccctctccttcctctccccttccctcccctcccctcccctcccctccccttcccttcccttcccttcctctccccttcccttttcccttcccttcctctcccctccccttcccttcctctccccttcccttccctccctttcctttcctctccccttcccttccctcccctcccgtccccttcccttccttctctccctccctccttccctttttctctccctcctttttttcttccctcctccttttttctctctttatctctttctcaacagcagttagccctgaaaggttatcttaaagaattaagaaattttcaagcatgaggaataactattttcttaatatatttagcagtacacatatgttttttggttagaatcaggcacacagaatctttttgtagtgactttatttaaattctgtcatttatttagttttttttttttcttttgagacagagtttctttcttgtttctcaggctggagtgcaatggtgcaatcttggctcactgcaacctccgcctcctgggttcaaatgattcttctgcctcagcctcctcagtagctaagattacaggcatgcatcaccatgcccggctaattgttttgtatttttaatagagacagggtttctccatgtttgtcaggctggtctcgaactcctgacctcaggtgatccgcctgcctcggcctcccaaagtgctgggattacaggcgtgagccaccacgtccagcctaggaatatttttaaaatgataaagcccatgtgttccattaaagtgtttatggcattaagtgattaaaaattgcttttgagccaaatgatagccaataaacagttactagttctctcaagagatggtctgggaattcagtgccactgcaatcctgcttacatttctttattcttaatagcacacagtattgtctgctacttttttcattatattaaaaattatggtgatgcacgtgttctcactcatatgtgggagctaaaaaattgatctaatggaagcagtgaataagatggtggttactagaagctaggaaggctagtagggaggggagataaggagggtttggtaaatgggcacaaaaatactgttaggaggaataagatctagtggtcactagcacaatagggcagccatagttaatgagaatttattgtgtatttcaaaatagccagaagagtaggtttggaatgtttcccacacaaagaaataataaatatttgaggtgatggctagctcagttacccatgtttgattactatatgttgtatgcttacatcaaaatttcacatatattctataaatatgtaccagtattatataaaaaaagaaaagttaaagaaattattattaatgttgacagcatttaccgtatgcctggcattgttctgtgcactttgcacatactatccaccttaatccttgaatcttccttttgagggtggtgtaattatttccatttactatgtcagaaactgaagcctcgagtggctgtgtctatcacaacaccatgatgcatcggagtcataaattttaatatctatctttctcagcagattggataaaagtaacttgaggccaaaggtcatgtctgactcaaatgtatattctcaagttttgattcatattttctgaatgaacaatgatgataagagttacttattgatattgaatgcttattatatgtctggtacagtgccaaatgttttgtttctaggactacctagggttgcatatcagctctgttccttactagaagtgagttcttgggttagttgtttagcctttctgtaccctgggtgcctcaaagacaaaatggaaatagtaatagtatctgttccataaagcagtttgagaatgacgtcagttaacatataaagcacttagaacagtgcctggcacagagcaggcagcttgtgcatattaactatcattattatttccaacctagacatatccccttctgacgtatgtgcccttttcataacagctatcctactttatgtcatacttaaaaatttttatgtagagagttccaaacttcctttgtctattacttgagccaaacttctatattgtagtattttcagtgctaagaatcccatgcattaccacgtggggtgtataaatgtagagaaacatcttaggcctttcaaaattagaattattcctagttgtaattaaattaaagttatcaattttcacataagtaggataaacaaattcctctgttgaagtaacagcaagttatgtgggtggttgtgtgtgtgtgtgtgtttcctctttctaacttatcaaagagaagttttgaaatcttggattttctataagcgctttctaatgggtttccttgtttagtttttcacaagagcaggtatatcatccccatatctctggtgaagcactctccaagtgtgttgacatttcaggaagtcttgaatgttgctaaatgcatctgtgttttctgctgagtggttggcccagactcaaaaaagtgtgcctacacaagataatttccaagtatgatttctaacatcatagaattgtagttgtgcacacatatgtgtatatgcaggtcaatatcgcttagaagcaccttccttttttattaacatcattgttttggaagtttttagttcatttaaattaaaaattattgttttaattatttaaaaaattatgtcccagatatattagctttttgatgttttttcctattttgccaggatgtagaaattatatctttacagttgttgaaatttgattaactcttacatgttatctttaacaaatattatcatgaagactattctctgacaaaaagtatattttgtccatttaattctcctagcttgcaaaatgtacagtattctaatagttatctccctagtaaaggctatgtcaggagagagggcaccttgatattgataacacattttgttttggaaagaagatataaagtcagtgacatacagtgtgagaggcctgtgaatatgaaagtaaaaaggaaataattacttgattgcagacatactgttagttatctctgtcataatctccttttccatttaaaagaaagtattcttactattataggtaatgcattttgccaagcaaaggggatagaagcaggaatcttatataaatccttcctatgcaaacacgtatgtttttcctacaactgaaagaaataactacctttgatagtactagtaatcttttccttttggaattgagttagtgaaagcttccatcataggaaggaagaaaacttctagtagcttattacacattcctgaaaaaaaagacaaaagagcaaaacacaacctaaatatccttttttattaaaagtcagaattagcattgcaaatacaatccagaacttcagagctgtcacttagcatgaaccttttgataaattggatcctgatatttacaaaatctattaaaatacaaccaatagtgtgtttgtttatatgttgacaagatgatatacaccctgaaggtcaagggtgatgtgaactgttatggtgttcttgtcaaagtagctgaaaaaagtggggtggtggctatttaaagagttttgatggaataatggctttaccacaagtgtgacagcaaatgcaaggatcatcttgaaaaagttcagttgatttgaaacaaaaatctgtgatgtttatcaatcaaaaaaaaaaaaaggaaagtctcttcttccttctgtagcatgttagaaagttggcagctcaaatggaaaaacaaatagtgaagttaaacagaaagaaaagcattgatttaacttcttgggtggtttatcaaatgccacacgaacttttcattctgtcttgtcatttattaattaccctcttttaatcaagccagttaaagatcagtttacaaacttttgggttacttctgtgtaaatagttccaacaactcaaagtcactttgtccttttactaaataatcttctctaattgttagccaagttgtacttctttttctctcataaaaactcgaaatttatctgaaaaataaatgtgggatttaaataatgcttttcccagcatgattttattactacatttgagttccttgttctctttttcttaacaatggtaacggccttagttattagagatgttagctcaaaaatgtaacaccgaaaagaatgtgaatgcattaaaggtctgttaagtttttcagtatagatctttattttagtgtttcaaactagcatctagaaaaaaactgagtaaaaactgtatatgttaatttcaaagtaataagtttattttaatgaaaggaattggtacagtatgttaaccaaatatgaattgatataagaagatagatttggatgttagatccccccatctatttagaaaacatttaaattgttatgtattttaaattatagcacacacagaaagctaattttatgggcattttttaatttaatcttaaaaggaactgagctttttaatgtgtctgtcataaaatggtttaattaaatgaaattaagccagaataactgtaaacagacataaaaattattaacctcatatctctaccaatcattttcaatataggatttctgctaaacagtgtgtggtttagctcccaggaattaattctttgagtacatttaaataaattggatcatctcaagttactgctccgaaggcagagatctgcaatagaatgttacctaagacatcagtgttttaagaagctaatcacatcgcaatgcagggacatttaacctgcagtggttgacacattcagcctccacaggcaataaggacaaccagatcttatcaaaacaatgcattaaaaagagcaaaagtattcttaaaaaaaaaacccaagtcactgatccctgtactccttaaataattaaaaacttttgctgaaagcaaattatctctgtggttttcttgacttacaggttcatgatcacctcagaattagcaattattagatggtttacataggccggaaactgtggtgaggtaaacatatatcaaagtattatgaaaacaattaagtgctacacaagtgggaagtgttatcatattaacatgaatgaagctacctttgcctgtgtgcatttaaaacattttatttattctatcagatgaaggtttagaaaccagcaactcagacacaagtagtggaaaatctttaaggcaacattaagacttctgaagttcaccatgctgaaaaagctgaggttgttgcccaaaacaaaaataaaacagaacagaaagacatcattaactgtaagagtgaatgcagacatttctccactcaggtggcttgtgcatgtccaagggctgagctcagctttgtattaaagacctgtggatttaataaaactttagggtgaaccaatttatggttgctatagatgggaagttagtaacacaacattacaacaaccaccctccctccaccccctgcaactccctagcctagagccctctaagccattaaactattactaaagctgattaatcaaccctgactgcttctaaataaaacaaatgatttaagaattaaagtttctgtatcctattatcaaactcattaagtcatctcaaactgctgaattttggatgaatttctaaattcctaagaatgtattcatacacatttattctcccctccccatatttatccatgatacacaaatattaaaataatcagaccaatccgcttggacagtggagatcaacataatcactttaaagttttgttagattgttttgttaactgtcatactgccttgggatattttaaaataattttttattactttttcactcgcactaaagtaaaggaaattaaagtatgaaaattttatttgcagacggtctaagatcttacggtagaaatgaaactttcttgttgggccaactctcactgttctgctagacgtgcatgggttttgcagaggcctctttgaagtgagagtgaccagatttcttgtgagtttcagggaagatttcaattacaaggttatatttcaaccccatccctctctgaagtcagacctttatctccttttggaaatcattccatttacgagttttaagactatgatcatatgactacaatttgaatatattctttggcatgttacatggtgacccaccacttctattttatttctgtcctggtcgttttaatgtgtttatagggttcatgttggccgagaactgctgtgagatatgggacgttattcaccgaacagagcagactgttttgcaaagtagacacccgagaggctaaagtgtttttcactgttattattttcttttattttgtagaaagaatgaaaatataaaaagaaaaaataacttaattagaaactaagtagccagtacatctaagagattacacatatattttagcacatttgactctattttggagccttttgaccaaatttttcttctgaattttaattctcttatttgagaataaggggctggagatgttatttgaattgcttttttaatttgccgatggtggtagaaaaaggtttaatagaggtgattttatgtgtgctgaatttaggcaaaagactgcatgtttcagtgtatttcctctccatttctttctcattttccgtctttactttccatattactttcagcgttctctctctgtctcacccactgctctcctcacttcccagagtctggctggcaatgtgcatgggaaccttagcagctgaggggcatcccaagtttgcattgtggtttggtggcaacaacccacactctgcaaccaagctcttggggctttaattcccagctacatctctttctaactgtataatcttgtgcaagacacttcttctcttcatgcctcagtttcctatatgtgaaataggttaatggatggttgtgaggatgaagtgagataatatatggtgcatccttcagactgtccctgacatgaggtaagcagcagatatgtgtttgctgtcatttcacaatatacccatttctaagttacttgcacatatgtgtggacagtgggatgtggaagagtaaactggaacatgaaattgggagttgagaattccaagacctgaatctgattctgctgtgagtcagtgtgcaaggtgactgcaaatcactattggtgtcttgggatcatcaaattttaggatttaaaaattttcatattaccctggcattttacttatggatgagcaagtcaggaagtccttagagcttaaaattactcaccctctagcacacattgctagggcagagccggccttggaagccagtgcagtgtcttgcttcttaagccagtgtttcccaaagtgtggtaagttgttgtatttaaaaccatccttctgagcaaactaacacaagaacagaaaaccaacactgcatgttctcactcgtaagtgggagttgaacaatgagaacacatggacacagggaggggaacatcacacacccgggcctgtcagggggtggggggctaagggaaggatagcattaggagaaatacctgatgtagatgatgggttgatgggtgcagcaaacccgcatggcatgtgtatacctatgtaacagacctgcacgttctgcatatgtatctcagaatttaaagtataataaaaatagaaaaaaataattttaggtgatacacagaaaagtgttcttaatatacctggcacatcaaacccacagttttacaaataatattgcttatgatgaggctaagtacgaggaacaaactgatttcaagtcattttaagaatattaagtatgtgatggtatgggtggtataaagatacagcaaaaaccacgaatgctgatgctgaagtatgggaaatcctgcctactctgggttcacccccgcacctttcaaatactgatataggccaggattatgtgacagcccacatggttttccatgatgtaagaatttttctgtttcactcatgatttcttgcccaaagaaaagaaacttaggcctggggagttttccctgttctaacgactttaaaaaacaagcacatgagtgaatattggtaaataatatgacttatgataccaaaacataggaatccatgttctggaatcctaaatgcaaaaggaagcagtagttgttggcaattgtaccaagctaagagaagtgtgaaacatactttagagggaaaagacagatatgaaaaccaaaatgtcaggaatggttctgatagcaggttatctaatcacatgcatatgagcatttactcatttgctttcagcagagattattaagcacctatataatctctgctctttatcagtgtgtacacaaaggtaaaacctatttcacacagcaactatatttttgaaacattataatttgaatttgctttattcaagtcatactttagggatttgggaaagttgaatgttttcaggaaaactagtaaagttttttgtcaaacaaaattattcctttatctctttggtaaatttggatttttatatatcacatctgtaaaaagcaaagcaaacataatcatagaattttcaatatttggacacattagatgccaagtgtttggttttgtttcagttgtttgctgtttctttttgaaggcatagaaagaagctattggaaatgtcacctggtctaaggagagaagcagcagggcccttccttagccttgttaagcaccatgtttcctgcgccttccgtttaaagtacatgatatggttttgctctgtgtcctcgcccaaatctcatcttgaactgtaatcctcacgtgtcgagggagtgagatgattgaatcatgggggtggttcccccatgctgttctcctgatagtgagttctcatgagatctaatggttttataagcgtctggcatttcccctgctggcacttttctctcctgcctccttgtgaaaaaagtacttgcttcccctttgccttctgccatgattctaagtttcctgaggcttctcctaccatgcggaactgtgagtcaatcaaacctctttcctttataaattacccagtcttttgtatttctttatagcagcgtgaaaacagactaatatagtacactagttcagtttttaaatgaatgaaaattctaatattaaattagcagttctttgacaagaaaaagaatttattatttcttaaagtagaggtctaaactggctgaagtgagctttaaagtatactatagaatctcttggtggattccgtattaggcatatgttcttgtttaggtagtctgtgaaatgatcttctcatggaaacattcagaagagatgcacctaatagtttatggatgatattcagtgaaaattagattttgtatctgtttttttgggagttgtgtgtgtgtgtgtattttagcatatggatggtgtggtccatagattctttgttgttcttgaaagggtctttagagaatcattactggtatatgctgaaccagtcctcagggatgcaggtgtcactcactgtgtgtggcctgtgctggaccctggtgactttatttctatagggtcactgcatctactgttttgattcctttgacttatccaaccaatttttaaaatgtgaagatttggggaccttgggtttattacaggtacagaattgaattgaaagatatcagagattctggaatcaagatgtggttggagaggagcatgagggatggggtgggtgatgtgggagtacgacctggaaggaggaaggatgggtggtaaaaaggatgctgcaggaagggcttctgtttgatataaatgtttttatgatttgtttgtagaaaagatgctgacacacttgtaacccttatttcaaagggcagcaaatcttgcacttgatttttctgtgtaaatgaactgtgtaattggtaatagtttatatcaaaccattcaaaaattttctaagcactgttgcaagctcgtagacttcccaagtgatatcataataatatcataattaccgcggcttatgaaaaaaatgggttaagttctaagatgtagtaacatctttaatctgaaatatctgcgcttggccaaatcagctttcctgtattttctttcacaaaacatttggtcccaattgtagttttctttctttcagaaaaaaaaaaaaggtcagaaaaagttcaaaatgacatgatggaatatatatttgtttggaaaaatgatctggttattgccatggcagctatattaaatttttagggttatgtgatatagtttttatattaataccatctttgaaatttatttacatgatgtaacagctctgatggttacattacatctttgaaagcaaaaatgtacaaactagccaagatttatgcagcttctcagcagggcaaaattattcactttaaagggaaaaaaagatatttgttggattttaattataccatttagatgttgacatgtattaaatttattacaaaagaaatgcaaagatgacttacagaaaaacaaattcttacctaataaaaaatggcacatatcttgataggctatgaatttttgctttccgatgaaattgttacaaagtaaatgtctgaaaaacaggtttcatgaataagacagaatctttacattcagtctttcttctggtgcataggattgttttatgtgtttactcttgctgagacttaggcttgtaaatggcttactaataaacagaaggcaagttgttaattcttaaattttaattataggtattattatttttaaagttgtttacaggctattctttcatcaggcgtgtcccccttttaaattgaacctcagattctaagttaaaattttttttataaagtcaattattttttagagttaattctgataatttttacaagggtgattatagaaattaaatagagaaaagtataagccatgtgcaatttatcatgattatacttccttggttttataaacccagttttgagaaattatatcccaactcaacattattttataaaataaatatatcaaattctgattgttttgaggatatgggagtaatattatttcctccctttaaaatattattttaacttaaaaagaaatatgatgtgctgcaatgagatagatctgaaatgatttagaaattttgaagaaaattttcaagtttgaatttgcctgaattaacatattaaacattatttaatatcttggcatttatgtaattaattcattatataattaaagcaattgtataggaatttttcagaattttttatgatttgtgaaaggggatcactgagctacagaaaaaaaggtttttatttttctagaaattctcttttgtaattgtatgtcaggcactatttgcagcccttgatatgtcatatttcttttattttttgcttactctatagagttattattctcttcttatacacaagaatgagcttggagaaattaagtaacttatctgaagtcacccagctgagacttgattcctgctctgcccagttccacttaatacacaatacccaagggcccaaaattctgtcatttcttctgtatttagctatgcctagtttttcagaaatattgaagtagaaggaaatttgttttggaaagggaaattaaaacccaccaatagaaaataatgataatggtactgtttgagcacttagtgtgtgtcaggctcttcacatggacaatctcattttatcctcacagaaactctgtaatatgtcatcttacaaatgacttaagtgttttgctgaatctcagattcagaaccaggctgattcactccatgaccatgcctccttttcatttaaatctaaatgcacagcttaaacatttgcataactgaattcacttttaattatgtggacttttagaaaatacatctttttaacagtttattcttgactcaacggctcggaaggcataaattatgattaaatttgcctaggtctaataaaagattgcgacttaggttatcccacctccctcttactgggtattgaaatttttttatatacttgaaatggttgcattttgactcttatccttctgggttccaacagtcaagtacttatattaagacatatttacatagtcatcaattcatagggtcatggaaatgggctggagaatcccaaagatcatcttatttaaagcccatgcaatggagcacatggagattcaagttcagtgacttagtaggtcatacagttaatactgccagagtaagaagtagaacataggattcctcatctgtagctcatctagcaactaattaactagggaatatgagggggtaagccagaggaagattaacaatgcctaatttatacaaaatttacagctcacaaaggaaatgattctattgaatgagctaatttaatgtgattatatgttttctttttaaaaagtaggaaaaatggtggcatcataggatttgatcaaagctgacagggaatgctttggtgtcttaataaccattgactcactaaatccagcaatagacagtgctaaatgttcacaaagctgaaatattgagcagcccagtgtaatctggcccacacacatgatttctaacctaaaaatatctgtcttatgaaataaaccaaccaaaggattctatttcagtttgcttttctagcgatcctgaaaatgtggtcagggatttaggtaaaaccagtatatcacaacacaattgcaatcaaattcaaaatgaaagcacagtgaagaccaaaaaaaaaaaaaaaaaaaaaaaaacaaacaaaccaaagcaaaacaaaacaaaaaaaaactcaggatttctagctcaggaaaggaggaaatgagagtgagatcacgtacttcagagaccgaagaaacccatcaacctttgaagagaacctcctcgaaagtacattaaacatcccaaggactctaactcagtcacggatgttctcatttccatttctccagtcagtactatccttttatctgaaagtatgggatttggcagtagtttttaaagtgtgtgtgtgtgtgtgtgtgtgtgtgtgtatgtgggtgtgtgtatacacacctcctttgagaatctaataaaaactatgaaccttcttcccagaaggttactcatatgcacacacaccattttcttgtggtttcaaggtgtttgtagccctgcctgaagcttctctatagacccgacgtaagagatttcatccattatttcctttcagcccacagatgcttcctgtggaaagaagggaatcaatcccacgtcctgtctagaatttaggaagcctacaggttataacaatgtgtaactaggtgccttcttttctttggggtctgatgtgagccataacctctgcaaaacaaaggatcggcaaaccttgtgtcccagacattcaagttgacgggatctcttggttagatttcctgggaaccaaaccttacgacgcaaatgcccatccagaaacacagggcgtctctctgggagacagcatggtgtcccagtgctggctgcacacttgccagcctcccacccagctgtgtgaaaggagctttattagccagcccaaaccaggcttgtttggagtcctgggccacttccattttctgaggctcttgatatattgaaaaatgaaaaaaatgccaaaatagggttacaaaaacagtggtatactttaaatgtttacctttaacaacttaatgcttttaataccagaaacatagaactgtgctattcataagttaattacaggatttataaaaatgttaatttatggtttgctacaggcagtgtggtccagtcaggggatccaatttagagttgtgcaaagaaggcctccttctttcaatcctgtcagtctatctctgtgattgtatgcataacctcatctggaaatggcttcaaaggtctaaatttgaggctctttatgaaagtggagctgagtggccctgctagcaccccctggagaggacttgcagaaagctcttctgaggaggagctggggttgcccgtgtcaccagaatccctcgccttctcctttgagtctcaccctcctcagggagcctgtgctcctgtactaggacagcttcccctagagctctatgaggactaacacagccatctatgcaatgggaaggatcctgggaatggccagctgctctcccccatagtggatgacttcagcccttactacacattttcgaattcctttaaaaggtcattgcctcctttcaaacttcacttaaggataaagatcaaagtgcaaatattcttttcaagagtagctccttgacccaccttcacaactaggtataaattacagctaccaggatccttatgagaggagaactggggcctgaagagaagcactgaggcatgaatggggtggggggatggtttgaggagtcagtgaaagggaagactagggatggtagcagtagtcctcagcgtgggacagttttagggattggaatgggaggagaaccaacacttggagagagagaggtacatgctaggcctctccattgggtgaagtctttatcctgctgctttgtagcagcctcaactctgcagacacttttggacatttttaaaggaaatgttcattttaaccatttaggcaaggcatacttttgaaagcaacattgtatcccatagaattctcccagggcatactcaactctgccttagctgttttggctcactcacagagcagagagacatggcccggcccttaatgcttgggtacctggcaggcgtcgtatccttttatctatatccatctgactgtccatctcttcatccagctacccatccaagcagccatccatccaaacaaccaaccaactgacagacattcccaacacaaggcactatatgccaagcaccatgctaatgcctagggataccatggcaaacaagacagattttatccttgccctcattgaggttatatccttgcatgcttgtttaatgctgccttttaaatccagcattggtttaaatgattagctttgcctctctttaagtcctgaggtcctttttgcaaaattgtaatggattaccttttccacatgtaggaatcccattctagacaacaaatatccaaaggttggatgggaaaatctacagatttggtaccagataagatgtcttatgatttgttttacatgtctctcacctatggcactgtaaattacttgagggcagggagtgggtcttaggtttttaatgctctgcaccaagcacagtggctggcacacagtagctgcttactaaatttttgttgaaagaatgctgtctgggaagtcagaggtctaaattcaagactcatcgttactgtcatcaccctctatccttggtgcctcatctcttggatcttgatggggaggaaacctatggcaagtaaatgtctttgatgtaggccagtagtggctcttacatactccctttcttgagcaccctgagtctgaggggtggcttcatctcttgcatagttgtctgatccagggcaggacagtgtaaactgggaactgagtgcatgctcagcactgtcccaacgtgacataaggaaatgtcttctcaattatttaagatctaaaaatatgttttctgtccttgacagacggccacttttcccttaataaagcatgtctgacaatcacactttgttggtgtggttaggaaaagaatgtcgtagacttaggaaaacataataatttaaagagtgacacatttcagcaaagaaataaagctgttgcctgctctgaaaagaagtaaaaccataggaaaccattacttcattgggacaaacattctgtgtctttagaaagttctcactaaaaaaaagcgggtgagctctagggcatagtgtgtgtctgcgcatgtatagaagtagtctgtctattttttagagatgttccctttacaaacatttcccacttaatactttgtaagtatttaatacgattgctgtctaacatagcagtttgcacctaggctttggtccaagctgcttcttggaaatcatatttttcagtagctaccaggctgaggtgtagtcagtaactgaggtatagtcaggtttcagcaaggtctatttggtattgtacccactagactatataaaccaaaatttctgctacaataaagagttaaatagtactccataagacgtgttgcacgaggcatatggagatttcaagtgtgcatcgcagtgtgagcattaacttaaatgtgtcattttatagttctctagtgcagaactatttggtgtacgattgtatgtaacatgcaaatcccatcagttcacactactattatttgtaggattattttaacaaaataatagttccatttcctgtttggtataaaactaaggctttatttttaaaagtggaggaagatgttaatacaaatttctctgtggtttattttccaaaattgatactttctcatatgtagcatgttgttgttgttgttgtttccaaaatccatctttcactgacacgacaagggatgctgagtagctcttcacatttgctagccacagtctgagattatttgcaaggcaggattctctgatgccaagggctgaggtctagtttactgatccccttccatctcagcaaaagtgtatatgagagagaagagagagaaaagccagaataggagggaagctggaaactgtggtgcttactcgttcatctcaggatatggatacaaacgtggtaataatgaaagctgccctttgtttacaatacacacagtttgtggcagcaatctttataagcccccaaatggcacttaataaataaaagaagatacaggttttcttgattagttagatataaatgtttactcaagctttcatgagagttttctttatttttacagagctctctctgctcaaatgaacgcgtgaacgaatgtctgtttttttaatgtgaactcactatatacaaaataagttttcgcaggatccaaattcatttcatttgtaaattatttaatagatgtcaagaattcttgttgactgctttaattaaagatagatttttaaagactggatttaagcaatttttaaatgggtagattgtgtcaaagaattttgcagtctgtgaaatacattaacactgatactaaaaagagagagagagagagagagagagagagaaaacgaacaagaaactgctccatgcaaatatttccaaggttgttcttagcaatgtagggttaccatttttttcctttttagtgttgatgttgtgtggacactggagacagttgtgcactgtggatattattgctgcaacggagaagagggaaaaagataggtttgtagcagggcctgtggatggcaccaagccagtgccgtgaaaaatggcaaacatgtcacagctaacagctggatgcagaaatatttctctttaatttggatggataaaatttttttcacagcagggcactctcaaaagagtacaacatcaaagagggcgggtctcaccagtcagacatcagctggctccaggatggagcaaaatgaatgaactgtcaggacttttccagcatatatgcttttgccaagtgaaaagttaaaggttcagtggcttgttcagatcacagacagaatcctgataatggaagcctgattccccaaagtcttcctctgatcaacagacagagcatgcctgaagaagactccagaatgatggatggcaggcttcatatcgacggctgccgccgccttcagagataagtggaattcaccaaatgctcaacagttctcaggagtgcctgagtccccatgtcataatcctcagagtcaccgactctcctctgctaacttgacacttagcagtagctgacccacagtgtgaccaaaatacccatttccatttcttcacatggccggctctctgatgaaggctttgcaaacaacaccacaggtgttttacagttcattgacacttttcaactgtttttctgattaccatatttcagtcttgacttatatgttagtattatctgcacactcaacataaacctctaatgattttctaatatttctggaacttgatgaatgtgaattgacaaagtacagtatatagctttatatcagcattactgaaaatacagcaatggtgtatataaccattactcacttattttatggggtatttattacttgacctttgaagccacattttagaatcttggcattcgagacattccaaaatattccagaccaaagtgaaaggaaaggatttccttattagaaacaacaacaaagtaagttaattgtaataggtggaggagggagaaactattaaaatgaaaaaatgtataatatatatttgagaaaaaataaaaagctgaacacacataatatgggcacactagtcggtgtttaatgaagaagctttattgtaaaatatgcatattcacggtcttatgcattgtctttttttttttaatgttgctggtcattatgacacattgcgataagcagaaatggggatttgtgtctttatccattgcatgattgctagttgtttacattttaataacattaattctcactaaattgacatttgttctaaaaatagaaatttgattgataaagaactttattaatcattatgaatgtttttatgaccctcatttggagaatttcagttagttttaaaggaagagctctacatttctctctgatagggcaaataggatgtgatgaaaaaagcaataacatggtggcctatgattcacatttcccaaccatataactgagagcaaatcatttcatctttctcagcccaaggcttattacctgtaaaacagaataatattctcagcttctcttgcaggtcagttatacagataaataagtctgtaaaagtattttataaactcaaatgccacacgaatatgtatgacttggtcattaactgatgttctttgcttgtgtgaaggtggaggcagatgctttcacttattttgaaagtttcattttgtgatctttcttctcaagccttgatttagctttatttgaaagtttaaaaccagaaaggttagtaggccacactgttgtggtatttgctgttttcctctctagactggggagcagtgctggatctctgtggatctgaggctccaggctgaaatccacaaatgtcccgggctttgcatccaggtacatgtgactgcacagacagctcacctaccttgaacatattgagtgttcatgcaggaatatggcactgtaagttggggctccctctggtcaaaaatgtcagtgacttcagagatcaagcaatcctatatggtaggtgatgttcagtgagagatattgggatattggggttctaaagccacagctaattaaaacatttgtacttgttaatttcaagcatgctccagaaatgttctcaaaggtatagtgggtgcctatgtcttttgcatgacaagcgacactgcaatgaactaaaaactgattaactttaggaaagtgtggagttgaagaaatgcttccttaccgttttctgaacagtatttacattcatataccatttcttattttgacatagtttgctttattttaaaaatagattcatctgggagataaaatataaactattaacacgtcaactgttttactcctgtattcccttgatgtcattccaaatctttttcttctttctcttttctttttcaacaaaagttgatttcctggtgtgtacaaaaccctgtgtaaggtacctatcagtaaattacaaaatgattaaaatgcactcctgccctcagtgagtttatgctctggtaaccttagaaatagtttatttgcatatgctgcgcataatatattgtggccagtgtccgtgagcaagttagtagattatgtctagactgacgtttctcatctaataatagtgttggtctaaggctggctatgttctttgagctcttactagatgtccagcattgttttcagtcctttacatatactcacttatttggtttttatatcagctctttgaggtagggattattattagcaccatttttttttctcagaaaaagaaagtctcagtttccttaagaggttaaataactgaccaaaatcacgtcatcacaattgtaactcacatgcattgaaactgacacccacatgcaagctcttaacctctgtactctacaccctatggtcgcccttaaccatagtggtttatatcgtgtgttttcactgagaatacttaagaaggtctcctttaacaaccaccgttcaccttttaaaaatcttttatttagcaataaaagaaatctggttactaatttttcatagtcaaaacagccaagaatcatttttttgagtaaatggttgtagagctgtcttatggactacaaaatactgggcctctacctcctgacacgcagaggaattgtgtagtaaaacatatttatctatgttggcaaacagtatgctttcttaaatttctaatacacttgactattggaaccccaattttctgaattttatagaaggatggggctgtgtaaaggcactgtgtaaataggtagaggatatctgagaaacggtgtctttttatctggtcttccctggatactccatgagctgtgaaaggattgtaaacagcgctgggttcacaggtctaaactggaaatctccaacgaccttttctgggccctttctgtggtaattgtttattccattttaaatcatcatatgaaattcacctttgtatttcatagagttgaaagagattggcttcaaaaagcatgtaatattttttaatcctagttgttaatacttagaatcaaggtttaattgcgtttagtggtaatttcttcttaagctttgagtaaaatccaagatctttaagaaaatacagaattattgtgagaattcaattacttcggcatgcattgggttccttctatgtgctgggccctgtattagatgtatgggcataaaatatgcttcctcacctcagctgcttggcgaaaactggaggctggcacttcaacacacaaccaaatgccagtatctggagccttggcacagggatatgccagggttgggagcatgggagagggcgtctgaaatgtctcctcactccctgaaaactggctaatcccttttatatgaaaccttcggatcccacttccccctccccatgctgaaatccagggaacccgttcggggaggagcagattcatgattaagttgtaattcaagttccttttgtctgaggtcattagctctcttcaggatatttacaggactgaatgaggtgaggaaggcctcagcacactcccagatggggaggcagagaagtggagagaaggtgagaaggcctggtgatgagttctggttctgtcatggactagtcgtctcactttgcttagactactaacttttgtagacgccatttccttctgtataaatggatggggttggaacagatggtctctgaggtcccttccaaatctgattttcctgggctctaaatttagccacagtgctcggcattctggcagaagagttggtgactgagtttttcatggaggccttatctactggaggaaatgtgctgcctgtgctttttcacacagggtcccccagctcaccttgggcccctagaggtgtcctgggaactgtctcagagagtcatagtggggttagttgtgctggtgaggtgctctcatcaacccctcattttttaaccagggcaaatttcatctgtttttatagtggaattacatttaagacgtccttgaattaaaggggatccttcacttaaaaagatctttgaaagcctgtgctggtaaaaatggagggaaattaaaaaaaaaaacagaaaaaaacaatactctgtactccccttcactggaaaactacaggacagaaagcttggatcttgggtcagatgatggcatctgggaagcacaggagtgatgaatgtttgcagtgtttctaggctgtcacttcaaacagttttctttgaaagtgcccccagctgtaatggactgattttcagtggtggcaggaattcccttacagctgggcttacaaatgtaaatgtctaatgaggccaagcaggtaagtaaattagtgaagtaagtagcatgtaagacagtagagaggtagagactgcagaactggaaaagctcaagcccagtctaaagggagccatcttttcttatcttaaggggatcactgccagagatcgaggacccatcttttgatttttcagaagttagaaatctcaactagataaaattaaaaaaatttttaaacattgttcaggaaaaacaaggttggtctattgcttgaatttagcctgagagccactagtttgcaaaggagaaacactttgctcagagccaccaatacacacaattcctatcatttggaagatggtattatgcttatgttaaaacgagcttagatcagtcactggcttacaccatttctatgattattgttgttatcataagctggcagccttggtaaatgacaaagcagtggacaagccactcacagacagttgttgtaacgtgcaaccctggtgcataatttactcctgctgctctcatttaaagctagattttgtgcaaggaaaataagagcatgggagagagtggcacttcctaatatccaggatcacaatacaactcctttcttgtggtagctttcggttaatgccatgcatgatttgtaatgagtgagaaattgtgtgatcattatttcaaccatatgtgtgatgtcccaataaatagaattagattcaatactgttaaaatccgcttaaacaggtaagaattaggtctccctttttcttatatttctactcctattgataaaagagaaagaacagaccaaaagcaatggtttgaaaatagcagcaacaacaatcacaaaagaaatcagaggctgatagtatagtgatatgtattacaaatattttcccaagaggataacagatagtttttaacattaggtaacatagcttctctgttttaacaatgcatgcaaaaactgaactacaaaaaaaaaaaaaaaaagggctaggttttcttttcatttatttttttctctgatgttttttgaaatcagttaagagactcttgctatactttaggtgagaaaaaacatcttatttgggctaaaatggttaacagtggagagaatgacataaatgcacttgaaaagtacgtagaagacaaattcaactggatttgatgatggctaggctctgggggctgagggagaaagcagtatcaaggttgaatgagtttgttcaactctgggtatgtagtcgtggggtttaagtaggtgcatgggatttgcgtcacagtttcatgtgaaatattataatgttagtattagctaaagccaggaaaaccaaacctcatgccatgtgctacattgtgtgatatttgggaaaagcctgacaaatagccttttacttttcctcaaggcaagtagcagtttatatcaggcaggcaaaaattgtagatttccttgtagtcacgatatacttagttaagattactgctgaaacaagagtgtagggggaaacacttttcatactaattttcaaggtggactggttagtggctggtgatcaaatgagccaacggttaagacagcccccactagttagacatgttagaggattttacttgctgttgaagatagtggcttcatgcacaaaggaggattgttgtgtgcacttctcaaaatgcttcataataattttcaccagcagtccctgtggaaggtttattcttgagggaagggagggtagggggctgggtcatcaacatttcttactccatcaaagattaacagtggcattaagggaaccaaatggctttggtcaatgttgcaattttgaagaaactggttaagattaaaaatttcaactctgaggctgtcaacaacagtttcagagttgaaattttgaatcttaactagtttttttagaaaaacaaaaacaaaaacaaaaccccacaacaacaaaaacagaaacaactacagtgtaatcaatcctaaatatgttgtctatcattagattgttcatgtagcagatgtagccaccccatgcaatgtttccattttttgccattatccaaaacctagaaatttaaagaagtcattagccttaaataaatataatccaagaatctcttcactctgctcaagctaaattgattatcagctgtgatcaccctggtgtgtttacccagtcataacttctcaattgtttttaacagattaatgtttgaatttcattgtggggttagtggaaaggttggggttggagaggaatgagttcaagaaaagcaaaaaataaaataaaataaaataaataaagtaaaaaaaaactcagctgtttttaaatgactagtaaaaagaaactgtcatcactaagcccgtttgcaccccctcccccggaatagaactgctgagctaaactaatatgaatgaccatactaattttggagcctaaatgtaaccagtgaggctctctctaacacttattttccatgcttatttgaaaaggaaaattggaagggcggactagcaagagtgagagacacgatttgtcaggatgctctggagaagtagctaccagcagaaggatcccactgctgattttatctgaaaaggtgcagtgtatgatggtccttctgagaaccatacccttaggaaattctttaactgtccctgcttcctggatggccccaggactgggagtgactttctagaattgctgtggatacatgaccgcctcatctcccactcctctagataccatgtctccctaagtgccctgaatctgaagtcgtttctggaaaggcaagctgttgcctctgctgttggcactgactctgtgtttgcttggctccctagttgctttcacaagactttttgtctcatgcttattgagtggtttgaagcagatttcattttctcaaatgctatcttgaaaggaaatctgcttgaattgatgtgaggcagtaacaattagacaactcggttaagaaatgtaggattcataggagacagccattttttttctttccttttttgagggtctctcttttttttttttttttttttttaatgactcctctcctactagtttcaggtcctgaaaactgaagccctacatcttctttgaggtgagagtccatttatttcacccaaatcagagtctgttttgccagttctttacggctccataactctccaactgccttctgctgggtgtcgcccagcctgttgaacagacagttactgcctcccgaatgcctctgggcagttgtgtgtttgagactggggggcctcgaatgtggatgttccaacaatgtcagtgcggcctctcctttcagcttgctttgtttatccagcagctcattatttaagactagcctgtcaaaataagttaaatattctttgggaaatatggtcacatccgtgagataccacaaatatgtttaatacagagaagattggcttgataagaaaaacatgatcgacttgcatcatcaaaacatattttcctgttattccggttgagttgtccacaagcatcaataagcactagcaaacctaagggcaataaatttctgcagctgacacataaagacaccaagggaagtagggaaaatgattgctgatgattcgttctaactacttgaccttctgacctcttctccagatatatgaccaggatgggacactacagcactttattgatggtggggaacctagtaagtcgagctggatgaggtatatccgatgtgcaaggcactgcggagaacagaatctaacagtagttcagtacaggtaaagtatatcttgatttaccacctacagagctgaagccatttggcttgcatatacaaattcaggcttgccactggtgggtaaaaaaaatcctgcagaactctgcaaggactggcagacattttttttttttgctaggtttctgaaacctccttagttcctatgacagtaagagcattcatgaacatttaggattaaaagtgctcgtagatggcctccttcactccgtgcacatggtgaagttactcccacatcattagaacttccagaatggtctgaatgagcccagcaaacccactgacttggggtgcttttcccaagcagtcgtcttcacacagataagtagaaggtcagagattcagcctcaggtctcttgctttcagtctccttcatgctgtctcctttgaggaatagctttatttgcacaacagcatgggaaaccaagaactcgctaccttcccaaggatacctttccaaaaccgttagacttagtggcagtgacagagccagggtaactctcctgctccgtctaaaggtggcagtgggtttggccctttgatgattcaggatttgtttcagttgatgaggcagtttccgggcatagagaagcccctggtttcctgaaaggtatgggcaaaacacagaggataacaaaggcagggtggagccatccccatttcccttagggggtccacatagggaggcctctggggagctgagaagcagggtggattccccggacactcagccagttcttctcagtgcacctgctggtgaagcatttccacttagtgctaaggaaggctggagtggagatgagagggcaaaaacaaatcaaataggaaaaaagccccaccactaagccttcttctctcaaaatccctcgaaaacgtgtgctatataaatatatgacctcagttataaacagccgtgttctctttagaatcagaagcaactgtttagctttattaggcaccacagacacatcaaagcagagggctctgtgctcagcaacttggagtcctgcctatggctatttattttcctttcctttttttttttttttaaacgaagcttaagttttttctttttaactttcttccccttgttggttaaaggctgcacaaatttggcttgctctctgaggtcttcaattaaaaaaaatgtgggcagtatgtgactcaccgccttggttttcagtgcagttttatttcattaaataacagtttaaatgaagtagcacaagacagtatttcattacactgctgtatgtgggctttattcacctttattacagctgcatttctgttgtgaggttttttataaaactctgagctagaaaattagtgaagattgtacttgtccacttagtaagagatagtttggttctgtaatgggtacccagggagctatagaggcaaattctgaatttgggaaaacaagaaccccctaagaggaaggtgggcacgggtaagtcattgcctatctgtcaatattaagtgggttttttacaactccccctttcatgacggcgcttacactatgagctctctctgccgatctgttttcgattacttcagatctttacaaaatgaaatacaaaagcccaattttaaaaactggcattcatcaccagtgaccacgtccaagagtaagaaaatagaaaagttggaccctgaagagccaggctaatttttattgtacatgaatgtcctcttcacaaaaagtcagctggtttaaattcattctgttatgatttgtaatatctaaatggaattttcttcaaagcacacttgattgattgacccttagctgaacgttttgtttttattttgaggctgacaataatgtttattggcatgtgttccacttcaactgcgttgggacgccatgaagctatctttatgagtcatccaaccacaatactaaatacatgtcagcaaaggaaatattatctgaaaagggaaaaatccctttgatgtgcttcaacatgcagagatttctgcgagttttggaagctctgcccacttgtaaggaatggtgtacgcttacacatttttttccgcctttcggcctattcggtgcctcagaagaccacccattgctcgaaaacagttctgctctttcagcagcaaagtgtgtcatttggttttagcacattcatttgctgggcgcagtgtttatattaagggaagccaaaccgagagatgaaatgttgcaagggtgaagtacaaagtagactcaatttttctcaagttagaagatgccagtgatttatagctcagctccaattttgatttttttatgtagcagtggaaagaattaataaaatgcagagctcttggagatgcagagggaggaagggtagcaagagctaggcaactggctggagtttttgtcagatattcatagaatgttgggaaaaacattctgcttagctagcagtgccctcatgagacagaatggcagcaagtaaggaaaataacaagataaatgaaatttttgcagctgcaagtacaatattgagaatctgcacttttttattgatctttatgatcctattgccaagagccactttgtggtgacaaaatatgttgacaagtgcatatctcactgccatgaaaaatgtggagaagcattcgccttatgtctgcagtgttatacaaggaacaaattgccctgctacagccaattccttacagaaaggagaaatttaaggcccaccaaccctacacacttttatcttgaacttgaggttcatatttgtaatagcagttcttcattgagaaaaccagtctcagtctcctcatttttttaatctgtaggttttttttttacagtaccaaagctattataaaaaatgttcatttttcagtaccttcactgtatcgtttcagagtgtaatctttcagccagagtaaagtgctcctcttgtatttattgaatttccatccatttcacatcagagggtttttctcttctcctgtatcaaactttagaagagcagtggagaagatttttatttccctgagtccttatatcacaaagctgcttaattttattacaaattttggaattcccaatgccaagttgcaataatacatttaatgcttttccttcaaataagaaatcaatagtatttatatatgaggttggggcaccagtgtctttgcaattttccaggagggaattttctcattagtgtgagatgaaatttttttaaaattaattcttcctttctgatgtctcctgggctaaatatctgtctcttcagccagttcattctagggagggtcattgtggaaataaattgaatgctgtttatcacactgagttacagactctaattggttgctggggacaatcagttggatgtaaatttattacaaacagaaactgtttagatggagctgcgtagaactttttcagggcaataaaaatatggatgggggcacatgagtcctatgtattactaagctgggttttcttttgttttgaataggtcgaatatattctaccgagcctgtatagatatccctaggggcaccgagcttctggtgtggtacaatgacagctatacgtctttctttgggatccccttacaatgcattgcccaggatgaaaactgtaagaatttattttagctctgaattcacatttcaatatacctatttcaaagctaactttttaagagctttttttgaaactcatgaaacgtggttcactgtaataagtaacacaaacatatacaagtctattccatcgttttcttttccctgcatgtcatctgctttctctagggcatcttaacctgtatgggccagtccttcacttatcaacaacttcaaagcctttgccagaattttaaataatagttgaagcaagttaagtcagctggtattcactgagtacctactatgtgtctggttctatgcttgccaccttagggattacaagagcagtgtaagattcaccttctgctctgaagggatgtacagtcctgtgggagccacactgtatgcaaaaatgaagtaataagaaagcaatgacatttaatcaggggtaacacccctttagttgattgggtgtgcttcctcctacatagtcatttgcatgagaaataatatttaaaatggtagatatgtgactgaggaatttgtgtctttctaaattttttgtctaaaaccatgtctggaaacatgtaattttctcctatctttattaccgtgccaaccattatctttaaaagaattaacatctaggcaaatgtgaacttgcagcaactttcatgtaaactttatatttctgctctatcagttatttgaaaagtattttaaagtgatttcgtatttggaacagaattaggttattctgatatgcttcagtgagaaacactggtttcagtgatattgtgttttcttgtcaccacattgactaatttgtgagctgatagtttgatgttatgctacaaaaagaaacaaagataacagatatcttttgataatggataagaaacttcattttgaaaaaagtgggtttttaaaattttcttctccactttctaacacatgcactcacacaaaaactgcaatttaaaaacgctcatattatgactgatcaaaatgctgatcgtcagatatttctttcccattttgtctttaatttctttgtaaaaagaaaaatcgtcaaaaagcctattactatcaactttccttttctattttaccctaaccccaaaaccaatctcaaatcaaaaaataaatctttgcacatacagtacattcctctgattttgcaagcttccactggaaagtttcttttctgcagccatattcctgtttgagggagttcctgttttcataggagaaaatctcagtgttggccatgagtatgcagtgagaggcaaatgtagacatagaagccactgtgctctgcctcaaacagaatgactccatgccccatgcccccaaaactagatctttatctatgcacagaaaggtgtcagcatcagccagcctccccatctactaacatgtacttgtctgtaggttggaaccttgatgtaaccatctagagtgtttgatccaaaaggattctagaaatctcacgagatcctctgtttcttcttttactacaacctgctacagactctgaagctgttgttgtggtgtgtgtgttgagggatgtctagagtaaacaacatatcaaggccaaacatttattcattcattgttcagatgtgtaaggaacacctaccatgagccagtgtctttgctgggtgatataaatacagcagtgaacaaaatggaaagaatccctgccctcatggagcttacattttaatggggggagacagattatcaacagatatataagtgaataaatagttggtcagatggtgataagtgttgtgggctaataaagcagaaaaggggtaaagaggtgccaggagttgggagttacagtttcagagagtgaacagggtaagcttcactgggaaggtggcctttgggcaaagacttaagatggtgaaggaacaagccatgtgttagtaggtagaagagcattcctggcagccagacagttataagtcccaagatgggaatgttcctggcatgttggaagagcatcacagaggtcagcatgggtgcggctgagtgagtgaggtgaagaggggttaacttagatgtgggtgcgtgctagggcagggaagaccttgtagggccctagaggccattgtcaggaccctggctctaactctgtgtgagctaggcaaagggagctgttgtagggttttgagaaaaagaactatttgactgaatttttttcaggaataatccctgagtggagactggacagtagactggacagggggaagagcagggaatccagctagaggctcttgcagaaatccaggggagagatgatggtggtttggactagtatggaagtggtggaggtggtgagaagtagttggattctggatatgttttaaaagtaaatccaacagcattttctgacacattagatgctgagtgagaaagaggagtcagggatgactttgaggcctttggcctgaggagctggaaggatggcatgaccacttactaagctctgagccagaaatggaaactgtggagtgaccacttaggaaatgcatttcttaccctcgatctggatctctggcgtgggagactcatatccacatggtgcttccacctgacaatgctgtcacacggacaggaggcattgaggggttggagtagagcatttttgggtctctgtgccattcacagccacctgaaaatgggtgtctaagagcataccactggccttcagatttggtgccaccgtgccaaaaatgtactttctggaaaaaacataccagtttgcttttcagttcttctttctgctagtgtctaacctgagtgaagcattcttgagattgatgattagagtattgaataaactctaccaggatatatgatatatcatttagcacctgaagtccttgaaagaaaatttgcaaagctacaacagcttgaagtattgtagactcagtaggaaaactaagtagttcttttgggttccgttcagagctctaagtaagggttgagggaagtttaaaaggaattaagccattgactaaagtgctcaacagtgacaatcccctttcccccaagggtattataggaattttatttcagttcctgtctcagagtcatatatctgtcatgtgattggccacccaagaaaccagcagaaggcttcatcagatcgtgtgggggagatatatgactttgactgcctctaagatggattctcattccatgtgattcactgggagacctggaaacacctaaatgaggattccttcttctgtgctaagaaaatactcttgtgatttgaaagcacaaatgtgtaaaagggcatgggcagataatttaacagatagccttccacagccctgagtaatttaaatcatctccactggattagcaattccaagacatttttatcccactgagctagccacaaaataaattaggtacctaaaaagaagcttgagatcaaagactttttcaataaaatacctccacagagcctctttatagggctctgcgcacagtgaacaatgaagaaatgtgcactgaataaatactgagaatttctattaccattattagaagggattaaatatttcaggcagattttttgttgttgttaatgaaattgatacctggaccaaggcattcaaggaaaatatgattttacttagtgagtaatattaagcactttcacttataaaaatataacttttttcccatggttctttcaacattgaaagtacacatttcctatcgagagtgtgcggtgggtttgggttcaggacgtgccccctccgctggcggccccaaagcagggcggccgtgggtacactcactgcccggacagctcattgaaagctgccttgactcagagaagacagcagttcacacaggcatttgggttctggaagcaattcccatgttattttcttttttaaaaagtcgtattataaatgtaatagagctccaaagagagtgcctttccatccactgtgggcctttcaaaagagcctgaaggaacgcctgtgtcgacagatcacatccgcaagaaggaatgaggttccccaaagcttccagtgggggattagctcctgcagagtgtaaagaccttagtgtattcatattcgtttcagaggaaattaaaaaaaatcctgggaataaatgttaaacaagtcttcctgctgctttttctgtctcagcatatgaagctgaggtggcagaatgtgaaccttgatggcaacaggggagttgctgcactggagtaaaccctgcctggaggagccctgcctttttcttttgattttaaagagcagaaaataaaaagtgggacctcttcacggtgcccctcacccccaccgttccaccaacagcgagaaactaggtcagagtcaggaaggccctactcaagcccttagtggtgacctttagaagataatgtatagttcagtccacaagaccatctgtgcagggccccaggggaagcgttgtgatgggtgcaaaaagccaggccctgtcctggaggagctcagtctacaagagaacacataagcacataaccacaatatcaaacactgtgcagatgctgtgtgaggtggccacagcagagagcttgagctcggggctgtcaggctgtctaagtcattcagctgggagaagtcaaggttccaggcctcttgtgtacagtgcaaagctggggttggcttagaaccaggaaccaaaagatactttcctgtccctgaatggggaatagaaaaatgctgccctcaagccagtaagctaaggaactgtccatcttggggcactggtgaaaacaaagtcacactctaaaacctagccctagtcgtaggatgttatgaggcttgattttgtactacttgccagctatggaaaccctgagccaagaaactaatataaaaattggtctagagctgttgaaacctgtaggttcctagaagaagaaagaagtcactccgcagggatgcttctgactcttctgcaagactccaacaagaaggcagcacccactaaaaaggtgttgacagagacaaatgacaaaggtctcagggaaagtcactgttatgagagatttgactttttgcgtgctgtaggatattgtggtgtgctgcctcaagcccagctttgctactggatggaggtgctcattccgactgtttgtgggagtgtagggggctgacatctcggatgagttgtttccaggaattacctttagcccacttgaaccacctcgcccttggtcatacttcctcccacagtagcccatgaccaatgactggtcaatgtggggtgtataaaggactgttcccttgcctcaaaccaggacaaccctaaaggacattcattccatccagctccagagctgttaaactcctccctcagctcagtgctgcttgcctcacttcccaacaggtgttgatcctgagagcaatccccaaaccccaaatccccatttcagaatctgtttcctgggcgacctaatttgagacaggtactcccagatttccattttcaatccagacctccttactgagcgccagactcctctccagctgtcttggcaacatcttcacttccatgtctcacatgcaactccaactaaacctgcgtaaaactaaaaccactctattcactcccactaactgcctctcccatctttcagcagctctcactcccaatcatccaattgctctgtcgagaaaccttgacacctcactcttgctcacccttctatccaatcagccaccaagtcctgttgattgcatattcttaatgcatttcttcatttctgctgccacctgactagtgtcaccatccactctggcttggacccctgcagtagccttctgcatgacttcacactttctttctttagttcatggtggccagagtgaagtttcaaccacttgcttattttattgtttcagtttattcacttgttttgttaataggtagctctgtcccatagatcaaaatgcagaaagtactgtggacataaaagtctagtctccttccaagatgccatcagtaatgttggcagattctcaggtattctttcagagataatttttgcctattcaagcatctaatcgtattcccccttttattctctggctgtcattctcccacatgtatatgtagcacactatatacactgttctgtactttgtttctttatttaccgatacagagtgatgatgcctttaaagcgtaaatctgatcatctcacacccaagcctaaaatctttttttggcttgccattactctttgctaaatccccagttccttaatatggtagcctatgggtcacatagagtctccagaaacattttctatggcccatatagcattttacaagattagattctaaacatctctagactggccgtgccctgttcagaatgtgaccgcccccaccatcctctgttgtgttaacctgcctcccgtcaccccgtcagatatttccgtggcctgtccatctcccacaggcattggcaattgtgctgccttcctctcaagcctcggctgcagcccatctcctcttctctctctggccacattgcctttttttccattcctttagtgccctgagctccttcctacttcagcatggcacaagactctatggcaaagctgccgatattccatctttttgcattgccttttcctccctttgcacttgtatgatgcccgtgtacccctcaggaacccagattctctgatttatcatttcctgatatcctttcttttctctaacagcacttaccacacttgtcttaactgtattttgtcaattctaaaatttatgtttttgttttttattttacattttaatctttctgaaactggcaagtgtcttgcaattaatggtgacttacgattataatggtgaaattaatggaatgttacatttgatgaaactgagtaaatatttatctgtaaaaacatcagcttaataactgtctttcccactagagtttatgtgccagagggcagtgactttggttttcctgatccccctatatccatggtgcctagcacagggtcaggcatgtaatagatgctcagcaactatttgtggactgaatgaatgaacgaggaaggggtaaactgaacttagttttatagatcctgaatttgcctctctcaatattttaactgtccaaatttcatgcgttcatgttcttccttgactgtatcctttaaggctttgagagtttgccctcttccccttaatttttgcgtttccagactgaagagattgactagctcaatattgcttcttgcagaaaccacttcatctttttggtcattttaataacccatctctgcaccttttgccgttgtctatgttgtctttcttgtgttgggatgaaatttcctgtcctttttctgaaaatttcttgtgtttagtttatacctttaatggacatagtcagtgaggctgatatttaggaagaataatcttgtgtgtctcctaaaagtgctgctttaaattttttttaggagatagagtcttactctgtcacccaggctggagtgtagtggcatgatcatatacaatagagcattgtaaactatcgtcaccctactgatctatcaaacactagatcttatttcttctaccaaactgtaaatttctacccattaatcaatctctcttcatccctactcccctgtcacccacacattcttttgttttaatataaaaggttatgtgaccttaacaattttttagaattaatcaattaggttacttttttttttttttgagacggagtttcactcttgttacccaggctggagtgcaatggcacggtctcggctcaccgcaacctctgcctcccaggttcaagtgattcttccgccccagcctcccaagtagctgggattacaggcatgtgccaccacgcccagctaattttgtatttttagtagagacagggtttctccatgttggtcaggctggtcttgaactcccgacctcaggtgatctgcttgcgtcagcctcccaaagtgctgggattacaggcgtgagccaccacatccggctcagttaggttactttctaggagtgtaagtcagagctcagaatctatcatctacacttagagtattatttgtattatttacccccagaagcattttattccttttcttacagtgaggcagctggccagtatttcccactctcttgcatgttgatgacatcttcattctatggtttttctcaccatgcattacttcctgttagtttgaaattgcctggcctgtaaaagcttaatgttgcctaaaacctcgtgggcttccctgtgctttgcctctcctggattagtaatgaaagggccaaacaaggtggttctaccccaatctctgacaatgctgctgtttttatgttttatttaaaaaaatgccagagcatggcaaaacattccttcttgtcgttcagtgcctatttaaaaagtaacaatctgtgtgccataatatattttttaagtgtaaaaactgtccacaaattctatattgattatattcttttgccccagaattgaaatatacataaatatttgtatatagaataaagacatacatacaaacatacgtacgtaggtgtatataagtatatgtataacgtaagtatatataacatgtatatttatgtatataatacacacaaaacaatgtactagctgtaaaaacatcctttaaatttcgaaacacagctattgagcagagatgctatgaatgtatggtcagaaaaaaaaaattctgtcttataagtctgaaagctaaaacttgccacctagatatgttcttaagtgaatgtgtgacccagggtaagttactggaccttcttgggactcggcttttgtcatttgtaacaggagaaggtaggattagatcagtgattctcagccccgatttcactttagaagcagttgggaaactttaaaaaatgtagatgcccaggccctatggagagattataatgtagtttttaaagattctcctgtgtgagtctaatgtgcagtacccaaggttaagaactgccaactagacaaacgctaggctctttctaggtctgcaagtctcttgctttacttttctttcctaagacagtatgggctatgccgacagagccctgcagacagagctagtcctctggttggatttgcttaacacatgtgatgctgcagaatgttctcagttgaagagtgcttaggcagcacacctactcctttctgtgcccacacatggcatctccctgtccacttgagcacagagcttcgtggcagtcatagtcccccaccgttgaggatgcctgcatcttcgtgccatgtagcattctcagagatgatctgtggcacagcatgaggagtgctcccaggtcatgtgtttcctgccacgcggccttgaactggtggccagtggccatagtctgcattattttgttacttgctatcacagtctttttgccaatatccttttcaaaatttttggtctctaatttcattctcttgaccacctggtaactttaatctctcagccttgaaatgatccatagatatagtagttaaaataaaaaaagaagaatttttaagcctattaggttctaatcacttctggacctatgaaatgaccagcaaatagtttacaaatattattaactcactaatgtcttaataaaaagaacagcaaattctagctatattattagatttatctcctcggaagtatttcttctagttctctccccacttccactgccaccaccccagtttagggccatctccctcacacccgtcgcttctccttctataacaaaaatggtagttgctgttcatgataggccctgtaataagtactttcattggtgtatttaaaccttgtaaaaggggactttaaagatgaggatgctaaggctcatagggccgaacatctatttagtgtcaaccataggtcaagctctttactaaatgctgtctctatgttatgtcattcagtcctgagagtgactattttacattataccagggaccaaatcacggatttagatgttccatacttgcccaaggctagtaaatagtggagttaaaacctcagccatctcagccaccacaccatgctgctattatttttagaagcattagtaccactgtcctcattttatagatggaataactgcggcccagagctattgaatactttgcctaagaccacttagctaataagaggaagaggcaggatttgaacctaggtctttcagattccaaagcccgagtcacaagcaccacacttggttgcctcctactctttccttatccacttgcatcccatctataaatcaggtctctctcaagcccttcctgaacactggttctatttttcttgctatccctctgctcaggaatggtctgtgtctacttcctaggtctgaaatatcttatttatttatttggacttttaaggccctctgaggtctccttctgacccccaatccttattcctagagtgaccagatcccatgccctgctcagtcagcccgtctcccttactgcatgcgacactcctcctgcctcctcccacctgcatgctagacttctcctgcctccaggtgtctttcgtcttgttcccttcatctcttcaaatagcttttcctggatacctatcctgtgctgccaagatctggaggaaagcctgaaattctccatcagtcaagctgaatccgttttctctgcactgctcagggctaccctctctgggcaacatcccctgctcactccctctctcttgctgtgcctcccatctaaactccctccaggcataggtgcagtgtggtgctcactatggactcctgtatgtctgaagtcataagtgaactccatgagggcaaagaccatgtaaaacaatcctgagcatacagttgcttcataaataggcatcagatgagttattaatctgtgataatagttttttcccctcaaatcagatggtttgttatgttaattctgagtccagaaacacaaattcttaaaaggttgatttatttgattttttaaaagtatgtgttattgtgcttattttaaaggctaataaaactgttcttctaaactgttgctattctcctagtaaatgtcccttcaacggtaatggaagccatgtgcagacaagacgccctgcagcccttcaacaaaagcagcaaactcgcccctaccacccagcagcgctccgttgttttcccccagactccgtgcagcaggaacttctctcttctggataagtctgggcccattgaatcaggatttaatcaaatcaacgtgaaaaaccagcgagtcctggcaagcccaacttccacaagccagctccactcggagttcagtgactggcatctttggaaatgtgggcagtgctttaagactttcacccagcggatcctcttacagatgcacgtgtgcacgcagaaccccgacaggtaaccctgactctcactgctgacagtgtgtttgcttagtgagacccactgcttgccttcccgccaacttctgagcacctccacaggggaagccctgtgatttgtggtgtctgcattctggaaggtcagagagaaatgcaagaccactgcttgactttcttgcatataagggctgcacagacaggttggtggctgcagagaggaatctgcacttgccttccgaacagttctgcccaagcctaaaagagagagaaatagaaggaacgtttatgaatatcataggtggaaaaatgaggtcaggataattagaatcttctctgtcttccaaagataatatagctggctgctctgctgctgtcacagtcatttcagggttcacctccagtgtgccgtgggtatgaacttaattaagtactaagaggtaatgaattggaattttttgcttagtactatttttcttcagagcatgcaaacccataaatcctgcaaagctgtcaaaaggaaatacctactctgctagtgatgtggaggaaaacagatgccacttattcaataaactaatatccacacagaagaaaaatgttgactagatacctcagagtcaaagttggtttgaaagtttgtcaataaagaattttatggccatgaactgaggatgaaatttagctgaacaagtgaattaaaatttcaggtactctgatgagtggcacagtagatataatggaactattatttatgaatcaaaaccggtttatttgacagttttgatagctgggagcgcaaaagacaaaaatcaaattaattcaataagaaaggattgcttgtgtttttatctctccttcatgttctatgaaaacttgattaaaatccaagtatctaagaatagcattcaaaatgcactttgaatataaaagcagaagataatttttgaagctggggtaggagacttggaagcagggctcttgggttattttcttaattttgccactaatttaagcaagccacttggctctcctcgcctaataatgtacacccagctcttccctcccagctctggagggtacacagtgtgcctagaaaacccaagcagaggcagggaggatggaggtggcggggagagggagtggatattttgtaaaataataataatcaattacaggatacatgtgcacattacacatgcatacatttttatttgtgctgttggaaaaactacttgcttagcatcaacattgctgtagctaattaatgttgaaacattaattagggttgttaaggcagctatgtcttcacaatctttattttcaataggcgagccccctggtgagagtatcaacagacttctgcacatcttagtactattggcgtagaggtgatacaaaagttaaaaatgttttcctcattcagaaaagatatttttcaaaatttgccttccttgcaagtatacgtagaacctcaagatatgtctcttttaagtttgcaaagcattttagtagtctttaaaatacaaaagatgcattaaaatctgattataaacttgctttttaaatagagtgaattcagatggttggatctattatttgcaaaggttcattatagtcataataactaattataccaggtaaaataaaataatagttgaaaaatttctggatagtagaactttaaaagtttagctttgaagatgagatgagtttatgctgaatgccatataaagcaatgaaactatttcatggtaggtagatactgaaacagactgttttgtctgatctcagttacgcttagaaaatcatatgtgtggggccgggcgcagtggctcacgcctgtaaacccagcactttgggaggccgaggcaggcggatcacgaggtcaggagatccagaccatcctggctaacacggtgaaaccctgtctctactaaaaacacaaaaaattagccaggcatggtggcgggcacctgtagtcccagctacttgggacgctgaggcaggagaatggtgtgaactcaggaggcagagcttgcagtgagccgagatcgcaccactgcactccagcctgggcgacagagtgagactccatctcaaaaaaaaaaaaaaattatatgtatgtgttatgatgtctgtcctgtaaaataataatgtcataattcgtaatatacttatgtatattatcagaaaaaatacctgaaaaactagaaagcttacgtattcaaaatacatttcagtgggagattgttaggtctatactgattccaagctaatttagagttactggcaaaaatctaggcggcatgagactcctgtcttatcatggaccctgatgggcttatttgattcagatgtccaagtgtggaattgccagcctttccagatgaggtgaagtaatgggcttgttatctgggaaggtgccagagtgggattaaattactgaagcagtgggttccttccctgcagtttgttggtaaagacttgagaggtgttcaccatcattcttgaataagttaaaataaaaaattacttcaaaagatcagttcctttataagcaaagtaataaaatacaatgtttcttagtaatgatgaggaaatgcttgacttacatcatcacatctgagttgattgttgaagataaggggaaatagagggagatatccagtcacttggaccccctaatttcattctagttacataatttgcttttagtataaagggctggaatggctcatttctgttccggaacccagtatgctctgtttgtaccagaaagtttggagataagagatactctccgtaatttcttaaccacatgggtgaattgctaaacggaaaaaatgtacagaactgtaatgggacatcaaatttgttcatgacagtagctacgtttggaacctttttatggttattatccacgtggattattactgctgaatacaggttgagtatcccttgtccaaaattcttgggaccagaagagttttggattttgggttgttttggatttgggatgtttgcattatactcactggattagcatgccaaatctgaaaatctgaaatctgaaatgcatcattgagcatttcctttgagcatcatgttgctgttcataacattttggattttggagcattttggattttcatatttgggatgctcaacctgtatacgtatattctttagtgattgattccaaagatcagctggcctttagtctttagcaatatatgcccattcagccacttacagtgaaaaggctggatagttagaatgcatttcccttgctcagaaaactcaaaagcttttattttgataggaaaatcttgctagaaccaggtacaagaaaggcaagaaagggggacacaggagagaaagtcagaaggtaaaacaggttagagtttcaaacaagtccaaatttgaaacaggcccttgaatctgaggtccaaatgattttttattcaatggactgaatatttggccatgaaaccccagatatttcaacctccatccaagagactttgtgtctgtattcatgagctttttcatgtgagataccatcaaaagtctatgccttgatataaaggaaagaaatccgtagatcctcagggatcccagcctcaccatttattttgttttatttattttttttaaccactgtgttattcacatttaacacagaaaaaaaaaatctgtctgacctggcaaagtagaaatcagcactaaagacaaaaaacacacccatgagggtccaggaaccatggaattattattacttgattttgttctgttaagcaaaatcaaaaatctcttcctcctttttcccaggctactgactttttcttttcctgaataaattcgaagagaagcagctgttggaatctaaatcaaccaacattttgttcaggaactttataaacatttggggttttgcataagcttattgcctaggccaaagtagcttttcttgcttttgctcaaaccaaaagtgcttttgctcagcactcccattgggggcagtatggtggtggggggtatgctccagaaaggggtaagcaaagccttcaatcacaatggattgttttctgacaagtatgttctcttttatttcctgcagaaagtgtctttataatgcttatttttattttgcatcccttttcttttcctttctcctttttgactgtttgtgccacatggggcaagtctgccttcagcctcctgggcacaccatcacctattcacatttgtgttttaagtatcattgtttgtaagagatgtggtgggatcagagggtaaaatgacattagaaggggctctctgataggagggcctggagagaattcatcatcataatagtttcttagaatgtatcagtattcttgtgtcccacttcttccccatcccccaagtgtgaaggttatcttctttctagctttgatgttcttcaggctgtttagtcttgcacttctgtcactgtcctgaaatatttttctccttacgtagaactgagttcttttctcactccacccagccagcagtgacctaagtaatctctctttgaagtcttgagagatttgcacttgggctggctgatgttgaacaaggagagattgtggccccaactgaacaagttttgtcctggaggccatggaagaaaaaattaaagcaggattaatatttttaagccaaaccatacttaattttgttaaatgtttcatccttttcccatgtatacaccaaaccaattacagattaaaagcaaatgaattgcacattttactggagttatctttggcaaaggaggtgccagtgaccaggagtgccaggagatgtgcaagattgtctctctgccttctttctgcttaaacatttaccagcattgatatataccaactaaatctacccaggtgttttctgttcttcagttctttctttcttaaggagcacctttctgttttttcatcaagctgggtatttctgtgtcagaactagccacacaaagctatttacatttaaattaatccaaattaagtaaaatagtacttcagtttctcaggcgcactagccacacatgaagtgtgcagcagttgcatgtggcttgtggctccagtattggctagctcagatacagaacagctccgtcattagacaacactactaaagatctcaaatggtaaaaaaaaaaaaacaaaaaaaaaaccataagttacttgtggttgtgagatactgtccttttgtgaggcatactgtttgcctttgctttgagaagagtgaagtgctatatgtctatgatgatttagagagaataaagtgctttaaaaaggagattttgggactgggcacagtggctcccacctgtaatcccagcactttgggaggccaagtcaggcagatcacttgagcccagaagtttgagaccagcctgggcaacctggtgaaaccccatctctacaaaaaatataaaaattagctgggcatggtggcacgtgcctgtagtcccagctactcaggaggctgagaggtggaaggatcacttgagcacaggagtttgaggctgcagtgagccacgatcacgccactgtactccagcctgggcaacagagcgagaccctgtctcaaaaaattaaaaaaattaaagaagatttccatttagttgtgcaatgtcatgagatcctggaaagagtaaagctaaactcagcactcaagaatgtcagttcttaagagtgtctccgagtatgacacatcaagggaggcagaacttcagaactgattatatccaaaaatttaataagtcttaccttttggtcagaccttggaaaattaatgggaatgttggttgtcagaataaaaagctgagtaatgacaattaattgtgcgctccaaaggccctttggctgtatattgaaagacgtggagttaggatgtgctaattgaaatgggcaaacatagtcttaactcctgtggccagttgtcccaaaagaagttgtgatgcctgagattccaaagtgatgaaaatgtttcctaagctctgctgttgggcctgaagatttaatttttgaacgtattcctgtttccctggatgaaaccctaggcacataatcaattttaaaattactttttgatcattttcttttattcatattttaaggaaatattgaaaatacaagaaaagggggtttaaaggaatcttgtctacttacagtgtaacttctgtactttctaagggctaactttctataaatttctaggctgaaagagacactgttattatagtggcaggtgaggtacatccttcagttctaaattctatacagaatcagcctctgcaaaggtgtatgtgaccaagtattctaaaatcttatttttcaatgtacctaagaatgaaggaatattgctttgcttttagagattaactaaaacaaggtttggtcctatattttggtactagattttcttactctgaattctcaactttttaccaatgcatttaaattttccatattccaatgagcatgtacacacacacacaaccatagaaagctccatgtatagggagctgacttgtagacatgatggagaatagagatcatattggtgatgctgtatcttgggaggcagtgtattgtacagatttcctgggtcatgcacatttgtcaattacctgaaaacaagaacaagcatgagatgcaagagatcatcatcttcagtccattccccttaccaggcagatgagaagacaggtcagggaagttgagtggcttgtccaaatgccacagctgatcagagtcaggggtcctatctctcccgttctagccccttccattcagtcaacctgagttctgcgaagttttaaaaactgtgccataggtcactgcatccctagcatatgcctctcaagccagtgccaggcaaaggtgatgttttagaatccgatttgccttccattggcgttactttgatataagaattcaacataagcctctctgtggtcatttctgttctcctgtgtgtaaacctttaccaccgtgaactattaacataaaaaggatggattgacttctgactgtgagaaataaatcaccccaacttttgacagcagagttagaaaaaaaagaaaagattaattggttttatttagtggcttattgtttattgtgatagccattaaaaatagataaccagaggctaataaatgttaatggtcccttcactattagaaaaatcaattgtcagtgaatatagcatatattaatatattattttgtttataatcttcaataacagtttagaaaattcaaccctgagagaattattttttcaggaaccctttcaagtttaatgtttgccacaaagaacagattcggcaggaggacattttcatctacatataattttaatggttttcaaaggattattttatgattataataaaatgcatgtgtaatttggcaagattgataaactccttaccaaagactttttatatatttctttgaaacttgtttgagagcagttagatagatttctaaatgtaagtaattaaaattgtatagtattgagttattgaccaatccttggctattagtcaagctaaaaaattctacaatcagggctcagtgtgctgaagcctggtaaaataatagtatttgtgttcagtgaggcaagtggccacaattaagcagttcacttgacaaatgagagggtacactttattttgcacttaattgaattgttgtacatgctcagtcaccattgtctcccggcccttcattttggtttctggtcattggagcttgtgcatttgttaaaggttgagcaattaagtctgctttcaccattggtttctgagtgcagccagaaatgtctggctcataagccagggcttagtgaatgctgttaatatccctcacgacagattattaattatctgaacaaaaattttgataaacaaattagaatcctgtcaaggaatgatatgaaatagctttgaatagggaaaactccctgggttttatatcactcaccagattctgcttaagtaagcagaagaacttctgtagagaagacagaattttaatctattttatgaaaaccaaaaattgatttacttctcgtgagctgggaagaatgtgctctgataatcttgctaattatcaggtatttgtcaccacttccttccatttgcttttgcatcagaatcatccttctgcaagcacaatgacatcctatcatttctgtgctgctataaatcatgccttgctgccagattcaactggggaggtgatgttcaagagaaagatctaatggataaatatttggaggagggaatagtaggtagaagtcaggatatctttgacaaagagacacatctgggtgtacatctgtgttcatctgtgcaataccagtgattatgctataagtccaccacagtttaatatccgttaaaacacacatgtaacttgctgacttgcctgtgtgtttacctggtacttaggatgaggtccaaacatcctagaacggccttagtatcaagagcttgtgtcccgggaggacagtttatcctcagttttctgaactaacagagataatagcaactgccttctctgtcccaggggattatcataaagattaaactggataactgattttaaagcactttaaaaagatgaaagtgctatggaagcacaagagacaattatatattttctcttgtaacagtctgcttaatgaagtctatactttccctacttacaaaagtaccctaacatttgcctggggaaagataaaaataagaaagtaggggtttccaaaatggtatgattagtactggaaaggggtattcattcgggaattgatgtgtctcagcagctctgtgaattttgttcctgtggcaacaagtaaagtagtgggaatccagtggccaaagctctatgccctgtcttagaaactgagaaaatgtcaccaataagttttggccccttgtcatatgattctgacttccactgaccaacgcagaaaacaatgaccagacagtctgtttatttgtttcagaccctaccaatgcggccactgctcccagtccttttcccagccttcagaactgaggaaccacgtggtcactcactctagtgaccggcctttcaagtgcggctactgtggtcgtgcctttgccggggccaccaccctcaacaaccacatccgaacccacactggagaaaagcccttcaagtaagtagtggctagccctccaccctctctttctcttagcctttcccaagagccagctgatgcatcagcacagtgctgcctggcttagccagctggcacaggctacttggaaggccagtgtccaggctgcaaacgaatctctccttgtttagtggctgacatttgaaaaatgaagtcaggaaacctatgcactggtcctagctcaagttgccaaccttggtcgtgagacaaatcttctgggtctgttttctcatcattaaaataaagaggtaggagtaaataattttaatatttttttcagtccctgatgatctgtgcttctggaattttatctaggagcgacacagagctcctgtggccatcagcaagccttacgatcatcagaaaggtgaccacaagtttagaacatccgaataatccccttttggagaacttgaacccttcaggattctgatgaaatatatcctcctctttcctatgtgttaaagagtttgaacctattatagcagccaacttgtgacttttcagtgtatactttggactttagaattaccatgttggtgaaaaaagaaaaacaaaaccaaacccagagtacattgactttttgaggattcagggaatgtggaaacagatggaattgaattctaagggctttggcaagataatggcatctgagcaagagagtgtgtttctacacatggcacacttatccaaatggtggacatctgaatccgtgcaagatggtctattcattcacttattcactcattcattcatttactcattcagttatgtatgtgttcattcattcagctggtatttaccaagtatgtacttttttgctaggcaccctggtaggtacaagagatacaaaggtgaatgacatttagctgttcctccttttctccatctttgaaaacctcatagtctaaggggaagcccaattagtaaacgtattatagggtgaaaagtacaacagtaagacatgtatgtatgatgtttcacagtagcacagaaatggagtaatcaatgctatctggtggaaatgatgtttcagatatgttttgaaggataagtaggagatttctagacatacggggcatgggggaaggtatttctggccgtccaaacagcaggtggaaaggcctgagagtgtgagtcagcatgcatggttgattggtgttctcagagcagtttttatggtctgtgtgatgaactcttttcagttcaaccctcttacagctctcttcactcatttgctctactggctttttctgtttgagaaggagaattaaaagagcatagagttaccgccttatgtaccttctgtaggacatgatcaagcaagagaggaaatgattcaggcagtaggagactaatccccctgctcagtctcagccaagaagtcttcccagagcctcattacccaggattttccatccagacctgctgtcgtggcgcactttgtgctcagcctgaggccaggctcagcttgggaaacagagttctctggtctgggtcctgccttcctctctgtctgccagtgaagggagaagttcataaaagatagtcattgtccctcttctcctcaataattagttactttattcagcattcttaactattctccaacatagtttaatttatggtgttaataatcaaaatagtgataatttttgttgcggtacataggtgcagcttgttcactgcataagagcatctggctaagtgggcaggatggggcctaaaatcaagtctgtactatgccacccatgctgtgccgcctgaggctgcaatagcccaaagagggcatctttttctaatccaccctaaggagctgcatgggctaccacagtcctaggagttccctatcaccagtgcttgtatcctgcctagtggactttgtcattgccctcaggcctgagccccgtagggttcctaggttctggcttcactgctctggaggagggtgttgacaatgagtggcacgttgcctgtgcctttgagcaagagagcttttcaaaagcagagatacaggagggttcaggatccttctggccccttatattagaaagggcagccagaccaatacagtgccaggagtcagattgatttttatcttgttgctgtgtaaatagattttagtaattaattgaagcggtttcagggtcaaaatgggaaatagatttctattaatgttaaggtgttacttatgtgtaaccttgttgacttcactcaatttttttcctttaacatctgtttttgtcatgtttccaatagagttgccattttaacttaattttaattcatcagattaatatttgaagggctttgctgattgtatttttccttttccaaaaatatatgttttgatcatacctactttcatctggaaaaaaaaggaaacaactaaggttgttggcttaaattctgtgtatatgttttagttctttctgttcctacttttatctagacagccacatgctgtagttgtttttttttattttaatttatcaaatagatattcccaggggagagctgagtgtatgcttattttgaaagtgcaagatttaaacatcttctaggaaatggaaagttaaatcctttagtgtatacaaccaggtctttcagaattgatctatcccaagggaattttgggaatcttccaaccatagctcatggatattcatcccatggacatttgtaaatattatgaagatatccttttacaagcttataaaacaaacatttttaaaaaccttttttttgcagattagtcaataaaatgggtttctctacaacagttaattttactacttcaactaatgggtattggcttacacaatgttacaaagaaggagaagaatcttgtaaaggcacataaccctcaactgtatgtcttggggagtttccaaatagatgccccagatggctcagtccccaaattgtcccacccatccagggctcaggaggcctttacagaattctcagggttgagctgagattaagcttgccatgtcagagaaagccctttacaacttctaaaatcttctgctgagaagtggtttttgaaggcatatcaagattactgccatccaaagaaggctgcagaagatttggcatgaagaggtcagagtttcaatccaggctttgcctcatatctgattgactgaaattccactgaaagaatccatctcccatgttctaggtagatgatgggcctgtcagcagctaccctaggccgtagacttaggatttctaagataaaggagcatgtacgaaaaataaaaattggaggatcacattgaaggtcttggctttcaatttgctctatgatactggaagtcatggaaaacaaggagcaaacgcaagatatcatttaacagcaatggccaagcattttattgcaggcaggcaggaaggaaggaaataaagaagttagttggcagtctaaaaattattctatgcagcaaggactccttcctccttcttactaaacagtgtcttgatatttcagtgggctgccctgctgtgcctgagaggatctgtgtgagctgcccgaagcctggctttctgaacctgggaaactgagaacaggccagaattttccttaggaggggttcttcattattgttagaagcaaggagaatcattcatcgctatgttctttcatcaagaaaatggagtttggctcatgatgaaaaaaatcaaaggaaattccaaaggacatctaatatttgaacaagatctaggcaaaattaaagcaaatccaagaagcaaatcagtaaatatgcattgaacacatcatacatacaaagccctgtgcaatttggttcaattcaaaaagtattttgtggcatatcatagaggcacagaaagcttgttgcaggttttctgtggtaacagaacttgacatcgctttgttaagctcctcgtacatataatccagtcaaccatcatagtaagtaaagaatgatctcaaactttagaggtaattaagtctaattaagatgctcacaatggtataatagaaactcctcacaatgaggagtttcttttagctgaaatacttagtagactttccacttcattgttcctgagatactcccgtcaaggctgtggcatcagcacctatgctaagggaaggcacaacgaagcccctgagtgcaagggcgcttttccctcctgacgcattacctgcatcttttcttccttcttactctgttacactgcacgaagtccaggcttagagatgcccctgccagtcagtcatcagggactgtaattcagggttagtttagatgccaaccaagtgaagtctggctctgacttctgttgagtcagttctgttgagatgagtttcattaaagtatgaaaatattttgtggaagagatttctctaaaatgtaagataatgaacataaaactgaagtccttctcttatttttaaaaaatatttttatatctagctcttacttcctcaaatatataaattgcattcttgtcattcccagacaacatagatattatttctggtagccttctttcctcaaggagaactccctgagaaaagattctaaattaaggtaatttctacacgtttgcttgtatttttactcacacttggtgtgcagatggctctagaaatgatttttctggaatactcttcttatgcaccctatatattggacaaattttctgactattacaacaaattgttccatttgtgtaaatatctgcagtgcatttaggcaaacacttgagaaaaatgtgtttttctcttagtgtctccatccaatctggatgttaaaatattacatatagacatacacttttgccttatatgaagcactaaactgccaactcgtgtattcctcatattctaatacacaagattaaaaatgcaaaaccatgacccaggcacattttcatttctcacaattgttcaagctattctactctctttgaaattgattctagagcttcaagataaaaaaaaggaatataataatttgaaagtttgtcaagcagtgaaaggtagtatattttgacacactaatccagtaactaatcagttttctaataaacaatcagcagttcgctaacgtgtcatcagcactccaggagctctggagaggggatgagctgcccacggacgttaatgaatacaccaaaaatcattaggtgatcaatacttctgagttattttcattgagctgataggtctgatacattaaagctgacattatacatttgtcaagatcacagtgcagtttttaacagtggaacaggctgctaaaaatattccccgaaagacaatcaaagaaacacaagttcttccccctgacacactccgctggtgcaggagccctgaaaaatccaaatgcgaagtgaagctcctgcctcccaatgttcaaaaacatgcaagaattcccagagtggattgatgtgttctattttataggtacttatttccaagacagggcacttaatataatttactgaagaggagaaagagtggaatgcctaacagataacagggcttgtggctttcttgtctgtgataaggcagggagactatgtcatggtggcttttgccacagctttcatagtgcaggggctcacaaactggaggttgcattatttaaaagtgggacaattgtctgtagctcttcttgaatatctttttcttcaaaggtttgaggaaagggcattaggggtggctgaggtggcctctgagctgtattagatgctgggccagtgctctaggcagcccaggtaagtaaggtggtgatggagaagtcgctgtctgtgcccagccagctgccacagttcatctgtgggtgtgtgtatttacacacacaatcacaatcagccagggacaacatccacagaaaaacaacaggctcccactagattttgaatgtgtgttctgctttttgtagattgagtagccaccaagctagtaagtgaaggttgtttggaagatatggacatgggagatagggaggaactcaaagtctctagattacagtctttttttgttgttgtttctcatttaagttaaaaagaagagataaatcttgaagtgtgacattttctcctcatcagacacactgcccttaattctagcccataggtacatcctttccactgtgccactgcaaattctagttttataaattattttaaccctaagtttggttaggctgtgacactgtaaccagcttttgcaaaaaagcagcgaccacgcctactgcccctcacagtcactgcagtctaacatattgcttcctctagtttccaaattccaagatgtacactctttggctgctgttctgaagggagtagaattcccaattgtaaattagcagtaggtgaaattctatttgtcatcaatttctctttggggttacagagtagaaaactgcaggcaagctgcttctttgatggctcactcctaaaaatctctttttgttctttatctatttgaactgacagtgatcagagctgcagcaggacagggctctctggagaaatcaccttccccctgcctattgacagatccctctgttctgcatcagacgggctttgtcccatcacaggcatccaggccttggaaggagccaccaattaaacctcttgagctggtaaaatctgaagccactttggagtgtctgttctgattaggcaggatgagaggaagcccatcaccctgcaggccccgctccctggtctcaattttctctcttgcctccaccaggtgcgagaggtgtgagaggagcttcacgcaggccacccagctgagccgacaccagcggatgcccaatgagtgcaagccaataactgagagcccagaatcaatcgaagtggattaacggattgactggttggaattaaactgcaaggaaagtcatgattaaatgtcacggacacttaagcaaaaccaaagatttcctctgagcaactttcaatcagtcccagaaaaccaaaagcagtaataaaataagtaagatgttaagagatattgatcctggcatggaagtcagaccaggaaagagattatttatttatgacttagggatgagacttatttcagtggacaactaacctgggatggttaacatttccagtcccaccatgtattttgctttgtttctaaaaagctttttaaaaactgttatttaataccaaagggaggaatcgtatgggttcttctgcccaccgttgtgactaagaatgcacagggacttggttctcgttgcacctttttttagtaacatgtttcatggggacccactgtacagcccttcattctgctgtgtcagtttggcctggcctgacactggctgccccagcggggaccacggaagcagagtgagagccttcgctgagtcaatgctaccttcagccccagacgcatcccatttccatgtcttccatgctcactgctcatgcactttttacacggtttcttccaaacagcccggtcttgatgcaggagagtctggaaaaggaagaaaatggtttcagtttcaaaattcaaaggaaaaagttgaggacttattttgtcctgtcaagattgcaagaacatgtaaaatgtacggagcttcataatacgttatattgttccgaagcagctcgttgagaaacatttgttttcaataacattttagcttaaaaaaaaaaaaagaaaatgaaaataaagttctttggtttaaggctgga

SEQ ID NO: 766 - DNA, 68963 bp, Homo sapiens
ggtgctgggagaccgtgaagtgcaaagcagatggagtccaggccctcggggagacagcacgccagtgagggagatggagaccaatcacccacccagtgtgcggtaagtcagacggtgacaagctctgaagacaaggaaagcagggaggaaggggcgggctatgccccttgctctttcatgtggggagccagagggagccagaggatgtggggatcgaccacgtggttaggggaggaaagcatgtttcaggcggagggtgggcaagcgcaaaggccctgtggcaggcgcgtctgtgagtggtcagagcagagtgaggggtgggagatggggctgggtcagtggagtgggtgtgtacatgcaggtctgcagacccaggtaaagagtctggatttcatttctaaggggatgagaagctcgggaaggtctgaccagccttacgtcttgaaagggaatcccctgcttctgcgtgtcaggtgttactcggggtgcgccagtggaagcgggaggcagttgcagctttcaggtgagaaatgatggcaactcgcacggtgggggaagaggggccactgtggaggtggcttgcggggcctgtcatctgctgtttcctagctcagtgtacagggcccccacgcacccctgccaggtcggaaatccaggtactgccagcctctgccgttctacgtgtggccaggcgggggagcttcgccctcccatgtccctcaccccatgccccagacagcacggtcctgcgatccccctcccattccagtgctcagtatagccgtatccctgcaggctcaggcccccaccatggccagatcccccaccccaccttcaccctccgccagtccattgcacacatagcatctggaatggtctcgggcagcacctcagacgatgtggctgtgttgcatgagcccctcccctcaccgcagctctcggccctgcctgagcccaggtgcccgcgggctccccgctcacctctgccttgaaccttcctgagtctgagcttcttttttgttttgttttgtttggttttgagacagagtcttgctctgtcacccaggctgcagtgcagtggcgcgatctcgactcactacaagctctgcctcctgggttcatgccgttctccggcctcagcctcccgtgtagctgggactacaggcgcccaccacctcgcctggctaattttttgtatttttagtagagacagagtttcaccgtgttagccaggatggtcttgatctcctgacctcgtgatctgcctgccttggcctcccaaagggccgggattacaggcgtgagccaccatgcctggcctgagcctgagcttcttaaacaccacatcctctagcctcctgccttcacacaggctgttcccttagcctggactttgtccccacccacccgctcctgatctttcaggtctcaacttacaggtcactttccctgggaacctcctcagacccagtgaggccagattaggggcctcctcagagccctcatggccccaagtgtttaccacttcgctttttcatactatccaaagtgcacagaatcgtacacttttctgatgccttgttccagctgagtgccctgagggcagggatggggtccgtgtcctccggtgtgctcagccagcacctggccaggcactctcagtgttgttgaatgaatgagcgagtgagtgacccgcaggggaagctgctgtgtctgacacggtaacgtgcaggttgcactgggggggcctggttgagatcatgactggagtccctggcccccagagtgggagtcatcagtggggctcgctacctctgcacaatttttttttttctttgagacggagtcttgctctgtcgccaggtggtacagtggtacgatcttggctcactgcaacctccgcctcctgggttcaagcaattctcctgcctcagcctctcgagtagctgggactacaggtgtgcaccaccgtgtccagctaatttttgtatttgtagtagagacggggtttcaccatgttggccaggatggtctcgatcccttgatcttgtgatccgcccgccttggcctcccaaagtgctgggattacaggcgtgagccaccacacccggcccctctgcccactttcttccccttcctcctctcccgtctccaccaaggctgtctctggagtggctgtggatctgacagaatgcatgtccgctctgccatcactattcacgcacagcgcctgttggggactctcctgtaacccaagggggtagcggaaggatggagcttcaggccttgagggccaggaaatgaatgtggaagactgaatcctcaggggaccccaactctgggccgggtctggggctctgttttgaggacggggagtgggaggaggtggcagcaggagccggcgtctgaggcatctcctcacactcttccaaggtcagagacgaggtctcagatacgcttgctaatgcacgatttatttctttttcaatttcctttggaacctgtgctgtgcagatgttcacatgatgtggtggggaagtgagttttataaaactcttggcagagtaccattcggcatccctgtggttctagagatttctggggcctcggggctgtagcaccagctgcagacagctgcctgccttcttacagtgctcagcttttgggtccagcagctttctcagtcccaaacacatgtgacctcacgattctggcccttccatgatccgcaacaaactgttctggtgtgtaggtggaattcctatttttaatagccaagttgttgagaaattgtagggcttctacttccttttgaacggaagggctccggagatatttatatctttgcttctatagaatctaggaggttgtctttacccagggagggtcagcatgtggagagggtcacctgggagaggccccggtgtcagcctgcacttgccgtcagtaaatggtacgacattgagcaccaaggagctcagccagcccctcgagggaagtcctagctgcccactgggggaagggcggggaggcatgaaaacaatgaccccactggctggtgggggtgaccgtgttatgcaaagtgtacaccatgtagcatgagcaccgggccgggagcccccaaggctgctggggaatcagggagacaccaaagaggaggtggcctttcccttgaagggtaagggatctgtaggagtctgtgggagagtggaagctgcgggagggaaaggagggagggaaggaggcctggagagaggagggaggctcttgcattccaggcaggtatgggagctcctggcagagtttgcagtacccagtggctcagtgtggttggagttggctgtgggccaggtgggtgggtagacaggggccaggtctggaggggtttttagtgctgtgctgaggggtctgaagtccatcccgaaagttgtaactggggagtggcacggtggtgagttagagccacgtcattcaaactttctcaaattcccatacatagagacctagtgtgcacactcgcagcccaggcttgtgagctgcagtcgcccttgccatgtgcagctcgttctggcgtgttctgttctgcttctattctggctcatttgttctatgaacaatgctgtttgcaatcctctacattggcttcctctctccctgaatatttttgatctgcagttagaacaacactggattggcaagagggagactgaggcgggaacccaggcagaggctgctgtgagtccagctaggatgagacgtgggtgccagacagtgggcctggggcagaccccagggactccgcagtgaagaccccacctcagtggtcctgggccccaggcctcaagagacttggggcagctccctaagcagcaagaggggtcctgtcatcgtgaggcgtgttgaggatccagaagctgtggtttcataactccgtcactgtgtggtgtctgaaagccatttcattaaatgtcacatggaatcaaaatagaaattacatctctgggacaaagcccattgagccaggagccagggattctgaattggaaccagaatagcctccgaagctgggactgtggatccaaggctgcccccaccccctgggtctcgctcacatctgcactccccagagggggcaggtggtcctggagcctagcctacctgccgagagtcagaggtggctgcaggggaaccatggcagccctccttctcacactcatcctgggcaccctgcaccagcagaagggtttacatgtacaatcacccatccctagccccttctgggagggaagcatatcttacggatggcgaccttgaggctcagggaggttaaggtgccagcctgagatcacacagccagtgagaggcagagacagggcttaaactccaaacgatggctccagagccccctctcttttccatgccctgggctgcctctttccccagtgcaccttgctttttggaaccagatgaccaatgtggaaagacacgaactgattcaatcagagtgtatggagaagggacttagagaccctggtatttttaaagctccctggtaattctcatgtgcagctagggtggggcgcctctgctctgcggaatagggaaggggtgtaagtggccctgtgtctcccctctgtccccacctgccacctgctggtccatccattcagccgttgcacggacaggttgccttctgggggctgctagcccccttgcactgggcaacgctgtgtcccctctgtccctccccccagcgcatgctcctcgctctgcccctgctgcaggtgggccatgcttggagggcgcaggagagctgagatggggtggggatggatcaggccttgagagggtgcctggtaagccccgggaagggtagggaggaggaggagggagaggagagggcagtgcaagggcagcgacccccagccttgcccccgttttgagcacggggaaagtgtacacaggtagtgaggaaatgcctgcgtttgggtgcgtgttcatttctaatccattttcactttttgtgtattctttctatctactttttaaaggtttgtttcttttctaacttcctgttttagatgtatactttagtttctttatttatttttatttatttttttgagatggagtctctgttgacaggctggagcgcagtggcgtgatcttggctcactgcaacctctgcctcccgggttcaagcgattctcctgcctcagcctcctgagtaactgggattacaggcgcgcactaccacgcccagctaatttttgcatttttagtagacatggggtttcaccttgttggccaggatggacttgatctctcgaccgcgtgatctgcccacctcggcctcccaaagtgctgggattacacgtgtgagccactgggcccggcttagtttctttatttaaagataagggtttttttttgttttgttttgtttttgagacagaatctcactctgttgcccaggcaggagtgcagtggcacagttgtagctcactgcaacctcaacctcctgggctcaagtgatcctcccacctcatctgagtatcagggactacaggcatgcactaccacacccagctaatttttgtattttttttgtagagacagggtttcgccctgttgcccaggcaacaagcaaatctgcccacctcagccttccaaaatgctgggattacaggcgtgagccaccacgcccggctagagataagtttctcaaactcctgggcttaagccatccacccaccttggccttccaaaatgttgagactacaggtgtgagcctttgcattcgccttgaattcctttttcaatagtatgtttcctactaaaaacacttatgaaaagtgtgtattttctcttaccccttctccttttttgccatctaattttagattatatttcttagtgtttgtctttaaaatgtacttatacctctatgctatctttttcttatttttgccccctcccccataagaaagataaagaaatcagagacttagaccaggtgtggtggttcccgcctgtaatcccagcactttgggaggctgaggcgggtggatcactcgaggtcaggagtttgagaccagcctggccaacatggtgaaaccctgtctctagtaaaaatacaaagttagccaggcgtagtggcaggcgcctgtaatcccagctactccagaggctgaggcaggagaattgcttgaacctgggaagtggaggttgccatgagccaggatcatgccactgcactccagcctgggcaacagagtgagaccctgactcaaaaaaaaaaaaaaaaaaaaaaaaaaaaaagaaatcagatactaacaactctctccttctttcttttcttcccaatttttgtttaatgtatcatttctaaattcatggtttatatttatatatgtccttaatcctcactcacattgccctacaggtagattcattgctcactgtcagttctcttgctgaagttttcctatttttctcttgatttgctgaaattccttctccagtagtttaatcaaaagggactaaatgaaaaaaaaatattcagttattgcaagttcaaaaaggtttctagtctttgtgtttgattgacagctttccagaatataaaattcttaggccacactttctttccttgagaacttcacagatgtcacttctgtctctagagttaaatgccactgtgggaaagtctgagtctaacttctattttgttaccctttatgaattgatgttttcacttgactgtccaaagtcttttttatttagctgtttccccctttcttttatatttttagtctagttactttcatagaaattaccttgttattgacagatttttgtcattttccccaagacatggtgtgccctttcagtttgtagatttatcttcttttacttcaagaaaattttcttgaatgatatctttaaatatttatgttcccctatttgagttttctattctgggatatatgatgggtcctttgtagatcttccaaatctgtaattttctctgtaatctctttacaccgttcattttcatttccttttgctcactttcctcagtcttgttctcagtgtcttgattgtgtcttgagcaatatttgatgctcctctgcgcacctttccatttcatcatgactttgaagatacgatgtttttccttctttctccagctctgtcagctccagtttcatgttccccctgagctctcatatctgttttgtgtgcttgctttctggagaggattgctgtattcattttttttttttttttcgagatggagtcttactctgttgctcaggctggagtgcagtggtgggatctcagcttgctgcaacctctgcctcctgggatcaagcgattctcctacctcagcctcccaggtagctgggattacaggcttgcgccaccatgcccggctaattttggtatttttagtagagatggtgttttgccgtgttggctaggctggtctcgaactcctggcctcaggtgatctgcccgcctcagcctcccaaagtgctgggattgcaggtgtgagtcactgcgcccagccctgctttattaatttttgttgttgtttaattttcagcgaaaagtttgctggcaattttcatctgttctatgacaacatttttactagtgagttttcacttgccacttgtttttcctgttccttttctcgtttttattttttaattcttgcagtgtcttcctgtagatgctgcgctgtttgcttttttatttctcatctttgggcaaggtaagtttttcttcaaccatctatttgccagaggtttgtgtgggagaagaagcgaggactacacccagtgccatgtgcagttgtagggctgctcatgtgcagtctggtgattcctctttttgcctgcaagtgtggcttgtctgtgtgattgtctgtgtctgatctgctgcttctgcttcttggttccaagcttacctgtatctcacatgccactgtcatgagatcacaggccccactcctgctcatgcagataagggacgttggttggtgggcagtgtgatcccttctcactgcttcttcccaaacatctgtgtggtatttcctgcctgggcaaccctctgactcgtttctagtttgggtttcatctctcatctgtttccattggaaatggagtgtagctgggcgcagtggctcatgcctgtaatcccagcacttttggaggacgaggcgggtggattgcttgagcccaggagttcgagagcagtctggccaagaaggtgaaaccccatctctactaaaaacacaaaattagccgggcgtggtggtgcaagcctgtaatcccagcactttgggaggtcgaggcgggtggatcacgaggtcaggagatcgagaccatcctggctaacacggtgaaaccccatctctactaaaaatacaaaaaattagtcaggcacggtggcaggtgcttataatcccagctactggggaggctgaggcaggagaatcgcttgaatctgggaggtggaagttgcagtgagccgagatcacgccactgcactccaacctggcgacagagcgagactctgcctcaaaaaaaaaaaaaaaaagatggcgtttgcatcctgtttctctttctccttgttactatgggatgatttttttttttcgactttattggtgtataattgacatacaataaactgcgcctattgaatgtgttattagtaagttctgacatatgtatacacccatgcagctgtcacaaccatcagccactagacatcctgtcaccctccacagcttcctcatgctgtttcttacctccactcccattttcagacaaactgactgctttccgtcgccagagtttacattttctagaatttcatgtaaatagaatcctacagtgtgttgtgtttttttttttttttttttgatgtggtttctctcacttagcatagtttttttttcttttgagaaagagttttgctcttgttgcctaggctagagtgcaatggcgcgatctcggctcactgcaacctccacctcctgggttcaagcgattctcctgcctcagcctcccaagtagctgggattacaggtgcctgctaccacgcccgactaattttttgtatttttagtagagatggggtttcaccatgttggccaggctggtctcaaacccctgacctcaggtgatccacccgccttggcctaccattgctggaattacaggcatgcgccaccacgcctggcctagcatagttattttgaagtccatcagttgtatataacaatggttcattccttcttattgctgtgttgcatttcattgtatggctatgccatatttattcatccattcacctggtgatggacattggggctgtttccagcttttggctatgatgaatcaagttgctgccagtctgcatgtagatttttttttttttttttttgtagacagagtcttgctctgttgcccagactggagtgcagtggtgcgatcttggctcactacagcctctgcctccttggttcaagcgattctcctgcttcagcctcccaagtagctgggactacaggtgcccaccaacagcccagctaattttttttgtatttgtagtagagatggggtttcactatgttggccaggctggtcttgaactcctgacctcgtgatctgcttgccttggcctccgaaagtgctgggatcacaggcgtgagccaccacacctggccacattgctgttgaggaggtgcataggagcagaatgactgggtcatatagtaggtttcactttttaagaagtgacccaactgctcttcaaagtgaccataccgctttacatgcctctgagcacataagagcaacacaagagtcccagttgcttcatacccttgccaacacttggcatggccaatcttttacattttagccctccgagtgggtgtctagtgtatatccttgtggttttcatgtacatttcaccaataacaactggcatgagcctttttaaatgtacttattttttatatgtacaccatctttggtgaattgttcaaatcctttgcccatttattttttattttttattttattttttttttgaggcagtgtcttgctctgtcactcaggttggagtactgtggccccatctcggctcactgcaagctccgcctcccaggttcatgctattctcctgcctcagcctcccgagtagctgggactacaggcgcccgccaccacgcccagctaattttttgtatttttagtagagacaagctttcaccatgttagccaggatggtctcgatctcctgacctcgtgatccgcctgcctcggcctcctaaagtgctgggattgcaggtgtgagccaccatgcccggcccctttgcccatttaaaaatatcgagttgtgttatatattaggtttaacagctctttattctagttacacgtcttttatcagatatatgacttgtaaatattttctgtagtctgtgcccttctttttcattttattcagtgtcttttgaaaaagtaaaagacttaattttggtgaagtccaatttactgttgcttttttttcttttatagtttatgttttctgtgtactatttttttttttttttaattttttattttttgagtctcgctgtatcacccaggccagagtgcagtggtgtgatcttggctcattgcagctttggcctcctgggctcaagcagttctcccacctcagcctcccaagtagctgggattacaggcgcccgcaagcatgtgtggttaatttttgcatttttagtagatatgcagtttcaccatgttggccaggctggtctcgaactcttcacctcaggtgatttgcctgcctcggcctcccaaagtgctgggattataggcaagagccaccacacctggcccctgtgtactattcttaagaaatctttccctgtggtgaaaagggaactcttggacatggttggtgggggtgtcgattggtacagccattatggaaagcagtatggaggtttctaaataaataaaaaatagaactaccatatgactgaccaaaggaaattatatcaccaccttgtaaagatagctgcactcctgtgttaattgcagcattattcacattagccacgatatggaaacaacctaggtgttgatgaatgaagggatcaaagggccgggtgtggtggctcatgcctgtaatcccagcactttgggaggccaaagtaggtgaatcacttgaggtcaggagtttgagaccagcctagccaacattgtgaaatcctgtctctaccaaaaatacaaaaatcagctgagtgtgtgctggcgcgcacctgtagtcccagctactcgggaggctgaggaaggagaatcacttgaatctaggaggcggaggttgcagtgagccaagatcatgccactgcactccagcctgggtgacagagtgaggccctgtctccaaaaaaagatcttttttgactctgcgatacaaagatgttttcttctaggtacttcatagtttttacatttaggtctctgctgccttgttagttaatttttgtgtatggtatgaggttggagattggggtttatttttctgttctctttgagccggtttctgggaggagagagaggacccaccagctcctctgctgtgtcaagctattatacaaggccccatataggccgaggtttctgtttttttcttctctaggaaaaaaagaggaaaagccatcagcaataccaagggaaacagtaagctaagattggcatagttctcagcaagcctcacagcgattctctgctccctccctcaccccttgcctacctttaatccaaaaatgattttaccagaatgtccaacaaataagacaagacccaaaagcactgagaactttttcttgctgccaagtataaaacacagaccagtatagtggcttaaaaaagcaaattcccaggaaaatttatagagatggaaaataggacagtagaatagcagggactggggaggggagaagggagaggtgctgttgaacaggtagagtttctgtttgggctgatggaaaagttctggaaaagaaattgttgatggttgcacaagattgtgaatattcataataccattgaatggcacagttaaaaatgattaaaatggtacattgggttacctatgttttaccacaattaaagagtatttttaaaaaagcatattccctctggggttagttagctgtagtcaacacctaagttccccagtgatgaactgaagtatggaccatcagcataaatgtgaattaaaattaaatattgccaggcaggctgggcgtggtggctcacgcctgtaatcccagcactttgggaggcctaggcgggcagatcgcttgaggtcaggggttctagaccagcctggccaacatagcgagacctcgcctctactaaaataaatacaaaaattagctgggtgtggtggcacacacctgtagtcccagctacttgggaggctgaggcaggagaattgcttgaacctggtgggtggttgggtggggggtgggcgcacagaggttgcagtgagtcaagatggcatcattgcactccagcctgggtgacagagcgagactccatctcaaaaaaaaaaaaaaaaaattatcaggcagtatgaggttgcatggtcaatatcctaacagtcacaaagcaagcaagtgatcttgagggggaaagggaggaggtgggaagaaaggaggaggaccaagttccgctgagtggctaataaatattattttggttaagtccctgtctccacagagtaagtcctgattctttttttttttttttttttttgagactgtgtttcactcttgttgcccaggctggagtgcagtggcgcgatctcggctcactgcaacctctgcctcccgggttcaagtgattctcctgcctcagccttcccaagtagctgggattacaggcatgcgccaccatgcctggctaattttgtatttttagtagagacgtggtttctccatgttggccaggctggtcttgaactcccgacctcaggtgatccgcctgcctcggcctcccaaagtgctgggattacaggcatgagccactgtgcccgggctgtaagttcctgattcttaagcctaacatagttaaattgctctgtaaaaaaaaaaacagtggctttatattcaagaccatgttgcttccaactgaattggccactgacactgggatactgagcagtgaacagaccacaaggaagacatcactctcggatcctgtttgaaaccaacagctacagcaaaacactagtcttgattcagggcctaatggggtttctttaattagcaagtttacattcatggagtcttgtgaaaatggttagataaattgcagagaaataaataagtattttgtacatctgagtattattgttaatttccacctggctacatgaggctccctcctctgggttttctctctatgcccttttgctgtggacagaaggtaccttgctcattcatccatccagccggtgagccagggggcagcccggagggaggagtggaggggatgtgggcctggaattagactgagcttggtgtgtccccagctcaggccgcactgccaggccctggtttcgttactatgaaatgaggggtggggtgggtatctggtctcccactccccattactgaggggttcccgggctctcctccaccctctgattcctccccctcttctgttccagtccagaatgcctcctttctgcctaaacgcctctgatcttcatttgatcatcagcagctgcagacccatgagccactgggcctgacctgggagacactggccctccacttccagtgctctccagctggatttcctccagaacagtggcaaagagttcgcccagagctgcgtcccctccctgggaagcagcgctgagtcagggttacctggctccactgtgcccctagcgaggtgaaagttcgcacaatgacatgggctctctgttgaggataaggaggctacagcccaaggagcttgtgcaccgcaggcagagccactcaggtcatcttccagagcgggatgtctgactccagagcccgccagcccacactgctctcctgaggactgggtttctctggcctgagtctgcctgagtctacaggaagaaccctgctggcaccccagtaagcccctctagaccttggagctctaactgctctcagagctcacttttcagttagcctgtaaggcaggggtgtccaatcttttggcttcccttggccacattggaaggagaattggcttgtgtcacacataaaatacactaacactaacgatagctgatgagctaaaaacaattaaaaatcacaaactcataatgttttaagaaagtttataaatttgtgttgggccacattcaaagccgttctgggctacgggttggacaagcttgctataatggatcagagatatgtacagtcttaaagaagaaacagctcccaggcctgtaagacctatcagggcactcactgaatgctgtgagcaggggaaggggcagtcctgggcagtggggtcctctctgggggtccagctgtgtctccagtcgtctggggagctgggaacagcacaccagggttcttgcctcctgggaaagttctcacagaaagagagaacagaggtgcaaaagctaggccatgttcattattctttcattccctacttattgagctttgacaatgtgtgagggactgcttgattgattgactgattgattgggacagggtctctgtcacctaggctggagtgcagtggtgcaacctcagctccctgtaacttccgcctcctgggctcaagccatcctcctacctcagcctcctgagtagctgggattacaggcccacgccaccacacccggctactttttgtattttttggtagagacagggtttcgctatgctgccaggctggtcttgaacaaccaggctcgagtgatccttctgcctccccttgggctcccaaagtgatgggattataggcttcagccacagtgcccagccagaggaacgtttcagatgctggaatcaatggtagtgtgttggaggaagggagtttctgagctcagcccatttctttttttttttttttttttttttgagatggagtctcgctctgtcgcccaggccggactgcggactgcagtggcgcaatctcggctcactgcaagctccgcttcccaggttcacgccattctcctgcctcggcctcccgagtagctgggactacaggcgcccgccaccgcgcccggctaattttttgtatttttagtagagacggggtttcaccatgttggccagactggtcttgaactcctgacctcaggtgatctgcctgcctctgcttctcaaagtgctgggattacaggagtcagccactgcaactggccctaatagacatttttttaaactaaattattacactacagaaaaatgcacacatcataagagcacagctcgatgccttttctcaaagtgtatgcacttgtgaagtcagcctccagatggagaaagagaacatcattagcacccaggaaacccctcttggctcctcccagtcctgaccacactaaggcgcctccatctccacttccatccccagagatggccgctgctcggtgtggtactttatgcagacaggatcaaggatggtacactttttggtgcccttttttggcttgactcaacattatgcttgtgagactgtgttgcaggtagctgtaatcttttttgttgctgtagagagtattccattgtttgactatactacagtttgttcattctacccctgattggcatttgtgcatttcatttttaaaattatgaataactctattagaggcaactaatggctcagttttgctccttgctctgcaaaccaaccctgcccataggaactgaacttgtaaaggggcaggtgacgtattttagtgagaaccttccatggcgtaacctagtagaatgcctaatgttggaacctcgggcatcacagctggcctatttattttaaataaatgagttcatgaataaatgaaggaataaaggaatgaatgagaggaggggtaagtgactaaatgaatgcatttctgggaagagcattattgggtactcacctgtgtcaaacacctctggtcatcttcataaatgctgccatatgtaatccttgccacaaccctttgagatgggatggctaccttgattttacggatgaaaaaaataacaaggctcagagaatccaggtcatttaactcttctgagctctccattttcccatgtacgaaatgggtgtcagtagagctccgcagattgttgagtgggtgagggggtgatacaaagcggtcagcagttctggcacaggaaagcgctcgcgaacttcctgcgcatcattattctggcttgtgctcatgtagcctgtaagtggcctggccaggatttgaacctacagccttccatcatccccctgcacaactcctgccaccccatgctgcctgcctctgggagattaggtgagcaaaggggtcttggccatgtctttccatctgaggcactcagtacagagggtgaggggtccctgagccacctctgctgcctgccctaactccgggctgtgatgaagcagctctgttggatgaagcagccctggctccgatgctcttcctcccctcaccttccttacccaaaggatgaggttggaatacaattgcagtgtctgtgctcactaatttcattttctgtgtctggagtaataggggccctcaaacttattatgcttatttgaatttcaataataagcagccaagcgggagactggcatgggggccggggccgtgctctgaggaaggcctggctgccccagctggggaacagctgggtgcttccgaggagtggccttctctcccgggagctcggggttggtcagctggtcagctatgaccaggcagaagctgacactgacctgacccaacctgggcaggcctaggagagctcgtccccagaccttcaccttggagaaccaagtagtagtgagaacagtgccgcggggctggcccagatcatcggtcctttggacgtcttcttccataaatgagtcatttatatcacactctcttgtcaagaggtggaagtcagtttccaatggggaccaaattggccctaatttttgttcacctctggtactgagaggtaaggtgggggtgggtgacattttcaaaggggctgtatccctaaatgagataagaccactcccttgtgggtggagacacccttagcccaaaggcttgagtagttgaagagctgtaaacagtggctaccaggtgccccaggtacccagacgatgagcaaagccccagagggatccgaggaggtgacaccagcattttcccctgactggttctcgccctcagcctgggaatgtcgctgagtctttggttcttccagagacctgtcttttggctgccagcctttgcatagtgtccactcctgtatctaattctcaggagactgaggtctggcctaggcgggtctctcctccgactcagttccatgcactgaatttgacccctgggcccagatcagacacagggtctttccacgaggccctcacagaaggtggagctctgagcggtgtttttcaaacaggattttaatggtgcagcaagaaaagaaagactccaggatgactgaggtttaggcgtcactgggttgaaacggttaaagaggcttccttcctgcagggctgctcagagcctttattggccgctgtattgtgtgttcacacacacagagatggagactggagcttttccccaacactcagatctttgtttcccagaagcctctccagggagaagagcccagcgtttcagaaacgctggcttgaaggagccctgggagcctgccccccagtttctctgtagcctcacgattgtgctttctgctggtgagggaggtggctggaggtgggaagcgcccaggaggcccggctctccttgaggacacagctctgctcttaccctttgtgcttagtgcatccccagggccctcgggggaaagtccagccccctctccctgcccctccaggccctctgtgatgagtttcttccctgctcttgtgtgatttcctgtgtgcgcctacatcccaggcaaaccagggggttcctgctcttatgggctgccgtcttctgctcatgctgggctcagcctagataccctcccctacgccttgcacatagttcgggtttcacctgagctgcacccctttccaggaagccttcctgattgtcctgtgctagcttttcatttcactgctccccagcattttgtatcaaatccaaatgccttctgagctgacagcatctcactccctgacaagatgtgggcccctggggagcggtgccaaagtctggttaatcccagggtccctgctgcctgcacggagtggtgctgagtggagactccaggaaacccaagagcttcacctcgggcttgccatcgggccctgcagctttgagcaaatcgaccgaaggtgcctactgtgtggaacccagcaaggggagccatgcagaccagggagaggaggctggcatgggcaggggctcctccctagaggctgcttggatttaaggcggttccctcatgcccagctcctctccttccttcccatattcaccatagaggtttgggtcccctctcccctctgcctctgccccaggaccacccgtgcagaccacccccgcctgccagaccagtctcagggcatctgatggcttccctgcctgctccgcccacatctcaggccaaacccctggacgtcaggacactgcaccatgcagcccactgtattttcagtctttcctggagccctgcccccgccaggtgagctggctgctttcttgggaagccaggaccttcctggccacctctgtctgccctgttgcctgcgcccctgcagtgctcccaccaggctttctgaagctggcctggccctgagacccccagccctgcctctctgtggaattgtttcctagctggtcgctccgtccttccgagcctccctctttggggctgcagaaagcgtggtctgagctacacagcactgagctccaccctgtcccaggctggtagttctttttttgttttgttttttgacacagggtctcgctctgtggcccaggctggagtgtgcgtgatctcagctcactgcaacctcccagactcaagcaatcctcccacctcagcctcccaagtagctgggaccacagacatgcaccaccatgcctgactaaatgtttgcatttttggtagagacagggtttcctcgtgttgcccaggctggtcttgaactcctgagctcaagtgatccacttgtctcgacctctcaaagtgctgcaattacaggcatgagccactgcgcctggcctggcggttctttattagcacaggtccaagactttgacttccttattgcagggcagatatggatgtgtgtgtcatgacctccaccacccgcgtgcacgaggggcacagcctcttgcaggtgtgtcacgtggcaacctggaccagggatctccccagcccagtgaggggccagcctcatctccattctacagatgagaaaaatacatacactatttaaaaacacttctatccaacacagccacacacacacattcatatgcatactcacacatgctcactcatgcactcacacatacactcacactcatgcacacacacacattcacacacacacacacacattcacatgcatgctttaactcgagggaaatgaactcacaggactctaatttcctgatgccataggaagaacaacgggcattcctgtcatgtttttcatgggaagctgattcagagaggctaaggggcatccctaacgtcacacagctaagaggcaaggctgaggtttgcacttccactgctctgacttggaagcccagtgaggcgctcaaattaaaattagaaaccttttcctgttgtccaggcagaaaaccgggagaggggagagaacagccactagggcgaggacagagcgcagccactgggcagccgggaaaccgaggcttgcgcctggctgcagacttccctcttcaggcccttctggcaccatctgctccagaacccacagctcccatccgccgctgcctgggatgaatggtgccctgtcaacagtgatacacctgctgtttagtgggaagagaggtgccaagagtgcacgggatgcccgggtgcacagaggggaggagacagggcacagccgagctgccaggccaggcacaacttcttgatgaatagagaggtgtggagccgcccgtcgttcatgtcgattctctcagtcaatcaaaacgctgccacagcaggctttgggatgcggcgtctcgatgtgtgtgggcgtgtgcagggcggttgctgatattagtcatgagcgctggcccaggaatcagagacggggatgagtctcagctctgccatttcttggctgtgtgacgtctgggccttgatttctccatatggagatagagaaccccttccttctctgtccccagaaaaagtgccggccacactctccttggcctgtcaacagcgatgcacccgctgtttagtgggaaaccatcttccttcatgaggtcaaagccctcacttttttctgggagggatgactgtgcaccgtgagttagccttagagtcaggcccaggaagacatcagccacctgcacccccccgccgccccccacccccctgccgaggcctggggagtcacagctcttcctgatcttgctgtgtggcctcgggcagggcgtttgccctctctgggcctcaggcactccatcttgacaataaggccattgcacttgctattcacattgggccacctgtgccagccatccatgacaggggttctttaggtagagacaaatggcctgcaggggcggggacccccggggcatggccgtccactgcaggtcccaggaggagccccagcctggctggctgcttccaagaatagagtagacagagtctgcacggggctgccagtgggccactcctgcacgcagggccccgggccctgagctcatcagtgaagcaggtaattatgtgtgtgctttgttcctgcacaaaggcactctcagagaacttccaagaggctctgcttccttgctgatttgattttttcagaactggagtgtgaaagtcaagctgaacctgcttaattgtgcctgcgaaggctattcagagagactgctcttggaaagaaatcaggacaattagctcttggctgcagggagagggggagcgagcgcttgatggtgaatgtcagcctgttcctgggagaaccaaagggcagagctgggcagagtggggaaaagacgggcgggggggtgggggggcatctgtagctgtctctggggctggggccaagcccaccacctgcagggggcaccaagctccacatgtgggtgtggggcagccaggctgggagcagaggccaggtccgacagcaagctcagggccactcccctcagtccagtgagggttggttgtgtgatcttgggcaagtcacatggccctctcggcctcagtttccccgggtctgcaaaatgagtgctgtgcagaatgagcagatggagcccactcatcccgggcagtggcgggtgggaactatggggtccacagcagatggtgccagaaaggcctgaagagggaagtctgcagccaggcgcgagcctcggttccccggctgcccagtggccgcgctctgtccctgccctagtggctgttctctcccctctcctggttttctgcctggacaacaggaaaaggtttctaattttaatttgagcacctcattgggcttccaagtcagagtagtggaagtgcaaacctcagccttgcctcttggctgtgtgacgttggggatgccccttagcctctctgaatcagcttcccatgaaaaagatgacaggaatgcccgttgttcttcctatggcatcaggaaattagagtcctgtgagttcatttccctcgagctaaagcatgcatgtgaatgtgtgcgtgtgtgtgtgtgtgtgcatgagtgtgagtgtgaatatgtgtgtgtgcatgagtgaacgtgtgtgtgagtgtgcatatgagtgtgtgtgtgtggctgtgttggatagaagtgtttttaaatagtgtatgtatttttcaaccttttttgaatggagcccagggtgtatttcccaaattctttttacattattttaaagagaggcagcagagtgttatgacagagaaccagctatggagctggcctgagtctgcatctgggctccacctcaccagctgtgtgtgaaaccactttgttcctgttttcttatttgtaagtagagatcatatcatctatccacatctctgcctaggtgtgtggacggcttaatacacttggaagcctcagaacaaggactggcagtaagtgctcaatacattttatcatcattgttatttttgacgctgagggtcactgtaacgaccaatgaaccagccagtgaagtgggatgaatccattcaggagcacacagggctcgggtgcactcagtgctcacgggcgaagtgagcaggctggcatctgtttggattggtctctgcttgaaccctgttagttgttaaacagtttgaatgccatcccagggtagaagagacagaaacttaagggctacttacagatgcagggactaggggagggatgtgggtgtggccagagaatccaaccctggggaccacccatttcctatctgggcggccagggccctgcaggaggtgcccccgtcacttacaagccagggcccccactgcccctccctggtcctgcagtccatctgggatgtgaggctactcaaccaagctcagtttttgcagccaggcgcacgggggaaggctgccactggctgccatcaccgactgcgaggggttcctcattctcagctggctttaccctttgctgctccttgaataaagtgttttgaattctgccgcacagaggggaccccgctttactcttttggtttccttttgcccgaacacagctcactacagcctcaacctcttgggctcaagccatcctcccaccttagcctcctgagtagctgggaccacaggtgcacatcaccacacctagctgattttttatattttgtagagacgtggtttcaccatgttgcccaggctgttctcaaactcctgagctcaagcaatccggctgcctcgacctcccaaagtgttgggattccaggcatgagccactgtgcccggcctcttttggttaccttcatcggaacacttgcagggcctttgagagaccccatcaaacacgtttccctttgggcacctacactgaatcctctgggatgaaatttcagccaggagagggactgaagtagagtcacatgtggggacctcccattagtgggctccgtagctgacggtcccaggacaggggccctgtgtggaaagaagggcagacctaagggaagccaacaggggtgaggaccacggcgcaggggccacatttaaccggctggggaccaactgtttctaaggcttccgccgctcagctgggcaaaagggagataaatattgtaaagtttacgggaaataacagttttaaacaagctctggaagtgtaatgtgcccacaggcattcatcatcatcaccgctctcatcctctcctgggtgaccagggcgatgaatgacccaaaacaccacacacgaggaaaggcaaagagatcagagactggttcacccagagagaccgggatgctgccttccaaaatggaagagctgtgctggaaaagctgcatttgactcactggaataagtgcaggggtccagggcctgctgattgcttcctggtccctgtgcacatgccccgtggtgactccgtacagtgcttcacagatcttttgctgaggagctggggatgggcagggaaggaagcctggactgggtgcctagaagctctgggcagcagccgcatcagaggcttttgaaggcaggaagggcagccagcggcccggaggggagcacagcagctgctggtgacagcttgctgggtcgtcacaggggctctggacggtccttctgccccgaggtttggcttagcttggtgagggcagcgtggaggacaccgttccatcttaatgcctttccaataaagccttgaagacgacaggccccatttcctgagcagagctgaacagttactttacacttcatctaattgattaaaatgactcctctaaattaaccaggccttccagagctgagtgcgggagagtgaagtccagagaccagagccggctgcaggggcaggccgggggcccacagcccttctcccgggccctgctgtccaccagccctgctcgcaccccaggttcctggtggccgatgcgcttaggtcagccgactggcttctgtgctctgcccctgaacaccaagctgccctgaacagagcctggtctctcagggtgagggtgggtcagggataccgcgtgtgctccctgctgtctgcgtccgtgtctggcaaattggtgaggggtcaggcatcccaggtctccttttatcttccacactgcccctgggggtagagaattatggtcccatttcacagctgaagaaactgaggcccgtctgcgatgcgtagctagcaggtgcagaggcagggatcaaggctcagcctgttgcctgcaaagccctcgccctgttccctatggcgcaccagctgcttggatgctcccacgcagcagtgccttgtcatcacattctatttgctgagcggcgatggaacaggccctgcgtccccgcctgtgtcctaagcactccacaagcatgagcgtgtctagatggtgatggtttgctcatggtctctctctcagagcttttaccctggcggggttgggagcgtggcaatgggtcaccactgaccctgttaggaaacaagtgtgtctgtacgtgccacttatgatggggacaggccgtggtcactttgctggggccagtgtcagcaggatggcagatgctttgagaacacggctaagaactctgccttctggagcaggatgtcaaatgctgtttgattcaggcatgtgacacctgtcaagagccctggcacagctgctctcgagacacgcctcgactgccactctcccacccctgcgtggcaccctcctgactgttttatctgccttggtttttctgggtctggtgtagcacctgccccataagaagcgctcagtaaatgattgttgataaaagattgaaccaatcaaggaatgatgagccagtgaagggcaaatgactggaagcaaaaggccctcttgatggaattgggaagaagctgatccgagggcccaggacagccttctcttgaatgccctgctgctgaggtctcactgctcggcttggactcgcctctcgccctgcctggctgcagaggacaaacagtggggtggtgggtgtgtgtccgtgcctgtgcgtaggatgtggtagctggtgagtgtcagggctctgcacgctgcgccctgccttgcttctttctctcctctcaggctgtgtgtagtcctgggccaggttttttcagcgggcgtggtggtgggaaggtcctctgtcccttgctcatcctgtgtcctggctcttcctccttgtgtcttctctctgggccaggaggaagtggagaggtgggatcagggccgatgtccccagcctgggtggcagtgtactggaccatgggttcccacccagaactcttcatggcagagacctatggcctgcctgtcctcatctgaagataacttggccgttctgatttctcttcccacacaaggccatggtggctgcctctgagatttaataagcccttaggtcaaatgtctgcttggccagaggaattgtctcccgggctttcttggagacagctctaaagcatgcaaactatagtgtcaggaggaaaagctcttcctctacctactttgttctgtgtttgggggtctgagaaatttaacagtcaacagatcaacagtagaaaagacaaaggcttttctgttttttttttttttttgccttaagcaaaaatcctgctaggttggtttagccagagccccctcattcctggtgtttccccttagtagtttttcctccactgatccccaccctgctccggctattaattcctacttttccttgctgtatatgtggctgagcccaacctctctccccaactgcagaatcgcatcacagtgggtcctatacctaaggcgatagttccttccccccacccctgacacccccaataaaatgtgccttcttaccatcattaacaagcatcattgaataattttgatttaatagcgggttcgagagatctcctccatcttcatcctggcagggcttcccctccaccccagaaaggaatttatggcagtttcgctctgggcctccttcctgggagtgaagctgcctcttcttgaagagggggtttatggcagcctcactcccagaagtttctgcttttagtcagataagggaaactccaaaaatgcttctttctggatctgttgaatctcaaatgtcttcagtttaaaataatcttgataccaactctgggggttggggtgggtctcacaccactctcctatgcatccctacctgctaaaaagatgtgccggctctggcctggccggctcctccaccttccagccacctgtcctgtttattcatttcttccctctcttttctccttttcttttccatttatccagtcattccttccttctacccacccaccaacctgatcacccactcattcttctctccttcaatccaacctttcctcagtacccaacctgtgcaactgtaccatggactccttcaggcagtggctcccaactcccatcacagagcaaatgctcaacacacacccgtgtttcatctgttattcaacaaacactgatcacttgcttctcttaattattattataatatttatttatttatttagagacagggtcttgctctgtcacccaggctggagtgcagtggtacaatcacagctcactgcagcctccacttcccaggctcaagccatccttccacctcagccttccaagtagctgggactacaggcacatgtcaccatgcccagctactttttgtatttttttttttttttgtagagatggggtctcacagtgttgcccaggctagttttgaactcccgggctcaatcctcctgcctcagcctcccacagtgctgggattacaggtgtgcgccactgtgcccagctgcttctctttgtaagttcccaagttgaagcacccccttcaggtgtagttttagacgtgcaacatgaggggaaatcttaggttaattgctgggtccagaattgctctgaaagacaaagactgtctttgttctagaaaagtgctcataggcgctgtgaaggccttgatgtcctctggtgccaacgcaacagagaagccagcaaaatgctctgcatgggacaggttctggtttttgctacagagactgtaagagatgcaaagccaggacggtgagggtgagctggggttggggaggcgcaggggggctccccagcagagggagggcatttgaagacggcggctgctccttggaagctggcaggcacggccacagaatatgcgcccctttcctggccccctcgaggtctgcacagccctgagtgctcatgccatgaaaatgagtgtctctgagtttggagagctggcctccgcactgggcttcctgaggacgggagcaggagcaggaggctgaggccaggggggatggcagcccccggggatctgaggaagtctgggagctggctttgaacttctgcccacgctggaacttggggagaagagggagatgtgagtcaggttttcctagttcctgagggcctgggaggccttggctggcatcccgtttacatagcgagtggccccacctgatggttctgatccagattctggtacccgagtgagctaggccacgggagcagctgatgcccctgctgtccctgaaggcagcatgggaggcccccgggactggggctcaggctttccagagagaaggaggtgcctttccctgccaacttcctagctttaagtcacgctccggacatccagagtgagcacctgcacctgccagaaccccttgagccgcctctaccttccaggatgacccattcccagttttcccaattacctttcatatttcctctttggaaatggaatttgattttgaggctgagcaggtggctggagacatagaacataaatatatcatgacttgggagttgacttgcttatcatggaaataaatgtcctccctcctcaagaagcggtcacttggccaggtcactttgatcttgccccgtggtgaaatcagacggtccctggctcgtgggcgctggaaccaggggggaatttcagggtgagtcatgaatgctagggggcaggggtgaatgggctgtaatgtcagctttgttttcctgtcaggcgagagagagagagaggaggggaacaagagagaatgatgccaaggaggcgcctgggcagctgatgagctcagccccagggtgactgcggtcatttgggtcggcagtggggacagacatcagccccagctgggtcatgggtcatttacggcctgggtctccccctctcctccctcctccttctctccaacctgctttcttgctgctggaagggggtgtgcaggctcccgtgtgcctggcacagcaggggcagcacaggagactccatggggcctgtgtcccgcacccccacgcccccgcccccagccacagccctttgagagcacagcggaatgaacgcctgattaggaatcagatgccagaaagaagctgtgtctgttccaaaatcaagagaccaggagaagtgacgtcctttaaaaggagagagctaagtgacagagagggggcttgtccccagcccaggcacctcggggctgcaagctcctttgagatgcggggctcaggcctcatcaggggaaacgtgggcatctagatgaccctccacactgagcagacccagcacaggctgcgccactcatcattataggctgcgccactcattataggctgcggggcctgcacagaccccaggcatcgagcctgcgatggggcaacgtgtggtgtggaggccatacccctcctctgctggctggcagcttggcccagcctcctcactggtgaacagtcagctctgccccctgggctgtcaggaggattaaatgagataagacaaacacagagcaactccttgctaacagccatgcagtaccaagcaaggcacagcaaagggaaagagaaatccagtggcaccagtgggctgagaaactgtcgggtttggctgctgctgttgtctgcatctcccgccttcctcctgagccgtgcttccagggcagccccggcccttcatgtcagctggtgacatttctgcaattgttcctaaagaggggcctgtgggtcgagtgagctaagcagggcttggcaaggtggtgtcccccggtcagtgccagagtctccctaatgtggcctgtgagacagagctgatgctgaacaaaggaacagggtgatctgggagcagcagcagccgctgtcctgagcatctgggtcaggacgacacggatgccaccccaggacccctggcatagggagccgagcagggcagccgggcagaggcaggaatgaatcctactcagctgcagaatagtcacagacacctctccaccagcaacgtccctgaaacagtctttcttattaaaaaatattgagtgtcagttatgtgtcaggcactgttctggacacgaggtctcaggaacaaacaaaatatacagaaacttggcccttgtgttgctcaggatgaagaggagaagacaggagctgtgaggtgtccccacctgtccagaggctgggaaaacttaggagacggtgctgcttgtttagaaaaccgggcagaggagccctgctagtccaggccgggccagcgcccaaggatgaggggaagcacagctcctttggggtctgcgtgcatttgagcatgagtgcattaacagggggaacgtctgtgtttacagggcatgcgtttgggagccagacagacctgggctgagtcctgccctacatactaactagcctgctgtgtcgccttgcaaggggtgagatttctctgctctaagtcatgggtgctgaggcccacctgtctggcgagggtctgggggaggtcggatgagatgaaggaggctggggctggcaccgtggtggtccctgggctgtgcctgtttccctcccacttctgctgcctccatctgaccctgctccggagggaccaggggaggggcggacggaggacactgcttctgcagcgctccttgtctccgtcagtgatttataggaagctggctcaaccgagagctgagggaagacggtgaaggcccttttgtttttagttcaattttgtgagcagaatgctcctggggccaatagatttttccagtaatgaaattgtgaaaataattgaattatgcctttccagcttcaaagacaacctgtgccctttccccagccctccgcatggcattagagaacattcgcctcctgctgggtcggccccttcgcctcttccttctgtctgtcggtgcagcctctgaatagaatcctggcgaagggaggggctgggtgtgttgttgctgcacccaggactgcccacatcagttgcaaaatgcaatgtggggccctttgttgaaaaacaatgaagaatttcaagatggtggcagcagagcctgaaaccgagctcagggcccatctgagcaggggcccggtgtgaccacacggatcccataccggtgatgccaaccccctgagtcccggggaacagtggcaaatcagcactcaggaaatatctgttgaatggaaaatccagtttccttcgccgtcttccttgtctgtcctctcctgccgcctccattcaactttctcccttcttctcacagcactcggcagtgtggactctggctgcctgggttcaaatgagctcaccacctcctagttgtaagctcttcgacaagtgacttaaacactctgtgcccagttttccgcatctgcaaaatggggagataaatagcccctacctcctaggatcatcatgagaatgaggtgtgcgaagcttggccggcatgggttccatagcaggcactcaggggtgtcggccacgaagattattctttctcttctctctttgccgtcttatttcatctctctccgttatttggttcccctgtccttagtcccctttctcccccaatggcatcccaagatgcacaatagtggcaagtgcccagcctgtttccacagcctgatccccaccactgcgttggccagtcacccaagaagcagctggacccatcatctggctctagggatgacccagttccagcacccccgcaaacctccgtctgtccccctacctccctcagcagaggcccagcccaatgcaggcccgtggctggatgggagtagctcttcccaccacccctgggcagggctctgcggagcttgggagcctcacctggaatcggccctcatgcctcagtagagaaggagagcgaggagagaggtgatggggctccgcgggcacccccgatgcacagtctccttctgggcttctgatggccacaaggccagaagacctgcccagaagaattcagtataacccagttcagtgaaattggagagaacgagggcctgcgtcttccgggcagaaggcagggttcctgccctctggagcccttggcctggcgcgggctgattaggacctagatctgcctgggtggctgggtggccgagtggcgattgggctggttctgtaccgggtgtgctccgtggggggcgtgatctggcaaagccttggaggtgggactgtggaggcaccattgattgaactgtgtcccctgcaattcacatgttgaggcccaaacccccagtgtggctgcatttggagtagggcagtaattatggttaaatgaggtcgtatgggcgggtgctgatccactaggattaggatccttataagaacctgccaccttctctctgccacgtgaggacatggggaggaggcggctgcctcccacccaggaggagcccttactggacactgggccctggctgcaccttgaccttggacttctagtccccagaactgtgagaagtagatttctgctgattacgctttcctgtctgcggcctgagctaagacagcagcgcttggggagaagcagaatttgaggagctcctcagtggcaggctgccctggccctgctgtcagcagaggggaatggccatccatgctggcccctcaccagccgggccttcagtgagctccccgggtaggtgaagctctcccagctctgtgtcccccgccaaagcaggcccacaagcgagcgcctatggggtggagtgagagtgaggaagaaacattacccgaggggtcactctcttcagaagacctcaatgactgtagactactgaattatttccttaaaaaaaaaaaaaaaaggctaggtatggtggctcaggcctataatcccagcactttgggaggacaaaggaccacctgaagccaggagttccagactagcctgggcaacacagcaagaccccatctctacaaaaaatttaaaacttagccaggcgtggtggcacatgcctgtaatttcaggtatttgggaggcagaggcaggaggatcacctgagcccaggagctagaggctgcagtgagctatgattgcaccactgctttccagcctgggtgacagagtgagactcaaaaatggttaaaaaaaaaaaaagaaaaaatgttgatagctactataaagtttctcttatgcagtacctcctcattttacaggaaatttggagatagggaaaatagaaagaagaggaaaagatgcccaaatatacccagaaagtccctgctaacatgctgctgtcgtccttctattccttaatctaggcatgtgggcttttttcttatttaaaaatgttgatttagatataattacatgcagaaaagtgcacaaatctgaagtctgcagtttgagaagttttagacatgtgcatactctgcaccgaccacctctgctaggatatagagcatggccagtgcccagagggcaccgcaggccctgcctagccacactcacactctcttcagtaacccctcattctgattctattgccatagaatagtttggtctttcttaaacctcatataaacgaaccatgttgtatgtggtctttgtgtctggctgttttttcccctattttaaaaattgtgttaaaatacacataaactttatcatcttgaccatttttaagtgtacagttcaacgttattaaatacattcataatgttgtataaccatcactgccatccgtctgtagaactcttttcatcttggaaaactaaactccatactcattaaacactaactctgtattccctcctccccgcagcccctggtaaacaccatcctaccttctgttcatatgaattaaaaaaaaattttattttagtttttgagacagagtctcgctatgtaccccaggcgggagtgcagtggcgcaatctcggcttacggcaacctccgcctccccggttcaagtgattctccccatcagccctctgagtagctgggattacaggcacacaccaccacgctcagctaattttttttttttgatattttttaatagagacagggtttcaccatgttgaccaggctggtctcaaacacctgacctcaagtgatccacctgcctcagcctcccaaagtgctgggattacaggcatgagccattgtgcctggctgtgtttcctatgaatttgaccattctaggtacctcctatgggtggattcatacagtacttgcctttttgtgtctagcttatttcacttagcataatgtcttcagagttcatccatatctgtagcatgtctgaatttctttccttttcttaggctgaataatatttcattatggatatcatggcatgttgctcatccattaatcaatcagtggacactgggtagcatctgcccaagttttagacattgggaataatgctgctgtgaacatgtgtgcacaaaataactcttcaagaccctgttttcagtttttttgggcatatacccagaagtggaattcctgatcatatggtaattctacttctaattttttttctttttttagatggagttttgctcttgttgcccaggctggagtgcaatggcgcaatcttgactcactgcaacctccgcctcccgggttcaagtgattctcctgcctcagcctcccaagtcgctgggattacagacatacgccaccatgcccggctaattttgtatttttagtagagacggggtttctccatgttggtcaggctggtctcgaactcccaacctcaggtgatctgcccgcctcggcctcccaaagtgctgggattacaggcgtgagccatcgtctacttctaattttttaaaggaaccaccacactgttttccacagtggctgcatcattttacattttgtatctggtttcttttgcttaatattggtcagggagattcatcaatgtgtacagcacaagtttgtttctttataattgctgtgttaaggattccattgtatgaacaaaacacaatctattaattcccctattgatggacatttggattgttgcccactgtggctattatgaataatgctgtcattaaccgtcttgtacacattttctggtggtcataggcacctgtttctcctgtgggtatatttgggaatggaattgctgggtcatagggtaggcaattgtttcactttagtagatattaggtgtaaattttgatgtctttaaaatagtactgattgagccgggtacagtggctcatgccggtaatcccagcattttgggaggccgaggcgggtggatcacctgaggtcaggagtttgagaccagcctgaccaacacagtgaaaccccatctttactaaaaatacaaaaattagctgggcgtgatggtgggcatctgtaatcccagctactctggaggttgaggtaggagaatcgcttgaacccgggagttgaaggttgcggtgaaccaagatcgcaccattgcactccagcctgggcgacagagcgagatttcgcttcaataaaataaaataaaataatagaataaaatagaataaaaaaaaatatggtactgatcatcacataaagttttgaggtctgcctttttcacttaacattaaatcattactatttttaagttagaacttttattttgagataatgatagattcccatgtagttgtatggagtaacacagagagattcagtgcaccttgtacccttttctcctgtggtaacatcttgtgaacctaaaggcaatatcataataactatattgatgttgattcaatgtcctcagatctccctagcttcctttgcatccattcgtgtgtgtgtgttcctctagttctacacacttttatcacctgcacatatttgtgggtccaccaccacagttccaatgctacaaggatccctcctgtttgcttctttccttttccttccttccttccttccttccttccttccttccttccttcctctctccctccctccctccctctctctctctttctttctttctagctgagattacaggcatgcgccatcacgtctgtttaatttttgtatttttactggagatgaggcttcactatgttgaccaggctggtctcgaacttctgacttaaggtgatccacccgcctcagcctcacaaagtgctgggattacaggcatgagccactgcgctcaagctttttttttttttttctttagacggagtctcgctctgtcacccaggctggagtgcagtggcgcgatctcggctcactgcaagctccgcctcccaggttcacgccattctcctgcctcagcctcctgagcagctgggactacaggtgcccaccaacacgcccggctaattttttttttcgtattcgtagtagagacggggtttcaccgtgttagccaggatggtctcaatctcctgacctcgtgatctgcctgcctcggcctcccaaagtcctgggattacaggcgtgagccaccgtgcaggctttttttttttttttttaatgtgaagtctcactgtgttgcccagactggagtgcaatggcaccatctcagctcactgcaacctccacctcctgggttcaagcaattctcccgcctcagcctcccaagtagctgggactacaggcacctgccaccatgcctggctaatttttgtatttttagtagagacagagtttcaccatgtcgaccagactggtctcgaactcctgacctcaggtaatccacctgtctcggcctcccaaagtgctggaattacaggcatgagccactgtgcctggccacccctcctgtttgtttctaacacaatcatctacccccagcctctggcaaccaccaatctgttctccatctttatacctttgtcaccataagaatggtctgtacatggaatcaagcaactagtaaccttttgggattggctttttgcagtcggcatagttctctggagagtcatccaggttgctgtgtgctgtgatttgaatgttggtgccctcctaaattcatatgttggaatctcacacccaatataatagttttaagaggtgggacctttgggaagtgattaagtcacgagggctgtgacctcatgagtaggattaatgcccttataagagaggtgaagggagtgccactgcccctttaaccacgtgaggacacagcaacaaactgccgtctatgaatcagagagccctcaacagacaccgattctgctggcaccttgatcttggacttcccagcctccagagctgtgagcaataagtttctgctctttataaattatgcagtctagggtattttgttatagcagctggaacagactaagacactgtgtaccgatgatttattcttttcgttactgagtggtgtttctggatttggacataccgcagtatgtctggcattcatcctttttttgtttgtttgttttgagacagagtctcactctgtcaccaaggctgcagtgtagtggcgcgatctcagctcaccgcaacctccacctcctgggttcagctattctcatgcctcagcctcccaagtagctgggattacagccacatgccaccacgcccggctaatttttgtatttttagtagagacagggtttcaccacgttggccaggctggtctcaaactcccgacctagggcatccacccgcctcggcctcccaaagtgctgggattacagatgtgagccaccacacctggcctgacattcacccttaaaaggacatttgagtgctaccagtatttgcctgctttagtaaagctgctatggagactagtgtatagattcttttgtgaacttacattcacacaaaaatgcagttgctgggttgtgtggtatttgcctcataacttcagatgcttcttgactcacaacatggttacttcccgacgaacccattgtaaattggcagcgtggctgagtgggagctgcatctctctgcctctgtccagcactgtgagggaagtacagtttctattgaatgtgtatcactttcacaccatcataaagtcaaaaaatcctgagttgaaccatcataagccagggattgtcagtatttttagaggagctcagggtcataggttactctgccagttacatattctgatgcaaacgttttctgaagcctttattattatgacattctggggacctccataccccttatttttggggattagagcttccctctgtctaatccagctctagagccacctcctcgggaagccctccacccagagccacctctctgtgagagcggccccaccaatgactttcctgtgggatgatggagccctcatgctgagcagaggttaatgccatcccacggctcccttcccccagaggaggtctgggtctcagctgaggcttacagcctaacacatctggctccggacatactgggagctctttacctgagggtgtccctgtcatgtagacagaggcttttgagaaaataaacagtcctgagagaacctcttcgtcctgggggaagctggcttggtctggtgaagacttgttcacttgcttccagcagaaaataacttcgctgtgagcctggaggttattataactaaatcattctgtgaactacacagacaggctgggcatggccattgtatttccgtcaccctggagagaaatctgtgaccaaatggttaaaaaaaattccaagtcattcattattcaccctcgctgcataatgcatgaaggctgcgggccaggcccatttatgttttcaacattggcatcaaatgtcagccactgcctcagagaggcccacgagggccttggcactcgtggttggccccttctcccctctggatgaacctcaggcctccagggctcctgcctcctgctcactaggctctcagcctggatggtccttctttctcttcttctatgaagccctctccatcctttagggcttagaaatcatctcctccctgtcacctgccagggcaggaagtcatcctccctctctgttccccctgtaacactttatttttatttatttatttatttatttttttgagatgagacggagtctcactctgtcgctaggctggagtgcagtggcatgattatggctcactgcaacctctgcctcccaggttcaagcgattcttgtgcctctgcctcccgagtagttaggactgcaggcacgcaccaccatgtctggctgatttttgtatttttagtagagatggggtttcaacatgttggccaggctggtcttgaacttctgacctcaggtcatctacctgcctcagcctcccaaagtgctgggattacaggtgtgagccaccgcacccagccccctgtggcactttagagtattgataaccaccaccactgtgatcataactagtatgatttatatagtttgtattctctgctggacacttaactcacactatctcatttaattctcataatagccagtgaggcagatattctatttctcaattttaagatgaggaaacaggcttagagtggttaattaatttgcccaaagacatgcagctagcaagaggcagcatattgcaatttgcctgcaggatggtagcaattgtcatcccttttcttctcaatcattctcaccagaaatgtattagtttttgcagccttttcaaggaaccaactttaggtttcgttgattgtctctgtttcttagttcattacatgtgtatttttatttctagtcctgcttgcttaggatttattttgctgttccttttgtaatttcttgagatagatcttagtgcatttgtttttaatcattcctcctttctccagttcaggctggtcttgaactcctgggctcaggcaagcatttcaggctagaaatttccctctgagtactgctttggttgcatccctgcacatacaagttttgattgtaggagtttattattccattgaaaatattttccgattttcctggtgatgtccaggtgggattgtgctcaatctgacagactgcacagctctctctctctctctctttttttttttttttttttttttttttaagacagggtctcagctctgtcactcaggctggagtgcagtgttgcgatcatggctcactgcagccttgacctccagggctcaagggatcctctcacctcagcctcccgagtagctgggactacaggagtgagccaccacatgcagctaatttaaaaaaaaaattgtagagataaagtctcactatgttgcccaggctggtcttgaactcgtaggttcaagcaatcctcattcctcagcctcccaaagtgctgggattataggtgtgagccactgtgcctggctctttttatgatactcttttctgacattgagcaaatcattttcatgtctgtccctcccccaggatcagtttgagaccagcctggccgacatggtgaaacactgtctctactaaaaatacagagactggctgggtgtggtggtacatgtctgtaatcccagctacttgggaggctgaggcaggagaattgcttaaacccgggaggcggaggttgcagtgagctgagatagttccactgcactccagcctagcagcctggacgacagaggaagactctgtctcaaaacaaacaaacaaacaaacaaaaaaaaacccaaaaaaaatcccacaaaaaacaaaactatgaactaggtggtctagaaacaattatttctcacaggtcgttttaagccactgagtttgtggtaatttgtcacagcagccctaaaaaataaatatacacagttttaattgaagttgggctaagaagctggacgctagtcccagctactcaggaagtggaggtgaggggatcgcttcagcccaaggagttcgaggctagcctgagcaacatagcaaggcctcatctctaaaaaataaaaattaaaaattgggttaagaatttagcagctagtccttaataggatgagccatgaggaccggcagctacatatcagtggtttgaagcaaatggttgccaagtcgctcctctccctcccaggtcatcaccgtgacatccttttgtccagtgtccttccctccagggtagctcaggttaggggaaacagccaacacatccatgcaaggaaataaatggccactcaaacgcagactcttttaaaagtgggagagtggctgggtgtaatggttcatacctgtgatcccaacactttgagaggccgaggtgggaggactgcttgagcccaggagttggagaccagtctgagcaacattaggaagaccctgtctctacaaaaattacaaaaatgagccaggtatggtggcgcgtacccagctacttgggaggctaaggcgggaggatggcttgagccctggaattcgagactgcagcgaactatgatggcaccactgcactccagcctgggccacagagcaagactctgtctctaaaacaaaacaaaataaatagaaggaggagaggcgtgagcattgagagcatggccaaagagcggcagcactggctacccagcacttactagccacatctgggcctaaggattttatgtccctcaggactcacggggctgatgtgccatctgacccctctgagacctgtgggactgggctccgagcctctgggacactggaggggtggaggcaggtgtctgggcaacatccaataagaagcctgtgacagagtcaacagtggcaagagccctttgggccagcccggctcatcccctcctggctgcctgcccctccatggcaaggtcattttccttgattccgatcacagcagacctctgttgctctgtggctgattcattcagagaagcagggttctggctgggtatggtggcttatgcctgtaatcccagcattttgggaggccaaggtgggcagatcacttgaggtcaggagctcgagaccagcctggccaaaatggcaaatccctgtctctactaaaaataaaaaaattagctgggcatgatggcacgtccctggaggctgcagtgagctgagattgcgccaccgcactccagcctgggtgacggagtgagactctgtttcaaaaaaaaaaaaaggccaggtgcggtggctcacgcctgtaatcccagcactttgggaggccgaggcgggcggatcatgacgtcaggagatcgagaccatcctgcccaacatggtgaaaccctgtctctactaaaaatacaaaaacaaaatcagccaggcgtgatggcaggcgcctgtagtcccagctactggggaggctgaggcaggagaatggcgtgaacccaggaggtggagcttacagtgagccaagatcgcaccactgcactacagcctgggtgacagagcgagactccatctaaaaaaaaaaaaaaaaaaaaaaaaaaaaagcaaaaaagcagggcagcagggttcctagccccggctccactgccttttctggcttggggagacaaagcttggtaacatcaggactgcaaacatcctgccattagatcttggaccagcaccggcctggtagtttgctgtttcatcagggggcttgcagttcataagcaatcccttcttttcttttctcccaaagctgggaaatcaaaacaaaacttccttcccttccgatattcctctttactaaaaatttgcgtagccaactctcctgggagtggggggaccaacttggctcaggttggctgggatggtcctgtttttagcattgaaaaccacaaaagcaatgaaagtctcacgttgtgggaggccctgagtcctgggcaaactgggactgttggtccaaaccgtcccttccagaagaggcccacatggcaggccctttgaggcctggggcaggcgggacagaggcagcacccgcctggcatggggctgaggcctccttgcagctgcctcccggccccttgttctccttcatggctccatgcacagctgaggggagacatgaggtctctcggtctccatgggtttggggcaggcccagaatggccctgaatccagtaacaccaactgtccctggaagtgtcaccaccctggtctgggaggagctccatgaacatctcaaccatccacttcttgtgcagatggggaaactgagtcagaaagggaggagactgccttaagaaagattcttgcaacttgactttgatcctgtagagtgtttgtgggtttagaagagcacaggtctgaagatggaagacttgggtttcagacccgtctctgccctgtgcaccagcatgcccagagcagcactaacccaaagccaatctgacaaatgaacaagtcattctatttactggtttctttgatctatttataaaaatgaatatttatagcaaatcctgtaggatgcggtagatttggaagatttctgtgatgttttgtttgactaatgcttattttcccttttgtatcagtattttaacaaatgctttggatttcctccacgcagaggagaatcagtatgcagctgttaattttggctgctgactccaggacaagagacagagagagagcgtgaaagcgagacagagcgtgagagtgagagagagagagagaggcaggagaggctgagcgtgggagggagacagacggcatcgattcattaatatattcaaaactatattcaaaaactattcatttaaaaattctggaatatattgactacatactttaaaagacttttttataatgggaaactttgaacataggcaaaaatagaataatagaaaagcccagcgtgcgacatcagtgtcaacagaggtccatatgtggccagtcttgtctcagccttttccccacccattcactcctctcccaaatccggatggttttaaggtgattttagccatcgaattccatatgactctgttctcaagtgtactggatacattcttgaaaatactcttgaacatattcttgaggatgagaaattcttacaaatgtatattttttgtgcccctgtgtctccccttccttgcctttcaaactcctctctctgtccctttgtctcctttcccccacccttcacctcccctctctgttctccccagtctcccctaaactccaaatctctactctgaccctcagtctcatcttctgggtgaccgaagatggggcagtgcagcccctgctgagctgaccctcctttctgtccttcctcgtgccgaggttctctctccttgactgtttctcctagctgaagcagtaggctgctggacagaggcaggtccagcatactttgaatgttgttatgaagtccagtggagaagagctagcctaaattcggcagaaatcttcaatatctttaaaaaagaaatccctccattatggatcactgtaaacttgtatcagttgttataatcaatgaacacattgactgaattggccttttgatatattgacttagagctgtgtgattttggatgagccattttaccttttagagccccagtttccatctctgtgaagtggggaagtgtggaccatagcagtggttttcttttttctgaggcaattctcctgcctcagcatcccgagtagctgggattacaggcgcgcaccgccatgcccagctaattttttttttttttgtatttttagtagagacggagtttcaccgtgttggccaggatggtctcgatttcctgacctcgtgatccacccacctcggcctcccaaagtgctgggattacaggcgtgagccaccgtgcccggccagcagtggttttcaaactggtttcggaagcagattcattcttttcctagccaaagcctggtgaaccgtagtgtgtacaacagttaaaagcagagacctgcaggtccacaggagcagacgctgagaccagcctgcctggggtcaatgccctctaacccctctgtgcctctgctgttcatctgctgaatgggtctcatagttgagcagtggtcgagagatttcctggcatcaaatacatggaagggacttagcgtaggtcctgcttagcacatagtaagtgctcagcgaacttacttaccacttattacttaccacccctgcctgaagcagggtggggccaagggattggctggacctcagccactacccctcccctcacatggagccaggccccacctccacagattgggggcttggggacacgtcttctgtgctccatgctctcaggtcccagtgaggctgagcgctgaaccatccaagttggcagggccaggacaaggacccaggagctctggtgcccaggagtcccccgaaggggggctcagaggaggtgcgtgcggggctggtgccggtgcccccgaggcccacgtgcagccccgctctgtggggcctttgcccagcctcctggtccttgccagcgctgcatggcgtttcctgccggagtgctggtcactgagggctctcagacaaggaatgacccaggggctgggcccagcctctcccttgttccctgatgctgctggggccgctcctctctacccagcagaagggtcccgcaggaagatcagctctgaggttaattgtccttctggatagctgcagcccagttgtcatggaaaccggtcacgcagggctcggtagcaggaccctccttcctacctctgccacggtgccgcaggctcagagggggcgtgggagctgcatcaggtgatggtaagatactacagccattctccaactgcaggcacctggaaggagaaggtggcccggggccaactgtgcagtgagagaggctttttctgcgtctccccgcagctgtcttgttttcagcagtggccctgggggagatgtggacgctctgaggcctggggctggctctgtgtgtccaggtctgtgtgggggtcactgagagaagggaaaggcaggggatctggccccatgtggatcttggtggccctggcacttttttactctgagcccagccttccttgtgtgtaaaacagggattgtggtgcctacctcttgggcttgccctgcagatgggccgggctgagccacaccacagcggctgggcaggttcaggccccttctcacctctgctgtcctccagcaccatgattcggttgggaacagaggaaggcgaggagagccatccgcttcctgcttctgcagcattcggccatttgcccaatgctccctgatgccacggttctcaaagtgtggtccctgtccctggcctgggagcatcagcttcctgtggggactctagaaatgcaagttctccggccccacactagactgactgaatcagaaactcggggcggtggggtctagcgatctgtgcgttaacacatactctagggggttccgatgcccctcgagtttgagaccctctggtctaatgatttatgggtgagacactctgcgcctgcttccctgaggaccccgagctgcagccccagggcttccccctcccactttgggtgagtatgagcagggcccaggtggctggggtgcagtgggcagcccggtggtcctgcctggggtctggtgctccctcggtgtctgtcagctcgggctgctctagcagaaggccacagaatgggggctcacaccgcaggaatatatagtctcatggttctggtgtctggaagtctaaaatgaaggcgttggtagactcagtttctagtggggcctctcttcctggccagcaggtggccgccttcttgctgtgtcctcacatggactttctctgtccatgcatccctggagtctcgccctcatctggtggtcctttgtaaggacaccagtcctactggattagggtcccacccttaggacctcatttcacatgaatcacctccttaaagacctcatctccaaatacgtcctgttgaggagttgggcttcagcatatggatttggggggacactcagtttccttgggcctctcagctcctgagggggtcatcatgagccaccttcctgcttgagggggataaagggcagctgggacccagggcctggggccttgggccgaggcatggggggcatttgtgggccggtgtttgaaatgctccaccagcactgcaaacacaccagacccctgaagagagggtcaggcgctcagctaggaagagggcgctgcggagagagtggtgtgtgtcttcctgtgtcctcctaggagcttctgtctgagaagtcagaagtcatgagttcccagtcctggccgcatttggaggctggatcattggagggaggcgccggcgccccatgtagctgatgttggtggagcattggctgagggcccagagagccatgctgctgcctcccacacatcaatcactcaggccacacagtcactggtgaaagagggcacacaggtaatcctccagttcttgaatggggaatggaggcacaggagggctaagcgagggcccatggcctcaagattcaaacacaggcactgtctggccccagaacacacgcccttcccacctggccgaggaggtgctcacaaggggcactccaggtggatgcagagtgggccagccccctcccttcctgcgggcagtggcccctgctcttcaggggagtcagatgcattgattctggaggctgaagccaggtggaagtgatctagaggggagatgaatgtgaggcgctgccccggaggagacaggaatggctcatcagccacgagccagtgccatttagaaactggcagccaaagtgacgaggccacacagggcaggaggagcaagagcacacgcttggaggtgatggtattccagcagtggcatcagctcagcctgggccaggccaatgagcccaccagcagcctgccccttgctggggtggaagcctgaaagcagaccacagtggctgctttctttggtctgggggagctcaggccaggggctggttagagtccccagcacagccccatcctccatcccacagtgggcagcagtgtgaaactgggcaggggacttcaactctcctagtctagttttttcattcatgtcaagggaacaccactactgacctcacagggtgagggttaagtcagatgatgtgcttaaaagtcttacatgaggcatggtgacactagatgggccagggcttcctgaaggcagggtcaactctgattcatcttgacatctccagttcctggcccagagcctggcacatagtgggcacttgagaagtgtctgttcccttccctcgagagggtcttcaagtggtgaatggagatgatggtgatagtgataatggtggtgatggtggtagtgatggtgatgatggtggtgatggtactgatgatggtggagatgatggtgatgatggtggtgatggtggtgatggtggtattggtggtgatggtggtggtgatggttatgatggtggtggtgatggtactgatgatggtggagatgatagtgatggtgatgatgatggtgatggtggtgatggtggtattggtggtgatggtggtggtgatggttatgatggtggtggtggtggtactgatgatggtggagatgatagtgatggtgatgatggtggtgatggtggtggtggtggtgatggtggtggtggtggtggaggtgatggtggggttggtggtgatgagtgtgatgatgtgatggtggtggtgatgatggtggtgaggatggtgttggtggtgatgagtgtgatgatgtggtgatggtgatggtggtggtgatggtggtgatgggggggttggtggtgatgagtgtgatgatgatgatgtgatgatggtggtgatggtgatggtggtggcgatggtggggttggtggtgataagtgtgataataatgacggtggtaatgatggtgttgatggtggtggtgaggatggtggtggtgatgatggtgatgatcatggtgatggtggtgatgttggcgatgatggtggtaatgatggtggcaatggtggtggtgatggtggggttggtggtgatgagtgtgatgataatggtggtgatgatggtgatggcagagatggttacaatgctgagagtgatgatcttggcggtgatggtggtgatgttggcgatgatggtggtaatgatggtggcaatggtggtggtgatggtggggttggtggtgatgagtgtgatgataatggtggtgatgatggtgatggcagagatggttacaatgctgagagtgatgatggtgatggtgacgatggtgatataagtccccatgcgcacttcctcttctctagctctgtctctcacctgctcttgcctgagctccactgtggccacccacctgtgacctgtggatggaaagtaattctaattatgacattttcctacaaagaacaaaccactgggcttctctggagcacaaaggcatggcgagatgagcagtttgccccacaggacgctggcattgccctctgaactttttcccagatgtgctgaggacaaggaagtcaggagtgtggcttgttttccatctgctcaacactgctcgtgcctggagccccccagctgtgcctatcagcccctaggggttggctgtcaggggagcagagagactcttggggcagcgtggccttggtcacagcagaatgctgggttctgacatttatgagccatgtgaccttggcatgctccttgacctctctaaaccttgcatgacacttaggaaggttaataagatcacgtctgtgagaggtcttagtgccacagtagatcagtgtcagtgagggtagggacttagctctgtggcttgggaggcgcaggtggcagtgagtagccagtgggtgagacccagagaggctgtgcctgtgagcggctgggcagagtgggaatgggtgctgtcagctgggtgcacaggcagaggaggtaccgctgcccacaaagggaagtctctgagttggagcggagcaggggcgggagagaaggcaattggggccttcctgggtttgggaggctcagcaccaggagcagcccacagccagggctcaggacccaggggctcacccagccctcctgaccaggctaacctgcggggtctggagggaacacgggcagccacggccatgcgcactgggaataagtgagaggctcccgctatctcagacctggcgtgggagctgtgggcctttccagggcccggctgctgcggaggtaggagtttggtgttggcagcaggagcagcaaggacacactttaggacctacagcgtggaggcaggaggacagggaaatggcctcgaatgagtccgtgaccccttgaggaatctgcacacgactcctggctgtcttgtcacttgatgtaaggcctcaagcggcatctcctgaggatttcatggaggccagaggggactcacccagaggtggagggatgcaagctcagaggccagggtgggcgggggctggagctgctctgtgacagcccagagctcccggagccgcagccaccgtcccaagagagctcaaaagaggagggggtgggaagggggaggtaaaagctgttcagccaaggctttctcagcctggggactgacctgggtttgtcctattctgtgaaccaacccaaacatgtaaatgtcctggcactgagcaaagccttccccaggggcgttttccctgaaggacttctcagagcctttaatgggccagggaatcttgtcacgctcaggtgatggtagaggaggaaaggacttctccaaccgtggtgactctagaacctctccctacagcagctcggggagctccagctctggagaacacactttgggaagccttcccacgcaggacagaggtctctctgccgggctgcgagccctgcccacttgtgaccagggttttcaatcccctggtgtgagagcagtctcaggtagcccaagcctaagtggaaaaggggccgggagaggcggctgggcaccccctcgctggggctggtctcctgggtccctgtttcctgtctcaggaactgggaggaacccacttccaccacccagcaggggaagactgaaagtattagggggcctgtctggggtcagtcccactgtggacttgggcactgccactccacccccccctgctgccacaggcagtacccaaaggtggtgcattcggaccctgaacccccagcttcatgggttctaggaccctcctctccatggctcagcttccaactgatgacccctctccagagccagcctctgtcctccagcaggaggtagctttggcctctcttggtctctgacccgcatgtcccttctgcgctgcagtctcctgggctcagggtcctccttcagactcctccagggaggccacaccctcacacagacctgccctgggctcccttctctgctctgagcagcccctagtcttacaggagctctgcagaggcccttccgctgcagaagagcttaggtgacaagccagaagcctcaggtggcctccttgttttgccagccctcccccgtcggttccttgctttttctacccagcttggatctcggggggctggcctggatggattttgtcaatgactcacttgccctttaatgatcattgcatttgggaagccctggccagagatgcaagtgtagcaggagaggttggaatgttcctgtgcctcctcccggagctgctgctgtggggcagggagacttctcccttctggtggcctcctctcctccagcccctccttctcacgaggctctgtgagactgttttgggcctggaggcggcaacagctttccacggggctgggtgccgggtgcctcagtgtcccccactgtccctccattctgcccactcctctgcaaacagcctctgcatcacgtgttcttcaagatgccagccgagcgcgcctgcaggagcctgtcctgctcaggggcggagggctctgctcgtgtgggcacagctctgaggcggtccttgtagcaaacatcgctgactgcctaccacacgcccggggacctcctgggcacctgtcagtcatgaacgtaacaggttcaggttacccaagtcccatgccctaactgggcagttgcaccatgggcagcaacagaccctgggcttcaggatgtcccagcagagccgcagcagccacagagcaacccctcttcaccctggggatggggctgggcctctgagagcaagcatgagattgcagagccaaaacccaagctgtcaaaacgaccagcaagaaagacagtttggattaattggcacagggaggtccctagacatttagattatggctgctcctgggctggagcgtggaacccagagacatttcacaaattaacataaatcctgtgaaccctctgtccatttcaacgcttaatgccaaacataaacaaatgaaagtcatttcagaagctggaggagtttgaataattcagtcccatcatcatttactccaaaacgcctcatttcatcttatgagtcatcgttgaaaggaaaagaagattttacttggtattagaaccgggagagctggaaaagcttcgaagaggaaggaggctgccagcttcctgggtgcacaaggccgtggccagcttccgggctcagtcgtggacaaaggcctcctgggacagagaagtggcctctaagcaaaggcggtggtgtgacgctagcaggcctgtgtccacctcctggtcaggctgctgactggcggggctctgggggtaaggccttggtcctgccgtgcctcctcctggctcatctgtgacacagaaatgacagttcctactccccagcttgtgcgggcccaaatgggatggggtgtgtgtgtgaggactggggcctaggcctgtgcagggcaggttgtgttactaacgtccccccgtggctcctgggctaacggtgcacttctccgtcctgcttcactgccttatggcacgtgtccatttccccaaccaccggtgggccccgggtggcttggccggcctggtgtcccgtgcccagcatgggctctggcccaagttagcacttgctgcctaagtgcctctgccttttactcacctccatctggagcgggctcagtggggttcctgctggggctctacgggggcatccagactttgccctctgaccagccccactgtcctgtccttccctcccctgcgtcctcatctgtcactccttggtcacagccgccccctgactttcctccctgcctccttggcatggtgggaaacatgcgagttccatttctgaggctgccttgtgcctgatcttgggcaagttgcttgctagacctctcggcgtctccgttctcagcggtgcgggtaacctggccctgtgctactgtgtgtgggtttacagccaaggcctgtgaggcacgtgaccaccaaaaccctcacgaggccatgtggtcgtggctacgggtttaatctaaaattcattctgatcccttggccttggaaaaggcacttagcagggtggtgagggccacaggtgtggtctgagctcctggggagctaccgagggcaacaggcatgttctggaagacccaccgtctgaggggtcatgtgacaggtgggctaggtgggcacagaatgggaagagaggcagtgaggcagcctctctgcagaggaggggcttcacagaggaggcagcggctcaggtggtcccaggaggatgggtggggttcggaggcagagggctggacttggaaggaaggaagagcggacacagggcctctgagcggacagtgctggcggagccctggggagcaccgagtccccgccgtgatgggtccctgaagcaccggagccagcagcaggagcatgcgggggagaccttggcccagccctgcagtcaggcagtaggtgagccctgaagggtgaggttgcttcagctggatgagagggtgtgggagagaggagcatcccaggcaaagtgagccgcgtttacctggagaccaagggtgggaagcgagggagaagaggtcgcggtgagcctcgggtggacccatgtggcagacctgtgagttggtccccgacagcctcctgcctttctccctgactgcccagcagcagtgttcttgggcctcagggacgtgtcgtgactggctgaaggctgtcacggtggtcctgtgtaggactggttgccacaggtaagtagtgacctggcctggccgatgctgtgttaggataaacgtgctaaggaggctctggaaaagaattttcctgcttggacaagacagagactcacacgaggaaattccttttgttcctaccctcacttccagtgttgaacacagtcatgctagaaatggtgcctggtgcagctgcagccgtcttgctaccagcagggcaaggcagagccggccgcccagggacctgccactgtggggtggccgaagcagccctggcaccacacagctgttatatgctgtggtcagaagtccttattaggtgagcaattaatcagatgtgtggcttctcaccctgtatttcctctggcaagaccctgcggcactgcagacccctgtcctcatatgaggcctaagcagtgaggagcttcagacccgtgtgaagacagaaggcgcggggagcaaaggtggccagagaggggtggggtgggccacgagcccccaccaactgcaggcccacggctcagcagcaatctgaggtctcccaggcagccttcttgccttccttccatggctccttggaaagagctgggtttcatctcgggacacagtggcattagggatcggcagagaccagcaggagccctgggtccagactgtggctgtttctgtggtgaccagcagccggcactgcctggcagtgcctgggagtggacgttgaggacactgtgcccaggaggtcagtctgcccacccaggctgtgtcctggttgctgggtgggggtgtgaagagtccaggaccagccgttgtcccacccagcaaaaccctctgtgtgtggatcccatggggggccgggctccggggatggacagccagcagccctggcctgagcagccatccggaggagggagcagacaagaaacaggcagtgaccgcacagggcgatggggctgggcagggaggaggcgggttcgctgtggccagatgccaagccagagccgggaggccagagggagggccgcagccgggacaggagtgactgatgccagggcctcagagtgaagacagggctggggtcccctgccccctgatgggaaggagactgcgtggctggggtccctgggagcgcatcccttttgagaccacactcctcagcagcacctccctctctcaagcaccaacactggccttttggctgcctgagaaggggctctggggtccaggggagccagctcagctcaccccagtgagcttcccacactcagacaaggccctactccagggcagcttggcccgtgcctctgcccctacccctgccatggcgtctctccaggccctaggtctgtactcacataacccagtcctgcattgtgctgactcagcctctgagcctcaacaatccctccttcgagtggggacaacatccctgcctccgagggctggtgtgcggatcgagggaagtcacaggtagtcacagctctgtgaagggtaacgcgagcgcctaggctgggaggctgggtctgcagctgccggctccacgggctgtctccacctctccctgcctggctctcctggctcttcgtttcgtcatgttccttctgcccaaccagtcctagggggacagggagactcctgggcacaggggctgctcaaactgccctgggacagatggcctcctgccctgccccaggcagcactgggaagcagaagggctgggggaactccagcaaggcctggggggcattgagcaaagcctggagagagcacacttgtggatgggtgcacctgtgggtggccatacctgcggggcgggcacacctgcaggctaggagtaggggggctgggcggtgggcccaggggagggtgttactgagttacgtggcccccagtgctcctggtcctttcaacctttaagttgaagataaagtcacttttgcaatactaaagaccaacagattctaatattcactcccatgcaggaactaagtgcctgttacctgctgtcctgcttgtcccatcttagggtttcccagggcccagcagagcctttgccataccttctctaaggcccaggctctgggaggaaggtcactcagactttcagcactgctgctggtggatggggcccctctcagaggccctggatcctgctgggcctgtctgcctgtctgaccatggaaacctccaatggggcagggtccaggtttccctccctacaagcacgctcctaagcacgtccgctctgtcgttgtaggtgtagaactcaacaatcacaccctgcaaaggcggaggaaaccctcttccctccccaggcccattctgtgtctcaggccctgcctctcccctgtatgtaccgcatacatccctttcggggctatgcacaggcttcaggggagccccacccatggggtgcatcttcagcaggacaatcatcagagaatgttgtggtccaggatagggcagtcctccacttctggtcctccagaagtggactaactaacatctcctccaaagtcattcttcttccatgtttacggtgacctctgtgttctaatcctgggagaagccctaagctgagctcacgggagctgggagaccctgctgccaagctgagtctcaccatctttggcccattttttttttttttttagacagggtctcgtgctgttgcccagcctggagtgcagtggtgcgctcttggctcactgcagcctcaccttctctggctcaagcaatcctccagcttcagctttccaagtagctgaggatacagacgtgcatcactatgcctggctaattttttgtatttttttttgtagagatggggttttgcatgttggccaggctggtcttgaactcctgagtgtaagagttgaagaaagaagaaagaaacacgaaaagtggctcaacagtccaagacaggtttattttggagaataaacctgagaggggcttctggccgattgctgtcaggagcactctctcttacagactaagggtatttaagggtttagggagggagagcttatcgcaggttgggaatgtttctggtcagaggagtgtttgatttcggggtaggaatgtttctggttggagggcgctttatctcagggttggaatgtttctgattggaggtgtcatttgtggtttatggtcatgctgacagccattaggctgattttttgggggctggatttaggcggtttttaatcaaggggaacttaaaatgctgctgtttgtccaaaatgttgatgctcctgctttgtcaatccagaccctatagttataaaaggatgaggggcgacgtgctctttctggctacttcctgctgagagagggttgtcgttatgggacactgaacatggtgctggagtggaagaggtcgatttgttctgggtagcacactctgcctcagaggcccagaggcagcgcccactgaaacatctaattttcagctcacagggcttcaagaaagcacagcttaggttttagtgatctccagctagaaaaaaaaaaggggggggggaaggaaaagaaaaaggaaaaattgaaaacattattttggagacttgtagccagaaaaattagaatttaatccaaactgtagaaaacaataaaaattgaaaaacctcagacaagactagaatttaacaacaggtgtgctacagtttttgaaacacaattctctctctccagttttccatttatattaaaagacaaatcatggggccaggtgtggtggctcacacctgtaatcccagcactttgggaggccgaggtgggcggatcacaaggtcaggagatcaagaccatcctggctaacacagtgaaaccccgtctctactaaaaatacaaaaattagctgggtgtggtggcgggcgcctgaagtcccagctactcgggaggctgaggcgggagaatggcgtgaacccagaaggtggagcttgcagtgaactgagatcgtgccactgcactccagtctgggtgacagagtgagactcagtctcaaaaaaaaaaaaaaaaaaaaaaaaaaaaaacaaatcatggtatgactagtttgctttgccagatttttttttaggtaaagtttcactcttgttgcccaggctggagtgcaatggtgcaatctcagctcactgcaacctccacctcctgagttcaagcgattctccagccttacttcctgagtagctgggattacaggcatgtgccaccatgcccagctaatttttgtatttttagtggagatggggtctcaccatgttggccaggctgatctccaactcctgacctcaggtgatccacccatgtcagcctcccaaagtgctgggattacagaagtgaaccaccgcacccagctgtggccagattatttgtataaggtgcagcaagaataattatttttacataggccttttaagttggcttcaaaaaaactctgtttcatggaaggaatttgagataagacctttttaaagccaatcccagccatggaagtgcaccatcaaatacctgtgagttgggtgaattcttccactcttgaggctccaagataacctggggttcctggcctgtgagaaagtgacattcctttacttacctcaggtcagaaacctgcacagggactgcgcgcacaaaatatgaggcccacagggaccgcgcgcgcaaaatatgaggcccacagggaccgcgcgcgcaaaatatgaggcccacaggcaccgcgcacacaaaatatgaggcccacagggactgcgcgcacaaattatgagtcccacagggaccgcgcgcgcaaaatatgaggcccacagggaccgcgcgcgcaaaatatgaggcccacagggaccgcgcgcgcaaaatatgaggcccacaggcaccgcgcacacaaaatatgaggcccacagggactgcgcgcacaaattatgagtcccacggggaccgcgcacacaaaatatgaggcccgccatctaagggctctactggcttcacaagtcaagtttgattccttaaaggagagcacaccattccagtcaaagccttgctaaaacaaccagttcttccaattgtgtcctgccataaaagaaaacagacttttggtcgggtgccatggctcacacctgtaatcccagcactttgggagcccgaggcgggcagatcacctgatgtcaggagttcaagaccagcctagccaatgtggcgaaaccctgtctgtactaaaaaacacaaaagttagctgggcatggtggtgcatgcctgtaatcccagctactcgggaggctgaggcagggagaattgcttgaacctgggaggtggaggttgcagtgagccgagattgcaccactgctctccagcctggggaacagagcaagattccatctcaaaaaaaaaaaaaagaaagaaagaaagaaagaaaacagacttgtattgcacctttgcaaataaccatactgccataatttaaggatactcacaggtagtttccagactcgggagaaaaccaggcagagagaaataagcatgcctcaaattttgttcatgggagcacaccaaactgtcaaaagctgttgatagctcaaaagaaaagcctctttgactctgaaaagcaaacaaaggaccaacaatattccgagcaaaacatcaaaaagatcactccagtctgttagttcagttcacgcagtcagttcctgtcctgcctgatatcaatgaacattccagctcttcaagagtcctgaacgtccttcctctattctgatgtcacaatctgcaaagttatcagaaacctgcattcaagagcacctgtcagaactttatagctgatcataaaaccaccttctaaagaggaccaaaacaagacaacaattgttcatggatgacaaaaagttttagggtggccgcagttaaagacacaattgatgaggaaatctgttacctacgtggcacacaacaattttaacataacaattataattattactgataatgtacactaaaacatatcaggattgtaggagtctcccacaaccttggaacacataccaaaaacatatctacacaaatatagcccaaagaaagccaagcaccatttcgtatttgacaatattttctgtataatttttataccaaataagccaaatttcacctttacattagtgtactatgaatgttaaaccgaattaataaatccttatagacatatttactcaattttaatatttgaccacaaggtaagatttttatagactttttatagccctttacaatttttgttaaagagcaggttagtgctctaagagaaacccactgtgcttttattttaataaaatttaatttacagaaaaactggaggataccccttttagccaatatgtttacacacagaactgcctctaaaatcagcctttcacaactagcccaaaccttcatttttattttatccaactgaaaaaaaaatcctttaacctttcaaacttggcaaaaatccacattctcatgcctccctgcaatctttctaccaaaactatattttacttttcctacataccttgcatgtaaggacagtggcttggaatgttggaacctttccttggaatgttctgggtttcagcaccaaatgtaagacttgaagaaggaagaaagaaacatgaaaagcggctcaacagtcaaagacagatttattttggagaataaacctgagaggagcttctggccgatttctctcaggggcactctctcttatagactaagggtatttacgggtttagggagggagagcttatcacaggttcagaatgtttctggttggaggagagttttattttggggtgagaaggtttctggtcggcagggaagttatctcaggttggcatgtttctggttggagacaggtttatctcagggttggaatgtgtctggttggaggtgtcatttgtagtttatgatcatgctgacattagccattaggctgctgtttttggggtggatttaggtggtttttaatcaagaggaacttaaaatggcagtgtttgtccaagatggtgatgctcctgctctgtgactgagctcaagcgatttgcctgcctcggcctcccaaagtgctgggattacaggcgagaggcactgttcccagccgttggcccgttttctaaagccacgtcttcctctgcgatcatccagaacaacacagattctccacctcctctttttctaagctcttgctgcaaatgctggagaaagaacagtgagcgttcaggctgcagcttggccaaaaggccagcgagggagaagtaattacctcggcaatgacaggtgttccatcctttcttctcccctggaaatatcagccatccatcagccagggccaaacacccacccacatctggctcggaaagcagtaatgtaccaggaagcagctgttttcgagagaagccagccctctgtcagtttactagcttattctctcactcattcaacattcctgtgtttatcataccatcccaggggtggtgtggcttaaggatgggtctcgggctggcctggctgctcctgtttcccgactgccacccactagctgtgtgacctcaagcaagctgcttaacctcccatgccttggtttcctcaaccattaagtgggaggtaacaatagtggcacctacgcatagattgttcttggggggtaaatgaattaatacatgtgagggttggccaggcacagtggctcacgcctgtaatcccagcactttgggaagctgaggcggacagatcacaaggtcaggagttcgagcccagcctggccaataaggtgaaaccccatctctctactaaaaatacaaaacttagccaggcgtggtggtgcaagcctgtaattgcagctactcgggaggctgaggcagaagaataacttgaacccgggaggcggaggttgcagtgagcagagattgtgccatcgcactccagcctgggtgacagagtgagactctgtctcacaaaaataaatacatacatacatacatacatacatgtgacggtctcccagacatgcactccggctccaccttgaccaaggggatggggctcacggttaagtcaaactctcaggctctttctccagagaatttgaactctgagccttgggctgatgacacaaagactcaaatggtggctgcgcctttctcccccaagtgcacccccagagactgctggtgcttcctgctagctggatccccagagctgcttggtccctgttctaggtgaggccattcagcagtccttgtgattttctgagcatactttagccttctagcacactcctctcttcccctaaaattagccaagagtgggtttctgttgcttgcatcccaactaccatcattgggacagagcccctgtgcttgagacaagcagaagatagacttctttcacctggggcctggcttcgtccaacagcagagcccaacctccagggcagactgacccgtgatgggcatgggagcccagaaaaaggccccatccagcctgtgggatcagaggagccttcttggaggaggtgatgctgggcgagtgttaaaggatacctaggcatcagctaggtgaagagagcagggaaggagactccagggagaggaatgtgtgagaaaatggggaggagagggaggaacggttggtgggcagctgccactctgtccactggcagagaagcagccaagtctctgatggagcccaccggagcagcctacctggcttctgtggtcactggctgtgaccccgccagccctgctcagcgctgtgcccagccctgggtgcagggaggtgcggtttgctctcagaggagcagctagctgggagcatccgaggccattagggacaggacgctaatgcatcggcgccccattgattctgcctggcttttgtgaacacgtctgcgctgactaatttgtttaattactcattgccgcatctgttctcaattgccctatgcagatacttagtctgtggctgggagccaagcctcagggtcccttttcctcttccaagatgggtggcactgaacgccgaggccacggcccgtcctgatgtggtcagagatgtcgtcatgtgccactaacaggcgtcgccaagaccagccaggtgcagaccttgggtgggtcctatggggtcctacaggaagcataggcatggtccctggtggtccccaggagcacggctctaacacagccgaggcatagtgtgagcaaagtcagacgcagtggttacaagcaaccccacgtggtctgcttcgaatccagcaaacttttgttttcagtgcccagctccctaagccttctttgtccttaccgtctcttcagaatctgtctgcttcaccctgaatcttgtctattgtcctggctagttcagctggaggccaggggtcggagacttagagaaatgaggagggggcgtggagcaggggctgaggcctgagcggtgagtggggctcggtattgacgatcagcgaacagtctcctggggagtcagcttgaatggggcctgtgatatctgcggccagtgccctcggtatgtcccactcagcatcctccccaggtcagaacacattttggggcagaaccgagttttctcttcactttcagactcaagtccagcttattggggcttatgaagacttccacctcatacaggatgaatgattctcttctccattccctctgctgctcgtggacactcggaggtgggggaaggctctgttcttttacttttctggttctagtttctcagggaatgaggcaggaggagagacatggaaagggagagagataccttccgtttcaaggaatatgcagtttggatgtctgaaaaagatttatggcagagatgctggatggaaaacaaacacacagtttgagagggtcctttttatttttattttattttatttatttatttttttgagatggagtcttgctgtgtcacccaggctggagtgcaatggtgcaatctccgctcactgcaacctctgcctcctggtttcaagtgattctcctgcctcagcctctggagtagctgggactacaggcacctgccaccacccctggataatttttgtatttttagtggagacgaggttttcaccacgttgaccaggctggtctcgaactcctgacctcatatgatcctcccgccttggcttcccaaagttctgggattacaggcatgagccactgcgcctggccaagagggtgtctgggaggccgaagcgggaggatcatgaggtcaggagatcgagaccatcctggctaacatggtgaaaccctgtctgtactaaaaatacaaaaaattagccaggcatggtggtgggcacctgtagttccagctactcaggaggctgaggcaggagaatggcgtgaatctgggaggcggagcttgcagtgagctgagatcgcaccactgtactccagcctgggcaacagagcaagactccgtctcaaaaaaaaaaaaaaaaagttaaacacatgtctaacctatgacccagaaatttcagttctgggtatttatgcacaagaaatgaaaaggtatctatctgcataaaaagacttgaataagatttttcataatagttgtattcaccataactaaaaatataagccacctaaacatctattatgtgaaagagtacccatggaatgtatagcttggatactactcagcaataagagaagtatgaacaagaggtagaatgcagttcagagacaaacacatgaaaaacacaaaagagaggcaaaaaaaggtggcagtggaaggaggaattctgacacatgcttaaccggagttccagaagaagataagacagtgaaggggacatgtgatagtcaaaggcaggccccaatcctcagatcaggaaccataacaattctcagagagaataaatgaacagaaatccatatttagatccatcagagtgaaactgcagaacaccaaagaccacaagaagattttaaaagcagcaagtacaagagagattaccctcagaacaccaacaacagattgacagttgacttcacaacagcaataatggaagacacagagctggatacacaaaggaaattgactacaatctagaatccaaaagattcttgaaggatgagggcaaaataaagccattttcggatacacaaaagctgagagcagctattgcaaagagactctcactaaagggcctccacaccaatgcacttcaggaagaaggaaagaggtttcggacggaaggtctgtgtgcagagggaatggctgtctcagaggcgactcaaactcagtatgtccagaaaggactcacaatctgctctcccagcccagcgcctcctgggactttggcctctgtggatgatgaccacagtcacttgggccagaaacatagacatcatcttgataccccttctccctcacctcccccatatccagtcacctccagtcctgtcatctttgcctcctaatctctttcatctctgcccttttctctccatctccatggccacccagctgccactgcattttgctcaccacctgcaattggccttccagcccctgaacccctctgatctgctcagcccgctctccacaccgaacccgaggctctctctttgaatggcaatctgatagtctcccccctgtttaaaacatgaaatggtatcctactaccctggggataaaaacaagacaaaaacgtttaagaggttagagaggtcttcatgattcagtccccacccacctctcagactcacctcccgccccagcctctctggactcttttggcccctcatgggtgccatcattttgcccacataggctcttgtctgtgctgttttcactatagagtgggtccttcccttctttctttgtctaattcatgacactcatcgtttagtgcatttggcacttcctccaggaagcctgccttgacctccctgactatatcagctctcccccattaaatgttcccctcgtgccatggtcccctcatctgtgacattgatcacatgagcaatttcacatttattcatgtagttagttatagtctggatcctcctttggattttaagttcctataggtaaaagccttcctctcctttggccaccgagatatctccaggactaccatggacatgcagtaaacattcaccagttgttgaatttatgagtgggtgagtggtgcctgccaccctagaatttcccttatttgaaattctagaataagcagattcacttctttttcacatccatgtgaatttttgttcttgtataaatgaatagtaagtaagagccataagaaataattggagaaagaaggaattgggaattgggaagagaaaagagagaaaaacaatagaggcagagcaggggctttttgcagtgatgcttggggagaagaaggaagccgaagggacagcaagtgggtagatggcaggtgactggccccaggttatccagagcagagctgagaccacccagtcctaaggggaaggggctgggaaggaagccactcagctctgccaagcagattaaatacagatcaacaagagcctttcccattttgaaaatgtacattgctctgtgttgctgggactgcagtgagacccaggaggcaggaataaacaattctgagtcataaaatcattaaggcatcaaacatttggatcgatgagcagacacaaaagaatatgcttcctatacacatgttaaaagcctaactcttgacaaggatctcaccgaatctcttgggcagaaggattctgtaatggaaagtaattgcacgccactcatctttgttaatttaagatgagtaaagggttattgattcactctttgtttcatgagctgttttcatattgaatttcagtgaacaaaaatatttttaataaggatttcatgggcttatttggcatctttctctcccaagctgcagagctatagatccaactgccagctggacaaacccaactcatctccagccatggcccctcctgatgtgagcctatctcaggttctggtaccacaatccacccagtgccaagccagacactcacgtatcaccctggatgccctccgcagcccctcacccatccaacagatgccccgtccctgtgcctgctaactccctcccacctctccagctcaaggcctccctcccacgtgctggatcctgcctgttcagacctgtcctgtctcctggtggccaaactggcctccccagtcagtccctgctgcagaaagtggtttctttctttctttctttctttctttcttttttttttttttttgagatgaagtcttattccatcgaccagggcctggagtgcaatggtgcaatcttggctcactgcaacctctgcctcctgggttcaagcaattcttttgcctcattcccctgagtagctgggattatagacatgcaccaccacgcatggctaatttttgtatttttagtaggggtggggtttcaccatgttggccaggctggtcttgaactcctgacctcaagtgatccactgatcttggcctcccaaagtgctgggattacccctgtgagccaccgcacccagcctggaaagtagtttctatagtacaaagccgggggtgctgctcccctgccccacacacctcagcacctccatgttgcttcctgtggagtagacactattgttttgtctgcccagtctcttcttttcttgtgggaatatgcttctggaatatttgtctggaaaaccctctccttttgataactgtctttgcctccctgggactgcagctgacgtgcttgcatgtgtgtgtgtgtgtgcgcgcgcgtgtgtgtgcgtgcatgcgtgtgtgtgtgtgtgtgtgtgttgggatcggcttccaaatcttcctactgggggaatgcccattatccattagatgccactcagtgggaagtggtgccccacccgtccgtggagacctaaggggcttaatagatcctccctgcatagccagagacggatacaatctgggctcagtgaatcggtgctttgactgctcacagcgtagctgagagcttactcccagaatggcgaaggtggcaaagagtccccatagctggtgttgttggctgccatcaccccttttatccaggggcacagctgaaatctgtgccactcggctctgctgggcaggtgggataaatctgccccagcctctgtgctgtccccatccctgctcctgctgcccagcagcctggagtccttctccagacttcctgtaactctctccccaagccaatgccctccctcgggtgaacaagggcccctccttgtgacccatggtgcctggcttgccttggccccagccctcctccctgtgccgaaatcatctctctgtggacctttctccctcatggactcccacctccttgtgggcaggaaccagcccttggccatgttccggctccctagtgcccagtatgtgtttggtgaatttgggggcatgggttggatgatcttggttcagttaccaaatctttctttcctgtccaatcagtcttccaggatctcaaccagttctctcactgcagagtctggagaagcccagccctcattgtgaagggagagccaccgtggtgctcacagcaagacacccagagtcccttccagacagggacacccctggagcgaccctgtttcagaatgaagttatctgggtgggaactcaccaagaatgcacagagggcgctgggctccaagcttcagcatatcctttcactggactccacacaggcctgcggagcaggtggacccaccattctcagaccccccagggccccatagacagcagatctgctgctttcaatcacacccactgcctctcatgccggagtgggggaaatggaacccgcaaagcctgcaggccagggagggtgggaaactggggtgatgtgagcccacagggtggagcactgtggactgaatgcctgtgtcccctgggttcatatgttgaacccctaactcccaatgtgatggtgtcaggaggtggagcctttgggaggt

SEQ ID NO: 767 - DNA, 33621 bp, Homo sapiens
ctctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagaggtacgtggtggggggagggggagggccatatggggggcaacagggggaggggcagggggcgggggagagtcggggccgagggaagggagcggctgaaatggagggagaggggaggaccgggaaggcaggggtgggagcaaccgggaaggagggattggaggccagagggataggggtagataagggatggaggggccaggaaatgggccttgaaagggggctgaagggaaaatgatgaaggggaaagaaagcgccagaaaggggtgggaaggtagaaggattgggttggggaaaaagctgcagaaataatttgggggtgggagctgagtgatgaggaaaacatcaaggaaatagagggacagagtcttgggagaggggctaggaaggagaaatgaaaacataggggtgaaaagagaagccaagaagatgtggggggataatttggtgggggactcagagtatggtaaggggcggaaaaagagaggaggatggagggagagaaggggccagatggagagagagggaggcagtggggggtggggggatggagggtccagatggagggaagagagaagagagagggaacggtgggggaggggagaccagggcagggggagggccaaattatgtgtgcttgggggggtggcagtacaagtaagatgaaatgatgggagtaggggacaggttaggatcctgccccagactctgaccctcttaaaggctcttgaccagtaaaatgtaacctctggggtcttaatgctgtcttcacttcatcacttttacccccttcccccacccctccaatccttatttccattccccctccctcctctgctgtccatcacctatatctttccccccatatggtgtccgttccttatatgagtcccccttctgtccttcccctatatcagtcccctctctggtgttcattgcctctctcttatctcttttctatgtggtcgctcccttatatctctatcacttctttactagtccgtcttgaccccttctcatagcctccgcattaggtctgcctcctttgctctgacacatgtccagtcgagcccttcaggtgtattcccttgcccctgggcatttaccatcatttctgcctccttttctatctactcctattatttgtctcccagaccattccttgtcaccacaagtctgtgcctacccactttcccttaatacctcaactcttattatcatttctcttttcttgtctcctctacttattggggtgttggagatttggggtacaaagacacaggttttgatgattagaacaagggatccccatctcagcccttgagggatttctcatcctagtaaaaatttcccgtttctcagccatgttgctctgcctcttgcatctgcctcccagaatcattcttcaccaagtccagacagtatgtgtgtgtgtgtttctagagttgttcctaagttccctgctgccaggagaaagatgccctctgaagtctaacccgcctcccttggctgcagcctgaaccagccctttccccaaatgcttatgtgtatcaacagatttctcctctgggtataccaagtgtctaagtgcggtgggcatgttgcctgcaatgtctgtagtttcagaggctaggtattggtgatctctgtatctagagaacattagttagtctctgagatgggttgagatagagtttcaaagtatgtggtttctaaatggtggacattctgagggttcatcgctcactgtgatctggaggttgggtaaatttgagagacatatttatagacagaaaagggctgaatttgcaaaactctgctactcagtgcattctgttggaatgaagctcaaagaccagttctcctgcagtatactcatggttatcccataaaggtgacagagtttgatcttttttccatctaaaatctgataccttaagcctaatttctagctctttgctgtcgccaatgtgacatctctcttacttcaatagggcctgtgtggcattggggtttaaaggagaggcagtttgcagggagagcggcatggcaagaacaacagagctggggaaggaggaccctggtctcatctcagccataggcgacacttggtctactgttctctcttctcaaagttttgttcccatctccagctcttgtctttggaggcccctctgtgtcaccaggcctggatattccattctttccccctgacatctttcttcctcaagctcctcactgtgccttgagaaggctcctgacctatggagtggcttccatcctgtccactgagactaggtggggtgaggtggtgggggcagtgttgaatctctgggcactgaatgggagaagagataaatttggtctctacttgtccaaacaagggcatatttcccaccttctgccctggggcctccacagccagatgccgacaaaagccatcttctccttaccaccagaagaaccagaactttccctaaaggatgagcagggttgaactaggggaggagggcacagaggagggaagagttgggaggggaggccctctcatgtctctgactgtgaacaggtaagctccccgacttcttcttttctagatatttagccctcagaatctcatgatcccaatgttcctacacacacaccccatccttctttcccacagccatgtagctttcctcatactcttttatagaggggtggtgccaccttccaagtccttgtcttctgcagctatttggatgccttcctctacccagatatctgacaccaacttctctgtttttctcctgccaattttgcggcacctctaccttattttcctgaagtagatggagagctccttcatctttctctgcccccaaacgtgtaccttctctgtcatataattcccatccctgaacctctgcatttcttcccccaagtctccagagccttctgtgatgtgatcctctcctcttttcccctttgtataaatgcttgtcttgtgttcctttagagttgccaggtgtctcactttcaactgtgatctcctgaaggccggtagggtccccttctcactttgtggactctcttcttgccattttaggcctctgcttccaaatgcatagagcctcccttactgtttctgtgtgtctctgtcctccagatgtacggggaccctctatgcaccgaacccaatacgttcattccccgtatgatcgtcctggttggaaccctcggttctgcatcatctcggggaaccagctgctcatgctggatgaggatgaggtgagtgtggtgagaaggctgggaaaacgcatgtgggagaatggggagagtcctcattagtgaaggggagagagacacaaagaaggcagacaaagaagaaacatttgcaaatggcaggagggtggccattgagacttgggttggagtgtgacaagaggggtagtcattctctcatcttgggcagggagtctttgagggttatgagctgtgttggggaggagatgtggttctgaagatttcgggggtggggaggctcctgttttcacactgtccatattgtaggataggttagaatggggaaggggaactgaagggtttggagaaggggtgaagacatggaaggccctcccaaccaaagcaatcctcaggacccctctctgctttgcccactgagcaagactcccagtcctttctccatcagggggcagagtgcaagaagagaaattgcaggacgcagagaaaaggcaggggatagaggaggttttaggtagctggaggatactgggaaagaagactgaggtcagtggatcttggcatgatggggtgaagactgggagagtgattgagatcaaggtttagagagacactgagagggcttctgcaagggagtggttggacatcaggaaggaatataagggaggggaactgggagtatgtggagttatctaaaggagtacaagtggagtaggggcagggactagccagagtaaaggagatgaaacggacagaggcctcttatgggaggtggtggccaggtatggagatctgagagccagggaagtgtgggttctgatttgggagctgggtcagcaggagtgtccattggaggaaatagaggataaaaactggaatggtgccccacaagtgtgagtcagggaatgggggtgatttgggggacaagctttaaaaaatggtagggtagcctggaaaaccaaacgtggtgagagatggaccctgaaagttattgggaatggtgtgatgaggaagggttagaatttgagtcagggctaactagagtgtcaagggacctatgggggcaggtgagagtgtggagagatggctgggtagacagcttccaggccacagagtaaagtagaggtgttaaggagaggatatggtgactttgaaaggagaggtggcttggggagtctaagttttggacaccattgggagacatttgagtgactgtggtcaaacccctagatcaaggtttggagtctgtaggagaaatgggggaaactggaacccagagtggggactgttatagggatgaagagggaagacaatggattggggtaatgaaggaatgacagagatagggacagactgaagggaccagtggccagcaagttgaggggcaataggaatggccggtctggagcaggaagggcgtgtgtgtgggaggaggagtagatagaattgggaaaatgagcagcctgaacagacgcagggagttggaattggatgggtggtggaactggggctgggggatagtgaggggtctgttcctgtggctctttgtagaggtggaggagactgcaggggtggaggtgtatggaggtagggatggaggtggacagggggagctgggtgtgaagcttagggaaaggtgatggctgaggggaagaagggaactgagagatgctgggtcgggtgatggaaggagatgaaaggtgggggaaggtgaccaggccctctggcgggaggggaggttgggtcccagtctggccgcaagccgggccgtgggagggagacaagctgtggatcctgattataaatgcagcttctgctacccccgtgacaggctcggagggagagaagggggtaagggaggtgggaggttgggaggaaagcagggagaatggaggaactgaaggtcaagggaaaactggattcaggaagtagctaacttctgaggagttgcagaagagctgagtagggtttgggagaattctccggaaggtgtttcaagacaaatggagggagaaaagagggtgggacggcaaagaatgagagagagagactgggggagagaagggagagatccagtcaccaagtgtggaggggccggggcagaaaaagtgggcaggcttagggggaaaaggaggcccgcccttcctgggaggaggcggaggggggaagagggaggggaggggcggcgtgggccagggaggtctgacacacccccacctcccctagatacaccccctactgatccgggaccggaggagcgagtccagtcgcaacaaactgctgagacgcacagtctccgtgccggtggaggggcggccccacggcgagcatggtacggcggccgagcaggctctcatgacccggacaggcgcggggagagggctgaagatggaccgggctggcggggcgggggcgtcggggagcggcgggagctggccgggggcgggagaaggcggagacaaagtcttgcttcccgaggggagatggcgccctcctctggaaggtggagcgggacaggggctgtgggtgagaggcccctgtgggtcctcgctcggcttcgctccctttctcctctccagcagtgaagtttgactattttcctggtgcttgtaaaaatagtctccttagatctttagcttccagtccgtgtgttcctgcccctgcccctcccagcccctggtctgggatcttggaaagaatgacctagttcctgccctccccccagacctcttccccacccctatgctcctgattcttcttccggaccttcagtccttgaggtctccttttattaccccctgttttctcctctcatcagctgcttctattttctgcaattgtatcaccctttctctttcctccctgatttctcttattttctgtacccctcttgattaccccgtccctcccctctgctcccggcgaaagtccatcagactcccatctcatctcctttctgtctgtagagctatctgcgcggtctgtctctccaactctctccctctctccatctgtctcttcccctccctccccctttctgcccccccaaccccctctttagtcatttaaaaaaagatttttgtcttcctgagaagttcgcttaaaaggtttccatgggaacagtgaggggagatgaaggcagagaacagagatctgcagccaaggtgcagagagacgccctcagcccccggaaaccccctcgtcactgcccccttccacttcatttcccttcccggacctagcgatccaggttccccattcctccaacccccaggtgacccctttttcccaccagctccccctcccttcaggaattcaagctaccagtttctctcccttagagagccagtgacctgtccccatcctttggctccttccagccttctgataggtccaggccctactagccttgtgggccggtttggggaccttgggtgggtgggtgggtggtcagggatgtgtgtcattgtcatggaaaccccataccatcggggtgtgtgggtagcacatctctgtgaggcaaagtcaggtggtggtggagtgtatacagagaatgtgtgtgatgtctgtcacatctgtgtgtatatgtatatgtgtgtatgtcatgttcatgtctggggaagatgtgtgtgtttgtgtgcatgtgtgtacacctgcgtttccaggccagaatggtcacatgctcacagagcatgtttatcatgtgtcctgtggttggcagatctgcccacttattccccatctttctccttatcctgagtcctcagggtctaggggtctctggcgggggtctcccgtgtgttttgggtggggacaccgtgtgtgtttggagttgaggtggcatgtggaggttgctgtattggggttcagtaggggctgggaggggttccaggggcatatgtatttggggggagggcttagtgaaagttgatgggggtgaacgtttagggtcttcaggcagacatggaatgtgtaaagggcatggaggatgtgcagtggacataggggtcgttgggaccttggggacttggcaatgccaaggtgtttgctgaggctgtggactctccagcccgggagaggtcgccggacctttgaggggcattggaatcctgggctcctcctctgctgggtggagccgcgaaccctcgttctctccgcggttttgtgtgtgtgggggggtcctgctcaggaggggatggtgggtggcctggtttgttttgggggtccccttgcccccctcccccgtctctctcgcgctgtctccgggcgacagggctcgtgacagaggcggccacggcagcagcggtcgcctagcaacggcggcggggcccgggcaacggcggcagcggcgggagcggcggcggagggagccgttcccgcggccgtcaccgcgcggccgtcccggccgtcccgggccccgccgccgcccccaccgcgccgggcggcgcgagccgggccgtaccgccccctctccctccgcaccccgcccttcccccgcgcaggggcggggcccctcccccaccggggacacccctggcccccccggggggcggtgcgaggtaagggcggggccgggcggactaggagcgcgcgtagaggggggggcgccgcgcgcgtggggcgggggcgcgcgtgtgcgtgggcgcggggaggggggtggggaagccgcggtggcggcggcggcggcggcagctgctccctccgcatgttctcgctgcatcttccgagtggggggagttatggtaaccggagggggacagcggaggacgggagggtcggggaccggcctcgtgcggacagggtcttgagcacgcgggggcggccggtgtgtgtgggatcttggagcccctggtggaaggggcagcccgtgtgtccgcgtgtgtgttcgtgcccatgctcgtgtctcctgtgtgtcggtgccatgtgcacacgggggcccagttcctcgtgcacacatgtgcagccatccttgtgcaagtgtgtcctgtcttatcttgcctctgcctgtttcctgcctagggggctgttgggccagccacgggcttgtggggcagtccgcggccttgctggtccatgtcacctctgaccctgagcatgcatatccctggctggggctcacctcctgtcaggcttctgtgtgtgggaatgtgtggccctatgagcaggattttctgtgtccctggtggcaggtgtgtgtctttgcatgtgtgttccagcactggcctgagtatctgtgtcaatcccagcatgggtgtccagggcgtgtctggatgtgggtggtgtggctggggggagtaagtgtgtgaatgtgttccttggaattctactgtgtatgaaacacctttgggctgggcaggtgtaagccctgcttggtcagtaagtggggacagaaaagcttaaaaagggaagaaatggggtaaagaggaaaagtggggaggggataggagagaaggaatgagagaggcttgaagaagagagcagagagcagcaggccagggagaaagaatagctggagaatgggaatgtgggagaaagccaagccagacttagaagagagaacaggggataagagcttaagatggggaactggatagagatggtgggagaagaaggggtctgggagctggggaggcagtggggaggagagagtcaggccttctggtaaagtgatctctgaaagaagaaagggaagaagatgggagaaggcactggattcttgtaggccttgcaggatcaggcttggttttggatcagggaaggccactcaggcatacgggctggctcacagtgaggcctgtcatagcagggactgtcattagaggttcatatccccagcacagagctctgtctcccatttctctgctctgtgtccaaccctgttcttcgcccttctctggcaacctccctcctctggctccccttgagagctgccagctgggtgtggagaggaagaaaggccaaagggaaggttagggatttggagggcagggggagattctgtgggtgatggcaagattagagatgttggaggggcaggagtccaagcccttgctgtgtgtgtgtgagtgccattgtgtgtgtacacagggtgtgtacatgtgtgggtgtgtgcacaatgcctgtgttacgggtttgtgtaggtggctgttatgtgtgtgcatgcgtgtatacatcgtgcaggcatgggacatggagacccaggatcacagtttgtgcttttcaggtttgctgtgtgtgtgtgtacacgggtgtgtgttgttttctctgtacatgtcactgcatgcagcattaataacaggatgttctgtgtttctgtcactctgccccccctttcctctgtgtttctgctattcttttcctgcggcaacaaaagtgtttaataagcatatgtgtatgtggcctctgtgtacctgtgacttatgagtgagttcatggatcttagttcttggtaatatgtgtaaggttatattacttccaagaaccaagcaagccaattagcaaatttgttcttctgttaatgctttagttccaaagcggaattttaatgcatttaaagttagactttatgcctttattagatgagcttgcacatgaaaataatggctgagctcggttccctgaaatgagagtgaggcagccatacctgagaaatgcagaaaaaatgttactagggaagagatatcctgaaccattggatgcattgcttagtgtgtaccagaaggataattaacacatttgctcctggtttttctttactctggtggcaatctcggatgcctgtgttagagtgagagaagggctgggggaggaaagggggttgtcctgagacagagtggatgtggttgtacttttcacgtgaatgaaaggatgtttgtgcttctgagatatggggatacctttctgtggtcaggatcatggtgtactcaagcatgtatttcaggggttaaactggaattcccctgcatggggatatgtgtgtcttagggttataggtccatttctgtagtgtgctgtccacatgattgcccaagagacttgggccacaaagtccacaccagcagctctcatgtgggtcactgggttcaagtatgtactcccttgttgcagagctcacatatgtcaaagcatgtatcctgtggggtgtgtgggcctcagggtctcagaatgtggatccgtgctatgcccgtgctcacagttgtctgtatgtctcaaaagcacatagatccccagttatttttctgtattgtggttctcatatacacgtacctccatagctcagtatatgtttctgtactatacacctgttcctgagggagtgatagggttctcgtgtcatggggtccacatttttgtatgcaaacctcctaacacctgggttttacaggtaaagggaagctgaggactgattctagggcagtttgcaggcaatttgcaattctggaagcagacagtgaaaatataattgtggtcctcccttgttctgttctggaacctagagggttaacaggcagctcttccggtccacccccctccttccagcctgtagcttcttgttgccgtggagatggtggccccgccccgatgcagcacctgcccccccattggctgcagtggtgactgtggggctgaggggggagcccaggcctgggcagccattctggagctggagccggagcttggcatccccccacttacattctcttccagcccctcggcccctctaaattcccttgcagccgagcctcagcttcctttttcagcgcttgccatccctctaggctcttggcagactgagctgcatccgcattcacctcccctcctcctcctttccctatccttacttgggagtcccgagaacccccactgtccatccttcctgctccctgcccattcccctgcattctttgcttttcccctccccccaccaaccttctgagcccctgccactgcagtgcacgtggaaccggctccttctcccttccccccacctgccccttccttggattttctgtccccagcttctccccctgctactcttcacaggtctcttccaagacctccccctccagtccagggagggggtcatgggaggcagccctggccctccagacagacaggggttccaggaggtggggggcaggtggaagatgtgcccaccagggggaagaggaaagcctgcctatgggcaatgacctttaacccatctttccccccagctagccccttctggggtgggtgggcaccagggacctagcctccctggatctttggtgtccttcattactggggttttactgaccctctcagccatgctcccctgctgactgccagccccagtcatgggcctaaggcctcccaccccatccccctcagggggctcctgctcaggttccttgccccctccttcccgctgccagcctctccgccgtcgctgctcttcctgctgctttccggggggtaggtgaggccggagctgaggggcagagggaggtgggggcatgcactggggtcaggggtgggaacctgggttaacagcttcccttctggccccctccccaacttcccttctggccatttcctcccctccagaataccacttgggtcgctcgaggaggaagagtgtcccaggggggaagcagtacagcatggagggtgcccctgctgcgcccttccggccctcggtgagtggtgcctaccagatgtggctcagttgggccccctcccctccagccccaactggggccctaggagtctgagaaagagggcaggagggggagagagggagtgagagtgagaaaaagagtgtgtgtctgtgtgtgtctccccacctctttggtttcccccttcttggctctgcccccctgcttctgagaccagccctcccaccttctccaagctgtgtgtgtgtgtatatgtgtgtgtgtgtgtgcttgcactgtacccgtgggagcaaggaagacaaactggtattagggttcctatccccctttcctcgcctctggagacttcccttttccccatcccactttcatccaggggctctctaccagctgagggatgagtaggtagaactgaccctgccccaacccaccccatccccatttcccccccagcaaggcttcctgagccgacggctaaaaagctccatcaaacgaacgaagtcacaacccaaacttgaccggaccagcagctttcgccagatcctgcctcgcttccgaagtgctgaccatgaccggtacaggggctggagcatgtgggatgagattgatgtaatgtagggtctcctgtgtgagatgcagagggagggggttatctgtgtgcaaaggttgaaggattcaactcaagttggttgggggatgtcatggcacaggggacagaacagaaaagaactagaatagggatctgtgagcagcaggagaggggtagggtggcagagagaagacagacagacaggctggaaagggaatgaaggtgaagccaaggagggactcctcagggactcctcaggccaagaaggatgggctctagcccaggatcaaaggagctgtacaggaggagagtgaccctggaggaatgtttaaggaatgcagggaaggggttggtaggtgagtgagcaataggctgtaggtggaagggtgtcagggaaggtcaggaaatacaggggcagcaggttggagtggggctgggggtggctgaatgaatggatgatggctagggctcaaggacctcatcagtgagggaagagacagtatagagcatggcagagaaggggaggctgggacaggtgtgcagggtgacagaatgggaagcaacccatggactgaggcatgaagaagcagccagcggagaagtccagaaggcactgtccctgagaccaggctgaaggagacctccactgtttgcctttgttgcctgccatttggggttcctctctgggtttccccctcacccagtcactccccagggagaaccatgccctccctttcccccatgtctggccacccccaggattgggcaggtagggaggttgggataaagtgagtcacacctttccctgcccccctcccatgttgccagagctggatttggggccggcagggggtgagggcatggtattcctggccgcgggggcgggggggggggtccgggggccgggggagcgtcgcgctgacggcagccagagcctgcgatgacggggctgctataaataacttcttggaggctcccacacccaagctcccctcccgctttcccactgctctctactcttcatcccctgcccatctccataccgcttttgtattgctatcctacccctcattattccatgcccctagccccctttatcttctgccctcctgcagtgatttttttgcattccatcccctcttagccctcacctcggttctcccggccatctctccagttggccttcctcctcttctcctgtcctctgtcttgctgcacatacctttgtctccccctttcttcttcttgccctacctcctcttcttccctagtccgtgtattctgtcttttatcctctttgagctcttttctgcccacagctttctcctatttcttatgcttttccctcactctttcccctgcttctgctaaaacttgtcctcttatgctgtgttcattcattctttgaatcattaaatgtttatcaggcactagccgtgtgccaggcccaggctagacatatctcttctctgtgccttcacttctttacttccactttttcctttatactgaggctctggtttctggggttacctggaggtactacctagaagtgccccaggcccactttgttctctccttttttttttttcttttctgccatggtccatttctgggttgagatatttctagatgtccccagtcctcgcaatcccttaggtgtgagatggtgggagtttcttttttttcctttttttttttttaaatagaaatagggtctcactgtgttgcccagactggtcttgaactcctgggctcaagtgaccctcccacctcggcctttgaaatgttgggattacaggtgtgagccaccaggcccaggtggagcaggggagttccttaaaggattctgatttttctcacatccctcacgtccttcctgataggcagggtttctttctgtgtctgtttgggaagggtgttcagggggccttctctccaagtctccatcctggaacagactgatgatgcagggtacctatgtgtctaagaagagtaggggggccgggcgcggtggctcatgcctgtaatcccagcactttgggaggctgaatcacttgaggtcaggagtttgagaccagcctgaccaacagggtgaaaccccgtctcagctaaaaatacaaaaaaaaaaaagaaaaaaaaattagctgggtgtgctgaggcaggagagacgcttgagcccaggaggcagaagttgcagcaagccgagatcacaccactgtactccagcctgggcgacagagcaagactgtctcaaaaaaaaaaaaaaaaaaaaaaaaggaagagtgggaagccctgatcccttcctctcctgaacctcctgcctgccagggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtactgggtctggtgggctggggagggccaaaggacaggggtgatggaaggtggggggcagagaggtctagagaaagtggcacaggtggggacatcaaggaaacagaaacttctgggactggaggaaagggtaggccagggaggaagagaaggtagcagagtctcctcccctctgtagccctttccctcaactccacactcctttctaggtaacaacttcatcaggaacaaaatgctttgcctgtcggtctgcggccgaaagagacaaatggattgagaatctgcagcgggcagtaaagcccaacaaggtattggggaataaaggggacacaacctgtgcagggcaaaggttgcaccaacacgggaagctgggggcctagggaggaaagtgagttaaaggaggagaggcttggggaaggagaggattgaggtacagtgtatctggacaagcagggggagacccccattattctgagtcccccatttcttttcgctttctgtactgctaccctgccttacgatctctttccctgccatagaagtcatagacttacagagttgatggggctctggaaattctttagtctagcttccctgcaggcaggaatgcttcactaataccccgcaggacacatcaaatacacttagccaagtttctgtaccttggtttcctctctaagacagagggaactggtggcaatgggttggattaaatgatctctaaggtccctttggcacataaattctatgagtctgttcttcccaaaacttcatgcttccagttctgtcagctattctctgtatcccagtttctagcaagcttacagtcctagtcacactcctctggggggaactcttgtgtcttgatgtccttaaagaactcaacccaagatgctgacatgatctgacctatgcagagtacaaacaccatgttccctttcaacacactgcaatatcacctgagccttaccattagcttgtgctcaattgtatccccccaggcccttactgattcttttttttttttttttgagacagagtctcactctgtcacccaggctggagtgcagtggcgtgatcttggctcactgcaacctccgcctcctgggtttaagcaattcctgtgcctcagcctccccagtagctgggattacaggcatgcaccaccacacccgactaatttttgtatttttagtagagacgaggtttcaccatgttggccaggctagtctcaaactcctgacctcaggttgtctgcctgcctcagcctcccaaagtgctaggattacaggcatgagccaccacatctggccaagctttacccattctatatgcaattcttttttcacaatttctgatagtctctgcaggactttccagttcccttcaaattctacattaatatttttggcttgttattccagcttttgaaatctttccaatactgtttgtgttgtctagtgtatgtctacgcttctacagtagcttcctggggctgctataacaaactgctacaaactgggtcacgtaaaacaacagaaatttattctctcacagttcaggaggctggaagtccaaaagcaaggtatcagcagggccacgctctctttgatgctgtagcagggaatccttccttgcctcttcctagcttccggaggttgccagcagtccttggcattcctgggcttataactgcatccgtctaatttctgcctccatcttcatgtagctggcttccttctgtgtgtctctgtatcctgtatctctgtgtctccaaatctccctctccatataaagacaccagtttttataaggtgggttaagggtccactctaattcagtatggcctcttttttttgagatggaatatcgctcttgtttcccaggcttggagtgcaatggcatgagctcagctcactgcaacctccgccttccaggttcaagtgattctcctgcctcagcctcctgagtagctgggattacaggcacgtgccactatgcccagctaatttgtttttgtatttttattagagacggggtttcactatgttggccaggctggctcgaactcctgacctcaggcaatccacccacctcggcctcccaaagtgctgggattacaggaatgagataccatggctggcctcttcttagtttgattacatttgcagggatcctgtttccaaataagatcacattcacaggttcagggtagacatgagttttggtgggatactattcaacccagtacaccgtctcaccttatgattgctgtctgtatcccactttcttactgtctctcctcttttggtgtctctctgtcccttccccctttaacatcatgcccaccccaccatgccaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggtgagtgttgtgccctcagggaaaggtgacttgggaatgggcacttgcttgggggttagtgaggacagggcaaattcacgagattgggttgtgcagaggctgacacttggattttcctgggcctcaggacttcctttcagacatggccatgtctgaggtagaccggttcatggaacgggagcacctcatattccgcgagaacacgcttgccactaaagccatagaagagtatatgagactgattggtcagaaatacctcaaggatgccattggtatggcccacactcaggccctcttcttcccaaacctgccagatgtccaccccagaccccaagtccacccttccacagcttgatacttcctaacccagagtcctaggactccagcctccaacacctgattctgaaatttccccaaccctggccacccccttccctgcccttggaaagtgtgaccacaccctcttgtgcccccaccccccaggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactggtgagactgggaacgctgggctggggggccagggtcgggggaattatgtgttcatctgttcatctatctgtccatcctcaaagaggactgagcaccatttatgggcaaagcattgttctaggcgctatagagcaaacaggtgaaagaggcctggtccctgccctcagagggcctccaccagaatggggacaaattagaagaaaaaaaaaaaaagccacagagccataatggtgtgtaagtgctgagtaagggtccccccaacctctgtgtgacataaggtcagagagaaggcagagctttgagataagtggggaagaggtgcccccttgggtaggctttgaagactggtttaggttctgatatatggacatagttggcaagaaagacatttcagaagaaggctgtgagaaaggcacatgtgtgatggtgaaaaggcccaggagttttcaggggacattaaagtaggttagtagcaattacatcaggtttagtggagcatgtgcctcataatggggagtggcgggagagatgtctgggcaggaagattagctttagaaactggaaggcctcaaggagtctgaggtcattggtaggccttgggatgccattaaaggtgtcagaaatattgtgatttagaagattaatccataggctgggcacggtggctcacacctgtaataccagcactttgggaggctgaggcgggcagaccacctgaggtcaggagtttgagaccaggctgaccaacatggagaaaccctgtctctactaaaaatacaaaattagccagatgtggtggcacatgcctgtaatcccagctattcgggaggctaaggcaggagaatcacttgaatctgggaggtggaggttgtagtgagccgagatcacacgattgcactctagcctgggcaacaagagtgaaactccatctcaaaaaaaaaaaattaatccataagtagagtgtatgtagtagagtagagggatgtatgttgggggatgactggaatagagccagctgggggctcggaggcatgaaagtcagatcctgaatcagaacagtgacagaagttaggaaggagctactggaaggaccctctcgggaaaggatcagtaggaattgtcagcttattggaaaggagggagcatgtctgtggggagtcacggatgactcaagaggccatgaggctggtggttgggagaccggtggcctcattgacaaccaggaaagtcaggaggaggagccagttggaggtgtgggggcgatggtgagctctgctttacaccagccgagtttaaggtgtcagtgggacattgaagtggaactgggaggtgcggggagtgagctctgagccattccagggactggggatcatgcctggggcacctccatccccatttccctggaatccagaagagttggggggtccgagctccctgtacctcaagtgaccctccatctctctcccatctctgtctctccctggtgtctgtttttcttctcctcctctccttgtctctctcccacacccctccatctctctcccacgtgtctctcccctcaccttctctccccctccatttctctctccctaatctgtctgttccctctgccatggcccccttcttcaagcagcctcccatcttgctcctgcggtccctccttccctgtctctctcacccctgtttccacaccctcacctcctaccacccccctcagcatgttccctggaagctgagggtctctggggctcagtcccggtctctctctttctctctctctctctctgtctccccgacccttccccccagcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtgagggaagcttcaggagtgggcagggcagggagtggcagggcagggagtggcagggctgggggtcggcaagaagggtctcctgagtccccagagatcctgagatggggaggctatgataccttgtgtgtgtgtgtatgtgtgtgtatgtgtgtgtgtgtgtgtgtgtgtgtgtatgtgacctttatcttctgcattcttggctaggtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggtcagcagatcccctctttgccctatccccagatggctccagaggttcctggagcctgagaaactaccctttgaagattttttttctccccttgtttctcgaggtgtcaccactactatcccaactcaggccccctccacctgcaccctcagaggccctcttagagctgggcactgagcccccaggtaacagcctcacccttccaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacaggtgagcaccctgggacagccaggcctgtgccctaggagcccttctcctattctagatactcctcactgggccccacatgcatctctctagggcttgaaagaagggaggaaaaagcaccaagttctcaggggagacgataaggagacaggtacagtcagtggtaggctgagagccctttacagcctgagggagtgagagatttggagctctaggaatagggctgaggctccaccaactcacggcttagttgtaagcctagagcatccctgctgcaagctctgatttgctgtccctctgcctgcccatgctagtccccaggctgaggttcagccagcatgtcatgtcagccatgtgtcaaaatgttcaaacatctcagtaatagctagtgaataagcacttcccccagcccccgaccacaaccccacagacctccccatgatccagcacttagagcagtgacagcagaagcctagcagggcctgcagcctgctccagagtcccagcctccattctgataggtggtgcccgtgcttcatttgctgctcattattttgatgatggccctgctttttcctctgcccgtgtcttcctccatgacaccatacccatcccaccattcccgcctctcctttcatttgtccacatctctctccttctctgtctgtgctcgcccctctttccatctctctccagctccatcgaccttcagtccttcatggctcgaggcctcaacaggtgaggggctctcccctcccccgccctcctctcctctcctgtctgttccctctcccactccactggccttcgccctactcctctcctctcctcctccatggacctcatctcctccatatgtgcccagccctgcccccatcccttctcttgctgcccccatctcccctcctctaggcctcacccccttcccggaggggccctgtcctttccctttactcacctgtcccctcccatcctccctgcctgccctcttcagggctgccaccgctagctctcagcccttccctctgggtcccacttttcaccccaaggcctgtgccagaccacagcaaggttcaattgctaggagccctgaccttaccttctgcttgtgtgcccccttcccttctgacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcaggtaggtgaaggcaggaggaaggcgggctgggtcacaacagggagggaagaaggagatggggggtggggttgaaacagagtctgtggcctgaagttacaatcttcttgcctccttttggccattaaacaaatgtgtatagagggcctgctatgtgccatgtgctatgccaggcactaaggatacggcactgaaccctcttagcactctcattccagaggggattaatccataagtagaatgggggtgactggaatagggccagctgggggcttggaggcatgaagatcagatcctgaatcagaacaacaggagaaattctctggcattcaactcacatctctggcattcagaggtgataaaggctacagcagggcaataggactgggactgtcgtctcctttggctgtgctgttgccctctaaatgtaccctgctttttcccaccttttctttctctgttcgccctcactgtgccttgtcccagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtacgatgggctctaccagctccaagccccagtgtttccttttacccacaggggagatctctagtcacttccaagggaaacctccagggtcagttatggtggtaagaaaaggcaaagacctgatcacctcttgagaagccttccgtccatctggggagaccagatacacacagttgttaaaagtcactttcaactctattttgtaggttatatatatcatagactatctggggatcatctattttaggcttacctccatgttcttccccaggaggaacataagccctggctcctgtgactgcttaggaaaggaaatgttactttactggcagtaggagctaataaattggatggggatggagggggttgcagctatattacaagtgatgtctggcctacccagtcactgtcccatgggcataagtgacagtcagtgggcagggaatgcatgtggtaaagtagtatgtatcagtcatgtgtgaaaagaccatccagaccctcacttggtggaggctgagggcaaagggcaccaagagctctggggctaacacagataacttagcagaaagttacttgaggaagctgttgttcctagggcctgaggaagagggcggctgcaggattaggtcatatataaagaacatatgatcctaacacggggaagtggtctttgagcataggaaatgttgggactgactcagatgggcttgaccagcaaatttaatgagaattaaaccctaatattagccccaaggcagccaccgtaggaagttaattcacatctctcctctgcatgtagaagggttggtgatatatgtatgtatcctcttcagagaatgaggaaatagtcttttgaatcatttttttttctgtgcttcagatgaggaaaccttgttgagaaaggctgtagactagcactatccaatataactttctgcagtgatgaaatgttctgtaatctgtagtgttcacatgtgtctagttgtgattcaggaactgaatttttagatctatttaattttaattttgtaatttttttgagacagggtcttgctctgtcacccaggctggagtgcagtggtgcaaacatggctcgaggcaacctccgcctcctgggctcaagacatcctcccacctcagccccctgagtagctaggactacagggtcgtgctaccatgcctggctagttttttttcttttcttttttttttttttttttttttgtagagacggggttttgccatgttgcccaggctggtctagaacttgtgagctcaagtgatctacctgcctcagccttccaaagtgctgggattacaggtgttgagccactgtgcctggcctaaattttaaatagctacatgtgggctggtggctaccatattagacagcacagctgtagactctagagccaatagggcagataaaatgactcttctgagctcttccagctctggaattcctagattctcagcctagaattcacttgtagacctcctatccttggcaccttgacagagccaaggagagggtcacatggaggacagcacctgcctttcccccgtcaattgccttttcttcctatgtctccagcatgtgttctggggcctggcttagggctgaagagtcaccctatttttaatttctgagcacagttactcaaggtgtgtttgtgagtgtaggtttctgtgtgggtcttcatgaggggccatacatagacctcagggtgtgggagtctgtgaccttgctccattttgagggaacctcagcaccatggcagggtcttctcaaaagcaggtgtgtggatatgatccacaggcagggaaggggttggggaaggcagctggatgtccctcaacatgcagtggctgtgcttggcagacagggatggaggctgggtggtgggcttggggtggggcgcccctcatagtgcggggtcgtgtgcccggcgggcaggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggtgaggggcggcctggggagggggttgtgagggagagcctgaggctggagagagcaagtgggtgagctactccgctgactcccatccccaaactcaggagcccaccaggagagcccaccactctcctccccaggaagccacccactcactcatcaccagatggagagaaaccccaacctgcttagtgcattaaatatctctttaccaaaccctgacctctcttctgatagagtagcttcggaagcccttggaaaatgtacctgttcctgtccaaccatcactgcatttgcatttaccctaggccagagctccccactagttattctcaacttaacctgtgatgttcactccaaacctaagcagggctccctagccagagtaggccctgcccttcctgggtggaccctccctctctagccttggaaaggtgttctgttagaaagggtcttttagcctgtgtatgttttcagctgctccagcaagtcctgggctccaaagagggtatcctcagcaaagaggtcaattatcttcagagtggtggggtcggggtgggggggaccctgggcgcactccaaccagagccacctccattttgatccattctaaatgtattttatgtaagatttaattagaagaaaagggcttcttgaaatattttttgaaaaccactgctctaattgatatcctttatgataaatcacctcgaggatcttcacagtgaggtgacatgggggatgcagaagccaggtcctcagccatggaaggtctggggaaggggcactgctgtcctgattgggacgatggaggcctggaggtgtctggatggtagaagtctttgaggcacagaaagctgccttagcagggaggtgtaagggttcctgggaggaaggtggagagcatgatcctgaggaacagggagtcttgcatcacggcaatggagggactctgattctaagggataaggatgcctgaggtttttccagagagctatggggttccatgggcaggctctgagcctgtgcccgccactaaccccactgaagcccgtcccttcaggctgatgctggtggaggaggagctgcgccgggaccaccccgccatggctgagccgctgccagaacccaagaagaggctgctcgacgctcaggtggaaattacaatgtcatttatcttctccgtgtcccatccccatccatcccactgtctttcgtgcactcactacaccagccacctagccccatcaccatctgtctctcatagtctgctgtttgtccactggctgctcctggcagccccctagtgaccccatcttcatcccatcgtctgtgcctttgtcactcctggcagcgtcagcccaactcctgtgccttcccatccagtcttcccactcctctctgcatctcaggaccttctctaccagaaccttggtctttctgcccctagaccccacctagttccaagaacccctgccccttctttgctcactcctattcaagccacgttgttcagcttcctctgcgctcttgggccagagggctagaagctgccgttttctggaatagagcacagggcagtatgatctgtagtttctccaggccctggccggtaccctgaaaacttggggacccatcacctctgttctcttggctccctaattttcctgtctccttggcagctcctgcatagcttcctcttcctgactcttcagatcttgaaggccttccatcctgtaacctccctttgccctcagtatttaagtccagcctccctctggcctccctcccactctggccctcagaccttcccagctgcctgctgcccagcctctcttctcacaagccagcttctaggacctcccttctgcacccttaccccttgctttcccaaaattctgctcattttcctacccatactcctctttgctctgactgctaggctccccccgcctgccatccccccaccaaggctcctgaccccatgaccccactctctcccactgcagctcctcatcaggtaattctcctggttccgctttggccacgggcggaggacacagggggaggtgactccggaccactgcaggttggtcgtgaagcccactccctccaacacctccggagcctctcccctctcactgctgccctccacacccagagaacctccacagactccagccctccgacacctgcacagatccatctcccaagacaccacccaaagagagcatttgctgctgcttcccagaactgtccaacaataccttagcaacaccaagagttgggccctagatgggcccagcacattcacaggtcacacccacttccctgcaaaacccaccccctcccagcctcctcctgactctaagccctcctcttcctctacctctccagtgtatgtctgtcaccccccatttcaccagagcgtccttaggggctgggggtgggtttgttaatggggtggaggcaatgatgggttggaggatcttggctataggggctgtgctgactgcagcaggtaggttgggtttccctcttccttccctaatcttggttctctaccctcctttccactcctcacctgattctctctcttcctcctccttatatctgtgaggcagaaggcatctgaagctcatattagcccccattgggtgggaattaggagtgggtagttaactcagggagacttgagataccctggaaaaaatgctattgagatgtcctgacattaggcagggtggatggaacaagaaggagcaagaaaggaacctcaggcagatgttaggacatggacttgatcatgtggcctgggagtttagaaatggggagagacatcctcctagatcagatcgtgggctcagtaggcatgttgattcccagggagaggtgccaggaacagcatggtaaagaatgtactcttcacagctcacatccccaggttgctgatgccactcactccccctctcctgccatcgagtggccttgccggacacatcaccctacctaaaaagccagtaaatgagaacctgtcagctatagccatcatttctgagatgcgattttctttgggattgagctgcagtgggcagtggctccttacactgtaattttaattctctgcctgcccagcctctctgtcaaagtagctggtgatctataaagatgctaaaaggcaccaggggactttgccatttaaaggactcctgcagtgaattcttttgtaaaatgaataatggcaccctaatttatccactttctaaatttgggtccatgggggtgtccagggcatgcttatgtgctgtcaccagcagacaaacagagggaatggaatctgggggttccttccctgctctcccgccatactcaggataccctaccataagtgatttcctctcactgacttgcagaaaatgtgtgagatacccagcaagctaagaaggcagttttgctgggtatctcatacccaaggctggggtttgggtgatctgagaggttagctccttgatcctaggatggaagggagagcttatatagaagcttttacttggaaggttttgtatcctaaggtcagacatagctatattaccaagcctaaatgccatgtggcccaggaaataatttggacatttgttctaaaccacttgtggtaggtattggtctctctgcaactcagccattaattagaaattagttttgagcctgaattttaaaaagccaagtgttgcccccagcccacacacacacacacggacatgtacagtacaaaccccagataattacaacagccaaagagagaaggaagtgaatttcccaaccagaagcgtagggaaattcagatggctttcttttctcccagcagaggaacagaaggcggagctaagggcaggaaccaggagttggtcaaggagctataggaggtgatgagagtagaaccaggggtaggagctggtctggtacccctcaccctctaattgggagcccagggagaaggactgaaaagaagatgggagtggaaaagaataaagccagtttctgcttcccagggatgcagagattggggcatgctgtgtctgcagaagctcctagtcatttccgccataattgtgagagagaggggcagccctcccacaagatttttcccttcccatatcacttccctgaatccccttcctttccccccagtacagttaaacctctctctaatttggaatgttatatttgagaagatggccactgtgaataagtgacaaacggaatgacagtgtctatttaatgaaatgcatgtcttcaaaatatatacagaactcgatgaacaaggctttttccactcctcagggagcatgcattaatgaatagataggattcaaaagtctgttttctggtatgggttaaatatcccctcctacagacatatttccaccactaatttgcttagtacaccttttcttcacagataaaggaaaatgcaagctcagtttttcttcagattatgaagaaattccaaatccacaggggtttggattaatgaggttttgctgtactgcctccccttattcctcaacatgaagttcccacctcggattggggatgggtgggagggggtttcaagaggaggagggtgggatgggcaaggaatatacacaggtgaagccagagaagggttaggttgggggtgcggtgggaacttgctgttttgatctggtttcctggtgtgacactctgggttaaaggcttgaaggcccctgttaggagtctaggggtgagattctcttctctctgatcccagaggacgttaacttctactgcaggtgagaaacaaaataggaggatggtggggactgtcctgggaggagggggtggtccatggcttgtggtgtgggctggctataggggaggccactgctaggggactggcatccaggcccccttgaagcgtctcaataagtccgcgctctcctttttggtgtcttgcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttctttta

SEQ ID NO: 768 - DNA, 1748 bp, Homo sapiens
aggcagagagacccaaagacgggatttattgggggcccagtcatcacctggaagtcagaaggcgttgaagtatcgcggggatcttcatgatgagcaggaacagggctcatcatggcaggactgtgatagagtcagaaactgactctgtgacctggcgcacccactgcaggtacggaaagttcccctgttccacaggcaatgcaattacctcggccacttcgtaagggtgcacagaactacaaaataggtgggtgggggaaggggatcactcaaagatttacccaaaagaacccactcccttacacgcaagccctagactgcccagcaagtcacacccacacagtacacaccctcaccccatccatctcaaagttctcaccgaacaaaatctgtcaaagctgggaccaaggaactttgggttttaatcatctaagggacaaagataaacatggttgaatcaaggagtgggattgagttcagtttctcagaagaggggtaagggctaaaggggtcagggattggggatattttgttgggtgggggaaatgtttctcaccatcagcacctcactgtcttcctcgatcttccctttccactcatagctgaaaggtcagagggggagagttgtggggagcaaagaatttcccccaggaaagaggttcccagtcagctcctacagttaggttaaccccccaactcctatgactcacatggatgtaatctgagggatgaggttgacgcaggctgctaggcgcttctccaccacggccctggagtgaagagacagtcccattcagagtaccccataaccccagtttttgtactggcagcccagagacaggcttccagagctggagaaaggagaaagcagcactcttctgccccacccccaactgtcccttcatgatcatcctttctcgctgcacatcgaggtccctacctggcgatctccttggcgaccttctcgttggggcaagtaacaaaggctgcagagaccgagcccggaacgtagccagagccggaatccgaggccggcgagggctgggtcggagggcttccagaggccatggtcagcaagactcggggtagcaacaaaaggcgggaggccacaggcagcagcgccggcatccaaacaaaagacaggagcagagaggcctgagagcaggaggcgaattcgatctctcctcacaaacagcccaggaaattacacccggggaagccttcgcttagatcctcaggctctgccctccctctgatgcacccccgaagaatgcccctgaaggtgagagagaaacttggaaaataaagcaaaagctcatttcactcacacctcagggggccaacctctgggatttagggtgcgggtagcggtcgaggcttcgaggaccggaaggggcggggcggggccggtcactcaccactccgccgagcaggaccgcgggagcccgccccccactcatgcggcctacgctggtacaggagagttgatctcaaaggccacacgtcacacggagaaacaaccccaggaagagcggcctcttcttacctgggtggcagccacgtgattagaaaacagcgcgcaccatgtgacagtagaagaaggaccacctgcgcctccagagccagccaatcccgaccctatcatggcgcggtttgcccacctcctgatgaaggaggagccatgggagacttgaccaatcgactaccgcatctgcagacgtgcgcggaaatggcacgcccgtttccgt

SEQ ID NO: 769 - DNA, 5459 bp, Homo sapiens
cctccctcccccccgccgcctcctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggtaaggaggcggcaggaggcgctggtggggggcagggagccgggggtcggcgcggggcgcgggcgggagagcctcgccgccttggcctcgggtccgggctgggccgacacaagtcccttctcggacttgccgtcctggggagtagagaccgggactgggacacgcccccctcccggggcactcagagaagttgtctaacccgggggcagggagccccgaatttgagggtgacctgacataacctggcaccaggatgattgttcttaatgagacgcgcaggcctggggagacagccgtttctgctctggaaaacatctccagaaaaggtcccaaaacacgtctctgggcaacaggacaccctaattatgatacctctaaactgagtagcctttgcttctacaaccataatttctcctaaaatttcaaggccagtatataatatcccaggagagctctggaagctgggaaactagcaactaggtttggggtcggggggagggctgttagttaccgagaggagagccagtcactagagttggaagaggactcaaaaagctggtgatgggtgcccagtggtttcctatcaaggtgtctcagggatttggagatgggggcacagatacttcattcttgatggcaaaataggcaaagaaaatggggaggctggccgggcccggtggctcacgcctgtaatcccagcactttgggaagctgaggtgggtggatcatgaggtcaggagttcgagaccagtttggccaacatggccaacacctcatctctactaaaaatacaaaaattagccaggcatggtggcatgcgcctgtaatcccacctacttgggagactgaggcaggagaattgcctgaacccgggaggtggaggttgcagtgagccaagattgtgccactgcactctggcctgggcgacagagcaaaactccatctcaggaaaaaaaaaaaaaaaagaaaaagaaaatggggaaggtttctcagcattcataaccttctcctccccatttcttttctggctaggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtaagaccttctacctctgaccttcttcctagttcccttatctaattctggttcccatttcatcctgtttgctcacccattccaggtggacagtgctagggaggtgtgtctggtccagtttgaggatgattcgcagtttctggttctatggaaagacattagccctggtaagactctagagacctgagattgcacatcccatggaaaacaaacctggcctagaggggcagaaagagacttaaaggcaggccctgtgacactgtgttctctcacagctgccctccctggagaggaactcctctgttgtgtctgtcgctctgagactgtggtccctgggaaccggctggtcagctgtgagaagtgtcgccatggtgagagggcaggtcacctgaatggtccagcttgctcttccctccaggatggtctctatatcacctgtcctggccttagtccccaagccactgctctggccaggctgcttagccttatcttagtcctcatccgctttcagcccagggagaagcagccatggaaaggggtggtataacctttgcaggcagaagatggtttaaatgcatccttttctaaccatatgacctcggacaagtcccttaacctctaggagcctcagttccctgacttgtaaaataaggataatgcaccccctcatcaagaccatggtcagggattaaatgagatgggtaaagactattcctgtcccaataccaagcacacacaggtatgcaataagtggtctactattatcactgcagcttatcaccaggactgccatgttcccagggctccagcccctggagagggagagggcacatcctgggtatgccgccagtgtgtctttgcgatcgccaccaaggtaaaggcacttccctgttacccttcctgtgggagcctcccatccacagcctctcccaagccttttcctctccccacccctctgaagccacccacctgtcctgtctctgcagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtgagtaatgagaggggagcagactgtggaatgaatgatgtggtggtggatcccaggaaatgaaggaaaaagaacaggatgagggtagcactcagggggataggaggtaagtttagggtttgggacagttatggggaagggggtttctggaggccagaagtcctgtgttccccctcaggtggaacctgaaaatgctgcagtgccggagctgcctgcagtggttccatgaggcctgcacccagtgtctgagcaagcccctcctctatggggacaggtgagaccaaggcagactctctaggagccaaggatgccctctttcttcgtgttccaccctcagttctcccacgcccttctccactccagtctcttcccaacctctgcagcgttacctcacctgtttgccccgtccttgcttgtgagtcttccaggggatggcacagttttcctgtgtaagtgtgtttgctccctcttgcccatgtccaggttctatgaatttgaatgctgtgtgtgtcgcgggggccctgagaaagtccggagactacagcttcgctggtgagctggattgggcatgacctcagtgtaactccacaccacagtatttcactctatatgccccaacctcccacctcaggactcccctggctcttaaaatgcctctgtggtcttgaaaactttgtttttccagggtggatgtggcccatcttgtcctgtatcacctcagtgtttgctgtaagaagaaatactttgattttgatcgtgagatcctccccttcacttctgagaattgggacagtttgctcctgggggaggtaaggggtagtgcagttttgggggttgggatgggacagggagatgtagcggaaaggggaagagaagaaatcactgctcccctggccccatttttcttcatttctcccagctttcagacacccccaaaggagaacgttcttccaggctcctctctgctcttaacagccacaaggaccggtgagttggagggaagaggaggcaaggatgaggctcggaaagagatggagagtggaagcctggaaggggaggggcttgcaacccacctggaagactgtgactgaaaaggattgaggaatggcgtaaggaggaaccgttttttacagcactgaccctatatcatttctcttcttgccccagtttcatttcagggagagagattaagaagaggaaatgtttgtttggtctccatgctcggatgcctccccctgtggagccccctactggagatggagcactcaccaggtcactggtccaggggggatgggggaaattctcagggtgttagtcctggggggtatatgtatagagatggggaggtcttgggggtgtccgggagggggctggggggataaggaggcctcttacagcttcccttcagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcaggtactggagcagggggaacccgatggagcaaatggtggggtgtgggaaggagtcaaggattatctctcagtcctttgccccctcttctaggcctcagtgtctccaccatcccccagccctaaccagagttaccagggcagcagcggctacaacttccggcccacagatgcccgctgcctgcccaggtcagtgctcctctgcccctcccccacaaaatatgctcccaattattcacatcttctggactttatcacccagaattcttttccctctcccccttggctacccacttcttggcctagaccgacttctagaactagtgtctggtagccagtattctggggaagggagtcccttgggggtagtgtttgagctctgcacttcccagggggagaaggtcctgttcccctgcttcaggtcctgactttccccactccaaccccagcagccccatccggatgtttgcttccttccacccttctgccagcaccgcagggacctctggggacagtggacccccagacaggtgagattctgtcttctattaccagtgatgctcttcttcccctctatgtgctcaaggctcttagtctctaacactgtttctctgattcacatgtgctctccatttctgcccatttcttacaattgccttctctccctaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaatctagcagctctga

SEQ ID NO: 770 - DNA, 5459 bp, Homo sapiens; identical to SEQ ID NO: 769

SEQ ID NO: 771 - DNA, 5459 bp, Homo sapiens; identical to SEQ ID NO: 769

SEQ ID NO: 772 - DNA, 1748 bp, Homo sapiens; identical to SEQ ID NO: 768

SEQ ID NO: 773 - DNA, 1748 bp, Homo sapiens; identical to SEQ ID NO: 768

SEQ ID NO: 774 - DNA, 1748 bp, Homo sapiens; identical to SEQ ID NO: 768

SEQ ID NO: 775 - DNA, 1748 bp, Homo sapiens; identical to SEQ ID NO: 768

SEQ ID NO: 776 - DNA, 964 bp, Homo sapiens
tttaaaagttatgagaattgtcctttcccttaagaaagaacctaatgacactttctcgtacctgcctggttttcaccccatacacaatagggttcattgtgggaggcattagtaggtagagattagccataataatatgtatgtgtagaggaatggtgtgtcccccaaaatggtgtgtaaagaaggtaaagaaggctggaacataggtgaggactatggcacagaagtgggcagtgcaggtgctgaaggccttctgtcgagcatctgctgatgatagactcacaactgcttgaagaatcatagtgtaggagattgtaatgcacaggatatcaaagcccccaatcagcagggcaactatcaaaccatagatggcgttaaccctgacattaccacaagatatcttggccacagacatgtggtcacagtaggtgtggggtatgacgttgcccttgcagtatggaaggcgcttggtgaggaaagtggaagggataacaagcatcacacccctaagaaaagtgaggaacccagctttagcaatgactgaattagtgaggatggtggcataacgcagagggaagcagatggccacacagtggtccagggccatgagcatgagcaccccagactccatccctgtgaaggtgtgcacaaagaacatctgggcgaggcaggctttaaaatcaatctccttgagattaaaccacaatatgaagagagtgttgggaagggtgctggtgcacatgagcacatctgtgaaggaaagaagggcaaggaagacatacataggtctgtgtaaggcctcatcacagtagatgaggtacataaggccgaagttccctgtaatagcaatgctgtacatggtacacagtgggaaggagatccacaaatgcacatcttccaaaccagggatgccatttaggatgaatgaagctggagttaggctggtgccatttagaaatgacat

SEQ ID NO: 777 - DNA, 1035 bp, Homo sapiens
cttccatctgaattaagttgccttgaatcaacctgcacccttatcaccctggaagaactttatgacactcttgcgtatctgttttgtctttactccataaacaatagggtttagagttgggggaagaagaagataaagattagccacaatgatgtgaagagaagggggaattgtgtgtcccccaaaacggtgggcaaagaaagtgaagaatgctggaacataggtgatgatgatggcagatatatgggcagtgcaggtgctgaaagccttctgccgagcatctgatgaagagaggctgatcgctgccttgaggatcaaagtgtaagacaaagatatacaacaaatgtcaaacactccaatcaggagagcaaccattagaccatagattacattgaccttgatgctggcacaagatagctttactacagacatgtggtcgcagtacgtatgggagataatattgctttggcagaaaggcaaacgcttaaccaagaatgggaaaggaatcatcagcaatacacccctcaggaaggtggcaagctcagccttggcaatgatagggttggtgagtgtggtagcataacgcaaagggtagcaaatggctacatagcggtctagagccatgagcatgagcaccccagactccacacctgtgaacccatgaacaaagaacatctgggccaagcaagcattgaagttaatttctttgagactgaaccagaagatgcagagtgcattgggtagagtggtggtgcaggtaaggaggtcaatgagggagagagcatggccaaaaaaaaaatacatcggatgatgtaaggactcctcataataaatgaggtacacaagaccaagattccccacaaggaagatgatgtacattgtgcagagtgggagggagatccatacatgtactctttccagaccaggtattccattaagaataaaagatggaggagtcacatgaattgttggaaaccagcataatgaattaaatagaggcattctatttttccagaagtttcatcctgaagagaa

SEQ ID NO: 778 - DNA, 18388 bp, Homo sapiens
tgcggcgacgtccacgcattttctgacgtagcgagcgacggcggggagccgagcggaagtccagcactattgccgctagaggaggggaggggtgagaagcataagtggcaccggaagtggaattaatccgcctacctctcctgcgcctgcgaaacagaaaagacaaggcgcctgtcgggcggggtgtggcttcgggtggcggagaacgctgcgattggccctcggctgtggcgacagcgacgattggtccctgcgtgcagagcgcggtgagagtgggtggtggccgttggaattcaaaagtggcgggtgtggcgcggggctggtagcggccggagccgtgcgagttctctaccctgcttcgcgagcgggcgagagaacgcgagtcccaggatccccggcacccagttctcttccactgcattcccccggcgcgtgtgggaccgaggtggacatggatccgcaggtgagtaggggcggcgcaggtgtcctgccctggggatggggacgaaggctgaccgctccgatgctgtcgcgcccccggctcccggtcggcctttgtcatgtctaccgggagagcgaaggtccgtgcgcccccgcacaagtggaaaggggcggaggcaggagtggagacggcttagagcacccggggaggtcggaaggcacgtctgtctgccctcccctagcttcaagtttctggagcccctcccttaactttcatgtctccgagatttctcatttcgaattctcaggctcgtctgacacatttccacttctttattcctactcagggtgtgattgcagtgtgtaagaagggagagttctgatatgacttcttccttttggggacatggtgtctgaggccacatccttgctgaggtccttttgtgttaatcgcctctccttatcactgctgcttcggagtgtaggaaagggagaaggagagtagggtaatctgggccaaaagacttctcattctctctctcctttcccaaattgtgcagattcctgcccaatgaaactgattgatttagttctttctcttaaatggtgccctgctgcaccccacaaccatatgcagcttcctgtctccagtgaagagagatgaatgtgtgtgacagctggagtgtacttatctctggtgccaggaaaggtctgcctgaatcctttgtttactagtatttcacgttcaggtttccctgaagttaggattcagccttaagagagattctttctctcgtgacaaccagagagcagagtagtattatgtgacagtaagaagtagtaaaagccttctcagatctattaatcaagtatttattgagcacctactacatgctaggcgtggttgtaggtacttaggatgcagcagtgaacaagggacaaatcgttgccatcgtggagctgccattctatggggatacagacaataaatgtaataaatgaattatataactgccagaaggccgtaagtgctgtggagaaaaggagaaattcaaggttgaggacataggggaggccaactggcgggttagagtattaaatagggtggtctcagtaacccccatggaaaagatgagttgaataaagacttgaaggaagtgagggagacagacaagcagatagtgagggaagaacatttcaggcagagggaatctgctagagcagagtccctaaagagttgtaaggagggaagtgtggctggaatgaagtgagcaaggggaaaagttgtgggaaaggaagtcaggtaatgggtagtggggttgctgatcacagtttgtccttgtgggggtcgttgtgaggacttttactctgagtgagatggggaatcattggatgattttaagcagagagataagatttgttgggtccaccagattttcgtaaccatagcaccattgcctttttttttttttttttttttttgagacaggttctctttctctgttcccaggctggagtgcagtggcatgatcatggctcactggagccttaacttcctgggctcaagtgatcctcccacctcagcctcctgagtagctgggactacaggcagctgccaccatgcctggctgattttttgtatttttaatagagacagggttttgccatgttgcccaggctggtctggaactaactcctgggctcaagcaattcgcctgcctcggcctccgagagtgctgggattacaggcatgagccaccgtgccctgcaacatttttttttttttttttgagaagtagtcacgctctgtcgccagcctggagtgcagtggcgcggtctcggctcactgcaacctccgcctcccgggttcaggcgattctcctgcctcagcctcccgagtagctgggactacaggcgcctgccaccacgcccggctaattttttgtatttttagtatagacagggtttcaccgcgttagcccggatggtctcaatttcctgacctcatgatcctcccacctcggcctcccaaagtgctcggattacaggcatgagccactgcacctggccaacattttttattgtcgtgactaggtggggggttgctactggcatctagtgggtagagggcagggatgctgctaggcatctgacagtgtacaggactgcattggacattgtcaaatgtcaccttggggataaaatcacccccagttgagaaccactggtttatgataatctaggtgccagatgatggtgtcttaggtcagggtgatagcagtggaagaaacagtaaaaagtgattggattctggatatattttgaaggtacaatcagccatgctttgctgacagattagatgtggtatgtaggagaaagagaggactctgggtttttggcttgagcaactgaaagatggagttatatcaattgagatggagaaagctgcaaaaggagcaagttcaaagcagggttggacatcaagaggtcagttattagacttccaaatggagattttttttgatacggagtctctcactctgttgcccaggctggagtgcagtggtgtgatctcagctcactgcaacttctacctcccagcttcaagcaatcctcccacctcaatctcccgagtagctgggattacaggcacgtgccagcacacctggctaatttttgtatttttagtagagacagggttttgccatgttggccaggctggtctcgaactcctgaactcaagtgatccgcccgcctcggcctcccaaagtgctgggattacaggcatgaggcaccactcccagccttaaatagcgatgttgacgatgcagttcagtataggtgcaggatcgaggtctgagctggacatataaatttggaaactgtcagcatatcaatgatatttaaaggcatgggagtggatagtgagtatagatagagaatgctgttaaaatctggagagatgaggaggacctgccagtgaggtaagaaagagtggtctcctggaagctaactgaagaaagcctattaaggaaaagggagtaatcagttgtatcagatgctgtttgatgggtcaagaaaatgaagataaagaattgacttagcaacatgaagttacttgtgatcttgaggatagcaatttcgatggaatggtgggaatgaaagcctgattgcaatgggcttaggagagaaattggccacgatgaatacactagaggtaatactttagagttttgctgcgaaaggcggcaaggaaaaaggatagtacctgttagggaaagcagagttcagattcttttagtttcgaagaaataatagagtttgtggtatgccaattggagtgatgccatagagtacaaagctgatggtgcagaggtgagaagggaggattgctggaggaatgttcctgaaactgggaggatttggcgagtccaggatttggtgaggagggatgggaatgtgatgcatatatgaaagggttgccttaggagcagggccatccacctctgatcttgtggtgaggtggatgtaggcagggttgcatgaatatctgttcttatagaaggttaagtgcttatgcttctcactgtggaaagttggagggcatcattctagctttatattaatagatgggaaaaatatatatactgtggtctttggagttgtcctgaataaacaaacctttaaacacattttctgaaccggcataaattccaaggaggtaggtctgtagcagatccactacggtagtgtagagaggaggaagggcacaggttatttttaaaaattagtgtttgactttggaatacttaaagaaaaatttggtttccatactatatttgattacactaaattaaaataagctttctttgtgcacacttctgtaggtggcaggaaaaatgctacctctttttttccctttttatttttatagaagccaatggtatggatatatcacagtttaagtattgccccactgatgaacattcaatttcattccttcaaaaactgtagagtcctaccatgtagcagacattgtactaggccctctggttatatagttatgaacaaaacagatgaattcttatggtgctcacagtcttatgtaggggttatgataataaaaacaaaagaaaacagtgtatcaggttgtttcatgatttttaaaaataatgatgctctgtgaacttccttgagtaaatctcactgtatcacgggtagctcaaactcactttcccaaaattgaacttagcatccatgaaaccaatcctgctgggtccagtggcatgtgcttgttgtcctaggcacttaagaggctaaggcaggaggagcacttgaactcaaagttcaaagccagcttgggcaaccctgtctcaaaaacaaataaacaaaaaacaactcttcaggtactcagatctctgtgttatttcttttctttttctttttctttcttttcttttctttttttttttttttttttgagacaggatctcaatatgtcgcccaggctggagtgctggagtgcagtggcatgatcacggctcactgcagccttgatctgggcccaagccatcctcccacctcagcctcccttgtagctgggaccacaggcaaatgtcatctggttcgctaaggtggatgtctgcctagcttagccctcaagcttctagaatagcccctttcaactaggttccatgagaattaatttcttttttttttttttgagaccggagtctcgctctgtcacccaggctggagtgcagtggcacaatcttggctcactgcaagctccgcctcccgggttcacgccattctcctgcctcagcctccccaggagctgggactacaggcgcctgccaccacgcccggctaattttttgtattttttagtagagacgggatttcaccgtgttagctaggatggtcttgatctcctgaccttgtgatctgcccgcctcggcctcccaaagtgctgggattataggcataagccaccgcgcctggccaagttcttttttttttttttttttttgagacgtagtctcgctctgtcacccaggctggagtgcagtgttgtgatctcggctcaccgcaacctccaccaatcgttcaagcgattctcctccttggcctcccaagtagctggattacaggcacatgccaccatgcctgggtaatttttgtagaaacagggtttcaccatgttggtcaggctggtcttgaactcctgacctcaagtaatctgcccgcctcagcctcccaaaatgctggaattacaggcataagccaccgtgctcgcccagaattaagttctaatgccctttttttttttttttttttgagacggagtcttactctattgcccaggttggagtgcagtggcgtgatctcggctcaccgcaacctctgcctcccaggttcaggcgattctcctgactcagcctcccgagtagctgggattgcaggcatgtgccaccacacccagctaatttttgtatttttagtagagacgggatttcaccatgttggtcaggctagtctcaaactcctgaccttgtgatctgcccacctctgcctcccaaagtgctgggattacaggcataagccactgcacccggtccaggtgaaacatttcaaacatggctcagtaaatattgcctgattctcccaagcagtcttcaacactcacatatcttccactctctcccttgtttatgattctcagctccagccaaaagggccagttggtttcttagccatgctatgtacatatttgaatttttgccttccaggaagagcatccattcctctctgcttgtttgagtcccacccttaaagttagtcaagtccagcttttcccctagaggttattcccacttttaggttatgtcctcacttctgttcatgctgtctggcacataattcagcttttggcacaagtggtgctcagtgcttggtggtggtgttgacaattgaggctgggggccaagacaggaagttcttgggacatttgggctcctgggtattgtcttaagggtctcttttcccaacagaggtcccccctattggaagtaaaggggaacatagaactgaagagacctctgattaaggccccttcccagctgcctctctcaggaagcagactcaagaggaggcctgaccagatggaagatggcctggagcctgagaaggtgagctgggcatggagagctgtgcatgtgtgtggggggtgtgtgtgtgtgaaagaaaggagagagagagtataaaccattagggagggtgactatggaccttgtctttatctttccccagaaacggacaagaggcctgggtgcaacgaccaaaattaccacatcccacccaagagttccatccctcactacagtgccacagacacaaggccagaccacaggtgggctctcaggatggatagactccaaggacatggaagtccagtgctcttcaactcacttgtttcttttctttcaattttattttattttttttgagacagagtctcgctctatcgcccaggctggagtgcagtggctcaatctcactcactgcaacctcctcctcccaggttcaaacgattctcctacctcagcctcccgagtagctgggattacaggtgcccacaccatgcccagctaatttttgtatttttttcagtagagatggggtttcgccatgttggccaggctggtcttgaactcctgacctcaggtgatccacccgcctctgccttccaaagtgctgggattataggtgtgaggcaccgcacccagcctattttgaataggtaataacatttcatttggttcaaaattccaaaggcacaaaggttgttgtatagtgaagtttgcttcctatttctgtcctccagccacccaattctgctacccagggcaactgtgtgttcttccagggaaattctattggtattcaagcaagtaagactatactcccccaccttttttacataaatggtggcatactttagacatggtcctgcttttacttatcttaatccaaattgctttttggcatatggagtacagttggccctctgtatccgtgggttctgcttctgcagattcaaccaaccatcggttgaaaatattcaaggagagtgggcacagtggctcatgcctgtaatcccagcactttggggggccaaggtgtgtagattacctgaggtccggagttccagaccagcctggccaatatggttgaaaccctgtctctactaaaaatataaaattagccagacgtgatggcccgtgcctgtaatcccagctactctggaggctgaggcaggagaattgcttagaacccaggaggtggaggttgcagtgagccgagattgtgccagcctggcgacagagcgagactcggtctcaaaaaaaaaaatgagaaaatattcatggaaaataaaaaataaaaccaaaaaatacagtataacagttatggtcatgtgtcacttggcaatgcagatacattatcagaaatgcattattgtggaaacatcatagaatgtacttactgaaacctagatgatctagcctgctacacacctaggctatctgcgatagcctattgttcttgggcaacaagcctgtgtggcgtgttactatactgaagcatggtaggtaacataacacagtggtaaccatttgtgtatataaacatacctaaacatagaaaaggtacagttaaaatataatataaatgataaaaaatggcacacctgtacagggtactaaccattaaatggagcatgtttgaatggaagttgctctgggtgagttagtgagtgagtggtgagtgaatgtgaaggcctagggccttactgtacactgctgtagactttagaaacatggtacagttaggctacatcaaatttataaaaaatagttcttttataataaattaaccttagtttactataactattttactttataaacttaacattttttttcccacttgccaaggctgatgtaacattttaatctttttttaacttttttttttcgaccagttgtcaaatgatcctttattgaaatattttcctttgtgcttaactagctgggcattccacagcaccactgttgatgtcatctatgatgtcatgagggtggtggccatcaacattacagcccatagactgggcagtccccggaatctctttaatggttccagagagttctctggctaaggatcggtgccgcatctgtcgagcaatgttgacgatctcatcaaaagtgatattcccattgtgtttaatgtttttctgtttctttctgtctcttggtggtttcttgagggctttgatgatcggggcagaggcagaaggcaccacctcaatctgggcctgtctgttctcaatggtcagtttcactgtaatcctcaggcccttccagtcacccgttgccttggcaatgtcatcaccaaccttttttggagacagacccagggggccgatcttgggggccagggcagaagtggcaccgacttcacctctggtgcacctcaggtatacgaccttgatctcgttggggtcgaacttcggtggcatggtggaggcagctggtgtcggatgaacccagattcaggatgaccgaagaaagttgcaccttggcctcctccgagccgaaagccgagagcttctctctcttttttttttgagatggagtctcgctctgtcgcccaggctggagtgcagtggcacaatctcggctcactgcaagctccgcctcccgggttcccgccattttcctgcctcagccttccgcgtagctgggactacaggcgccctccaccacacttggctaattttgtttttttgtatttttaatagagacagggtttcaccatgttagccaggatggtctcgatctcctgacctcgtgatctgcctgcctcagcttcccaaagtgttgggattacaggcgtgagccactgcgcccggctaactttttgactcttgtaataacaactgaaaacacaaacattgtatagctttacagaaatattttattcctttatatccttattcctcatgctttttttctatctaaattttgttttgggcggggagcatatattcagggcaatatgaatctctgtctcctggcttgaaaataaaatttttgttttttgttttttgtttttgagacagagtctcgctctttcgcccaggctggagtgcaatggcgtgatctcggctcagtgtaacctccgcctcctgggttcaagtgattctcctgcctcagcctcccgagtagctgggactataggtgtgtgccatcatacccagctaattttttgtatttttagtagagatggggtttcaccgtattagtcaggatggtctcgatctcctgacctcgtgatccgcccgcctcagcctcccaaagtgctgggattacagacatgagttactgcgccccgcctgaaattctttttttaatttaaaattttatttatttgtattttttccaagaaataagcttaaatttgaaaaattttaaatattattttgcttttcaaactttttgttaaaaacgaagaaatatacacattagcctaggcctacatagggtcaggatcatcaacatcactggctttcacctccacatcttgtctcactggaagatcttcaggggcagtaacacacatggagatgtgacttcctgtgataacaatgctttcttctggattgcctttttttttttttttgagacggagtctcgcactgtcgcccaggctagagtgcagtggcatgatctcggctcactgcaagctccgtctcctgggttcacaccattctcctgcctcagcctccggagtagctgggactacaggtgcccgccaccacgcctggttaattttgtttttgtatttttaggagagacggggtttcaccgtgttagccaggatggtctcaatctcctgaccccttgatctgcccacctcggcctcccaaagtgctgggattacaggcgtgagccacagtgcctggcctggaatgccttttgaatgacatgcctgaggctgttttatagttaactgtttttgcaaatagaaggagtataccctaaaataacaataaaaagtacagtacggtaaatatataaactagtaacatagtcattatcattattaggtattatgtactatatgtaattatatgtgttatacttttatacaactggcagtgcattaggttcgtttatatcagaatcaccacaaacaggtgaggaatgctatgacattaccatggctataatgtcactaggcaataggaatttttagctccattataatgttacggggctactgttgtatatgcagtctgtcattgaccgaaatgtcattatgggcacatgactgtattaacatagcatttacattgtgttagatattataagtaatctaaagatgatttaaagtatatgcggctggatgtggtggctcacgcctgtaatcccagcactttgggaggctgaggcaggcagatcacctgaggtcaggagtttgagaccagcctggccaacatgctgaaaacctgtctctactaaaaatacaaaaaaaaaaaaattagccaggcgtggtggcgcttgcctgtaatcccagctactcaggaggctgaggcagaagaattgcttgaaccctggaggtggaggttgtagtgagctgagatcgcgccattgcattccagcctgggtgagaagagtgcaactccatctcaaaaaaaaaacaaaatggaggccaaggcaggcagatcaccagaggtcaggagtttgaggccagcctaatcaacatggtgaaaccccgtctttactaaaaatacaaaattagttgggcgtggtggcgcatacctataatcccagctactcgggaggctgaggcgggagaatcgcttgaaccctggaggtagagtttgctgtgagctgagatcatgccattgcacttcagcctggacaacaagtgaaactctgtctcagtcaatcaataaataaagtatatgggagcgtgtgcatagactatatttaatactatatacctatttatgtaagggacttgggcatccttggattttggtattcttggggggtgctggaatcaaccccttttggatactgagggatgactgtaatttctggttctaggggaggtatcattaggagctggccagacttagggataagggaaggaagttatcctatttctaattctgagaaaagcacttcttctgcccctgtcctagcaagtgtacatgccatcttaagaatgatcattctacctttgctctctcccatctcctgggcagctcaaaaagtttccaagaagacaggaccccggtgttccacagctattgccacaggtaactgtgctcaagagctgggtctgagaagggatttggggtatgtgtaaagggagaatgatggaggtggagggacactggtcctgtaattcctaagtcacctcctcaattctgtagggttgaagaaccagaagccagttcctgctgttcctgtccagaagtctggcagtaagtgacaaacataaccactgggtgagaggctgggatagggaagagaagatggtgagtgaccagaaaaatccatttggtctctaaggggaaggagatgtagcatcaggtgtggatcccataaaggctagaagggaggagggatagagagcctagacttcactgacctttgtcctttctgtgttcatcttagcatcaggtgttcctcccatggcaggagggaagaaacccagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggaggtaagggccagattttcaccagatgtcagccccgctttcctggcagaggtcatgcctcccctcccttccaggtacccctcaagtctgggctgagaactcctgagcacctatctttagcagtataggtgctgctgaagatacctctctcttgacctgtctgcaccccagcccactcctgactgtcttgctttctgccacgcttcttcctacccttgactgtttgcaaagctctcatttagatctgtgtctttcttagtcctccatccctctttctttgggttcccatcctgatcacaaattcctgtggtactctctttccctcctcccatgtccacttgactccttcctggtgagcaccaactagattaagttatttgcagtctcttaaatgactcaactttcacttctgggcattctgcatatgtgcttccctctttctggaatgttctttgtatactacatccttccttggttcactcctgtacttctgggtgtcaccctagatatcatcttccttgtgctcctctttgtgcttggacatacccatagcactccctgtcttagtaccatgattccttattttctcatctttctttgtttaccagactttgaggtccttttgagcagggacctcacttccacccactccatacgccccacagtttgttcttcttcttggttgcatcttaccctctgtgtatgttgtgttctcttctgggcagaggaggctgcagacatcagaagcagccctgtcaagcagccaagcagaggtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtgaggacccatgggcactggaactgggaaatggggaggagtgggcagggtgccacgagatggaggtagagggagaaaggagcaagagagaattgaaggatgaagtgcaagttatcaggctgggttaccacatccggttttggcctgtgggctgtcggtagatctgccttaacctgggagtggcgagggagtgatgcatctgccaaaacgaggagggtcactacatctcatgtctcatcttcttgctcagctcatcctagccatgctggcctcctggctgttcctcaaccagctagtcgtgctccccatctcagggcctttgcctggatgctctttcctggagatcttggctatcctgtcaaaacttgtgttccccaccccgcctttatacactccctattctatgtattccttaccattttcagacatactgtgcatcttattttgtttcttgacaggctagaaagcttcaagagggtgggggtgggctcttattcatttccatacatattactatgtactgacttctgcctgcctttttgccccttctgctcccatccccaggtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggtgggaatgggagtggggtgagatacgggacctgggggacagttggggttggctgtgcagaaccctgcctattcctaaacatctgtccccacctcaatcatctaggagtcccacgtgccttaccggaacagcaaactgacctacctgctgcagaactctctgggtggtagtgctaagatgtgagtgaaagggacagatggaaggggtcaggtaggaactgtgttggggtgaggggtagaaaggggaacagtggagacctgtccaggctctgctggcccctaatgctggggttgggcacattgtcttttcataggctcatgtttgtgaacatttctccactggaagagaacgtctccgagtccctcaactctctacgctttgcctccaaggtgcgattaccacccgtcagccttgtcaggacccgtgggtggttgtaggcttctccattccaatcccttttgtcttctagggcagggagcacatttgtgcagaaaggttttgcaggtatctgaggcactgctcacctggttccatttttaattattagcttttgagttaagttttttaaaaaacgggtgattaatttaacctgagaaagctgattaaaaaaaaaagaaaaggtgactaaaaggtctaaactggttgggcgtagtagctcatgcctataatccgaacacttcgggaggccaaggcaggaggattgcttgagcccaggagtttaaaatcagtctgggcaacatagtgagaccctgtctctacaaaaaataggaaaattagctgggtgtaatggctcacacctgtagttccagctactcaggaggctgaggtgggaggatcacctgaacctgggaggtggaggctgcagtgagccgtgatcctaccactgcacttcagcctgggtgacagagtaagaccttgtctcaaaaaaccaacacacaaaaaatccctaagattcctccctatcagcatacagagatcattatttttaggtctgcctagactccactatgtagctgcaccaaaatttatccaccagttccctctactggacacttggattgtttccacacttttttagtcacaaacaaggccacgttgactaactttgtacatacatcattttgtatttttcagttacatctaactagggaaatagtccttgaaatgggattactggatcaaagacttagaggtttttcagactattccaaatagtgtgaattcagactccaaacctcatgagggtcagccagtggctatatgaattctcactaatgagaattccttccactagaatctccttccactagtgttaagcaagtcagaaagtttccttactgtctgcctccacagtaatttttttctctggtacaccctcctcctgcgcgtatagccctttgatgggctctggctttatttgaggtctgatcaggtctgtcctgctgtgcgcttgggcctcctcccagtcagcactgattgttgctgtggagtagccagcacctgcaccctgatctggtattctactttgatgagggtttccctcactatcttgcaagttcaattttagagggtggtgatgttttttctaactttttattaatgttataccaatgtaacatccaacaacatgaactttaatatcctctaatacccagtttatgttaaatttcacccaactgtctcagaagtgtcttttatacataataggtttgttcaaatcaggatccaggcaagggccacccacttggttgaaatgtctcaagttccacaaccctatcccacactgccactattatgtcgtttgttgaaggtcatttgtcctatagaatatactattctggattttggctggttgcttcctctttcccccatactttcacttatttatcatatttgggtgttgtcaacctgacccatccatttacaagctccttattgactttttcacctagtgattttatccagcagtgaccatacctggatctttatttcattaaggggtttctaaatggggatttttctaatcttagttgttctgcattggttagtcacgattcttttatgaagacatttgccttgccatctacttggtttctctgaaattcaattcatacaggaaaaacaagataaatgctgaattatttattgattttcagtattgagttgatatcctagcagcttccaaaggtgaccaatgaatgtttatctgagggttatttttatttttattttttttgagacagggacttgctctgttgcccagactggaattcagtggctcaatcatagctcattgtagccaccaaaagtgttgggattataggcgtgagccacccagcccggccacagtcgttcttctttctgatgctcaaattgccccatctttagccaataggaacctcctggccgggcgcggtggctcatgcctgtaaccccagcactttgggaggctgaggtgggtggatcacgaggtcaggagatcgagaccatcctaacacggtgaaaccccgtctctactaaaaatacaaaaaattcaccgggcgtggtggcgggcgcctgtagtctcagctactttgggagtctgaggcagaatggcttgaacccgggaggtggagcttgcagtgagccgagatcgcgccactgcactccagcctgggcgacagagcaagactccgtctcaacaacaacaacaaaaaaaagagcctccttcagattggtgccagtgtcctttagacagaactctagtagtcttttcagattcaacttgtacatttccttccccagacttcaactgatccattttctaaggagtcctagttcctaaatgggtgttattactattttatctcggtttaagtgttttacagtgggagaggttggaggtctctagtacagggtattgctggaaatgaaagcctcctttctctgctcctgtattttcttctggggcttccatctcttctcaagccttttcacctcctccaaacctagtgtgcagaggagaacaaaccataactggcaccagcctgaaccagcctttggaggccttatttcggtatttctgagggcagccctagcattggaggatgggagatcttgggaaaaatgttgtattggttacgctgcaaacttttatcctgtctaaccccctgcccccaggtgaaccagtgtgttattggtactgctcaggccaacaggaagtgaagacggatccagatctgtgtgtgtgtgtgtgtgtgtgtgtgtgtgtgtgtgtgtgtgtgtgtgtccctatgtctatgtatcgggtgaggggtgggagggttgctggagggtgctttattgggtggagggcaccatgtcccagggctatcaaataaagaatagtttggttttttttttaaataaaggttttattagcatttgcccaagaaggcagatactttcatatctgtaa

SEQ ID NO: 779 - DNA, 92 bp, Homo sapiens
cggcgggggcgcgggcggcagtggcgggagcggcccctcggccatcctccgtctgcccagttaccgcttccgctaccgccgccgctcccgct

SEQ ID NO: 780 - DNA, 27181 bp, Homo sapiens
gggccccccgcttctgcctgcgctgtgaacccccccccagccgccggcacggccccgcccccgctgccccggtggtggcccacggccccccggctgcccgtggtcaaactggagtcgctgaagcgctggaacgaagagcggggcctctggtgcgagaagggggtgcaggtgctgctgacgacggtgggcgccttcgccgccttcggcctcatgaccatcgccatcagcactgactactggctctacacgcgcgccctcatctgcaacaccaccaacctcacggccggcggcgacgacgggaccccccaccgcgggggcggcggcgcctcggagaagaaggaccccggcggcctcacgcactcgggcctctggaggatctgctgcctggaaggtagggtgcgggcggccctccccgcagcccccgccgctcccctccgagagaccctgagcctcccggggctgcctgtccctgatcctggggcccccttgggcacccctcctcctctgccagaggggcttctgcgccttcccactcgcgcccctgacctcctctcccctccttcccactcctccctgcgtcctggcaccctgcggaattcctcggcatgctccctctgcagcccctctgcctctccgctgaacccccttatcctatctttccctagtccgtgtctcctgcgctgccccatcacacccctgcatcttccctctctccagtacctggggctcctcctgtttcatttcttccactctgccctgtgccttttctctttttttttttttttttgacaaggtctcactctgtcgcccaggctggagtacggtggcacaatcacagctcactgcagcctcgaatccctaggctcaagccatcctcccacctctgcctcctgagtagctgggaccacaggcatgagccactgtgcccagctaattttttttattatttgtagagatgaggtctcctgttgcccaggctggtctcgagctcctgagctcaagagatcctcctgccttggcctccaaagtgctgggatgaagggcatgagccactgcacccagcagcctctttctccctctttcccgtcagttcatcttgaccctgctcctccgctccacctgccccttcatttcctctccctcgtgccccgtgacatcttctctctcccgacatttcccccccagtcctctgaagtcccctgcctctcccgccccctttcacggcccagtcttccggtctgtctctttccccttctctttggctgctgctcccctgaaacttcgtgccttaactcgccctcactcatgactttctctcttttctgccttgtgcttctcctcctgttcatctttctcttcccatcagtgcccccacccatgtctctcccaccagggtgccctccaacctcccatcctggtcctttcctcctttttcctttagtggactccacttcctcttcctccactcatgcctccttcgacgtcttcctgactcgatgcctcaggccttcacgttaaggcttctcgctcctgcccctgctacctcctcggatcttcgacttggttcttttcctctgtcctgttctccctctcacagcttctctcctagctcggctccctggctctcgacttccccacttctccaagactcctgccctctgctgtgccaaccccttctctctcccactcttagcatcagtatttctttcctgagtatcaagtagctgcggggctgggaagcaggagtcttgggtgccagttctgctgcatatctgccctgctgtgtgaccactgtcttccctcctgcaccccagcctcacagcccttgtctgcaacgtgaaggagtggaaccagccatcctgatgcccccttcggccaaaagattgaaatctcttgcttctctttttcatccccctctatttcctctgccccttcttcctctgttttgctgagtgttcacgacaagccgggaacgttatctcgtttaatcctatgaggtgggcaccacctcgctgttggggatgggtaaactgaggctcagagaagtgaagtcacttgcccaaggtcacctagctgagaaaggggccgagccaagagcagaactcgaatctcatggatgggattcacagatgcgctctgtctagtgtacaaagtgtttaaaactgaaagcaaaatctgaatccattgccaacagttaaaaatagggaggcttcccattgtagttctgatttccggcttcttctgagctggcggaagatctagcacaagcctgtgttctaccctgaccacgatgggccggatctgagcagcagctggggggtctccacttccccacagtcacctccatctgctccgtctcgcctcccattcctcccacggctctcgtgatgttctttgcctctcctgtggaagtttgagttcatgtccattcactggtctgaccaagtaccaggcatagagccaagtgtgagggctcccatcatgggagccctaggacagcacgtggcatctagtagggatgtcattcattcattcattcgttcattcaacgtcccatttttattgagtttatattatgtgccaggcattgttctggattctggggctgcagcagtggaaaacaaacagacaaaacctcctgtcgttatatatcttatattctaagggagagacagataatgatggaggtaaagtcaacctttagggtgttagatagaactgagtgctaaggaggacaaggagttgggggaggggatgggaggggtcagggatccccgtgggaagtagataaggaatctaggaaaagcttccccgagcaggtgacatttgatcacaggtctgaaggaagtaagagatggaggaaagtgcttcagactgtaggaatagcaggcgcagaggccctgaggtgggagtgtggctgtgtgttgatcaagccagtgtgaggtcagcgtggccggggcagagtgggtggcggagaacgtaggagtaagaggtgcagtcgtaggggtatcagggtccccatcccacaggttctgttttttaaaaattatttatttatttatttatttattgaaacagagtcttgctttgtcacccaagctgtagtgcagtggcgtgatcttggcttactgcaacttcggcctcctgggttcaagcgattctcatacctcagcctcccgagtagctggaatcacaggtgtgtgccaccatgcccggctaatttttgtatttttagtagagacagggttttaccatgttggccaggctggtctcgaacttctgacctcaagtgattggcccgcctaggcctcccaaagtgctgggattacagatgtgagccaccatgcctggccagcttctgtgtttgtttttgttttgtttttctttttttgtttttaggcagggttttgctctgtcacccaggctggcgtgcagtggtaagaccatagctcactgcagccttgaacccctgaacccaagccgtcctcttgcctcagcctcccaaatagctagaactacaggcacatgcccccattttttgtagacacagggtctcactatattgcccaggctggtctcaaactcctgggctcaagcaatcctccggcctcagcctcccgatgtgttgggattacagatgtcagccactgcacccggcctcacggcttcttatacatcccagaaagcactttgctttagattcggagatgggagccgttgaaggttcttgagcagaggagtcacacgagctgacttacatttttgcggtatgtttcttgctgctgtgttaacaaatgaccgaggggaaggcaaatgagacaacgagaggctcatctagggtgggggcagcagggtttgggaagttgtttgaattttgagtatattctggagctaccgtgggcaggagttgctgatggagcagttgtaggatatgagagagaagagccaggggcgtctccaaagcagggtttttccaccgcagcatggttgatattttggggtggataattctgtgtggaggggccgtcctatgcattgtaggatgctgagcaacagccttgatctctcctactaggatgccagcagcgcccttcccagtcgtgacaaccaaaattgtaaattgtgtctaaacattgtcagctgtctcctgggggataaaatcgccctgagttgagaatcaccgctctaaggctttggcctgagctcctgagaataggggagccattcataagatgaaacagcagctgttttatttattttctcttatcaaatttattatgaaggagagggaccatgggctcagttttgggcatgttaaatttacgatgcccattaacagataacatctggacagaggtcagcacagtgaaggtcctataaagtgccatatagtaaagatttcaggctttgtggagcagtctctatcacgactactcgtgaaaacgaccaagacagtctgtaagtgagtgtggctgtgttccaatgagacttcatttatggacactaaaatctgaatttcactgggcgcagtggctcacacctgtaatcccagcactttgggaggccaaagcaggcggatcacctgaggtcaggagttcaagaccagcctggccaacatggtgaaaactggtctccactaaaaatacgaaaattagccaggcgtggtggcacgcgcctgtagtcccagctacttggtaggctgaggcaggagaatcgcttgaacccaggaggtggaggttgcagtgagccgagatcgcatcactgcactctagcctgggcaacagagagagactctaagaaaaaaaaacttttttttttgaattccatgtcattttcacatgccacaaaatcatcttcttctttgacattttctcaatcattaaaaacacataaaacccattcttagctggatttggcctgtgagccatagctggctgaccagtgatttaggctgctagagatatgatgtaggaggccagaggctgggctggagatatcagtttgaggggcatcatcatatagatgaatcagatggatggaatcacttagagaagagacagttgggtgcagtggctcacacctataatcccagcactttgggaggccaaggcaggaagatcacttgagcccaggagttcgagaccagccaggggaaaacagtgagaccttgtctctacaaataatttaaaaattagctggaagtgctggtgcgtgcctgtggtcccagctactcaggaggcttaggtgggaggattgcttaaacccaggaagtcgaggctaaagtgagacatgatcataccactacactccagtctgggcgacagggcaagaccccatctcaaaaaaaacaaaaaaaaaaagagagagaagagaccagaacaaatgataaaatgtccttatgtcattgaaggcttaagctttcggccagtctactattaaaatgtgagggagatggccgggcgcggtggctcacgcctgtaattccagcactttgggaggctgagacaggcggatcacgaggtcaggagttcgagaccagcctgaccaacatggtgaaaccctgtctctactaaaaatacaaaaattagccgggcgtggtggcgtgtacctataatcccagctactcgggaggctgaggcaggagaatccctttaaccctggaggtggaggtttgcagtgagctgagatcgtgccactgcactccagcttgggcaacagagtgagactctatctcaaaaaaaaaaaaaaaaaaaaaaagggagggaggtgagaagtcaccaaaggagtggagaaaggagtggccacaggtttggggaaaaacaggtccttggatgtcttggaagccaaaggaagttagcgtttcaaggagaggaggaatgaaggctgactctgttgttgttgtaattgtcattcatttgtcactgaatgcgcacaataaccctgcaaagtaggtactttatttatttatttttattaattttgttttcgagacagattcttgctctgtcacccaggctggagtgcagaggcgcgatctcaacccactgcaacctccacatcccgggttcaagcaattctcccgcctcagcctcctgagtagctgggattacaggtacccaccaccacacccggctaatttttgtacttttagtagagacggggtttcaccatgttgaccaggctgatctcaaactccggcctcaggtgatctgcccgccttggcctcccaaagttctgggattataggtgtaagccaccgcgcccagccggtacttttattattcccattctaaaagaagaagtgaagctcagagaggtgaagtgagttgcccaagatcacacagttaatatgcagtagggtctggatttgtttttgtttctgatttgtttacttttttttttttttttagagatgggtctcaccacattgcccagcctggtctagaactcctgggctcaagcaatcctctcacccccggcctctcaacgcattgggattacaggagtgagccaccctgcccggcccagcatctggatttgaatccaggtgtgtctggttttctaggagaatgaagcaacaaatccacttgctttcagcccatcggggctccaggggtgtagaaacggggtccccctgagtcattgcgtcctgcagccactgtgctcctgggaacccttgggctcaatctccatttccctttggagtgtgtctgagagatgcagtagaatgtaatgactgaaacaagctcggaggctgctctgcctaaggagcggccgttctttattcctttactgtctttaataaacttgctttcagctgggcgcggtggctcacacctgtaatcccagcactttgggaagccgaggcgggtggatcacctgaggccaggagttcgagaccagcctggtcaacatggcgaaaccctgtctctactaaatatacaaaaatattagccagggctggtggcaagcgcctgtaaccccaggtaatcaggaggctggcagggcgcggtggctcatgcctgtaatcccagcactttgggaggccgaggcgggcggatcacgaggtcaggagatcgagaccatcctggctaacacggtgaaaccccatctctactaaaaatacaaaaaattagccaggcgcagtggcgggcgcctgtggtcccagctacttgggaggctgaggcaggagaatcgcttgaacccaggaggcagaggttgcagtgagccgagatggcgccaccgcactacagcctggggaacagagtgagatcccagagtgagaaagaaaaaagaaatataacacaaggatgggccagtggctcacgccttgtaatcccagcactttgggaggctgaggtggacggatcacttgaggtcaggagttcgagtccagcctggcctatatggtgaaaccccgtctctactaaaaatacaaaaattagtcgggcgtagttgtgggtgcttgtagtcccagctactggggaggctgaggcaggagaatcgcttgaacccaggaggcggaggttgctgtgagctgagatggcgccaccgcactacagcctgggcaacagagtgagattccagagtgagaaagaaaaaggaaatataacacaaggatgggccactggctcacccctgtaatcccagcattttgggaggccgaggtgagaggattgcttgagtccaggagttcaagaccagcctgggcaacatagggagaccccgcctgtgtaaaaaattaaaaattagttgggcatggtgatacatgcctgtagtccccactactagggaggctgaggtagaaggattgcttgagcccagaaggtcgaggctgcagtgagctgtgattgtgccactgcactccagcctgggtgatagagcaagaccctatctcaaaaaaaaaaaaaaagaaaagaaaagaaaagaaaaaaagaaatataacatgggtgaccatatatagttaaaatttttaggctgggcacggtggctcacgcctgtaatcccagcactttgggaggccgaggtgggtggatcacgtgaggtcgggagttggagaccagcctggccaacatggtgaaaccccgtctctactaaaaaaacaaaatttagccaggtgcagtggtgggcaactgtaattccagctactcgggaggctgaggcaggagaattgcttgaactcgggaggtggagtttgcagtgagccaagattgtgccactgctctccagcctgggcaacagattgaggccctgtctcaaaaaaaaaaaaagaaaattaaaatttttctagtagctacattaaaataaataaaaaggaacaggtacccagcatagccaagatattatcacttgaacatgtaatcaatataaaaattattaatgaaatattatacatagacactctctctccctttttccccatcctgagtctgaaacccagtaaatattttaccctcacagaacctctccattgccacatttcaagtgttgggagctggaggcatctgcatgggacagcccagcttgtgccccctcctcagggatttcagccacaccccgaggtcttctctcaggactcaagagtctgggcccacagccctatttattagtgccgaccatacagagcccctttgctagcactttgccctgcttattatctcattaagccctcgccactttgccaggggaatgtattattagcaggaatctgatggccagaaaggggaagtggctcagcctggactacccagcatgtgaggggcagagtgggttggatcccagttctccacgtgtccgcactgcaagaaagctgccccttaacccttgcatgcccgggtctgcgctaggcagcccctgggaggagactcagggccatgacatcaccatccatgcacaagaaaaactcatagcttgatcggtggcattaagcataactactgtgaattctgtgcctaacttccttttttttcagacggagtctctctctgtcccccaggctggagtgcgctggagtgcactggcgtgatatcggctcactgcaaactccgctgcctgggttcaagcaattctcctgcctcagcctcctgagtagctgggattacaggcacccatcaccacgctgggctactttttgtatttttcagtagagacagggtttcaccatgttggccaggatggtcttgaactcctgacctcaggtgatctgcccacctcgccctcacaaagtgctgggattacagctgtgagccactgcgcctggtcttctgtgcctttctttcttgcttgctttctttcttttttttttctttcttctcttttcttcttttctttttttttttttttttgagacagagtttcactcttgtcgcccaggctggagtgcaatggtgtgatctctgctcactgaaacctccacctcccaggttcaagcaattctcctgtctcagcctcccgagtagttgggattataggcacctgccaccatgcctggctaatttttgtatttttagaagagacagggtttcaccacattggccaggctggtctcgaactcctgacctcaggtgatccacccgctttggcctcccaaagtgctgggattacaggcgtgagccaccgcgcctgggcttctgtgcctaactttcactgaaatttcactgaagccctctaaagtcacactaccatcctcaatttcccaatgagagagcagaggctcagggacgatccggttccaaaaccacgcagctgggaagtggtacgttgggatgtgtgtccagagagttggattccagagcccacgatcaataacccccacagccaccagactctactgtcttaaatatgctgaactcccaaaccgagctgtgctggaaggaacctctccccatcactcacccccaatagggctttgggcaacttcttcaactccctatgcctccatttcctcatttgtaaagcaaggatgctgtcactgcctacctccgagggtttgtcctagggactgagcaagttattaaccacctgtcaaatgcttggagcagtacctggtgcacggttagtgctcagtcagaactagttattattactgtcaccactaacctgttcagcaatccggtgtgccatgtggtttacatgctcagtctcatttaatcatcacgaatattttgagagaattactatgatcccattcaagaaaggagggaccaggctgggcgcggtggctcatgcctgtaatcccagcactttgggaggctgacgtgggtggatcacctgaggccaggagttcgagaccagcctggctaacatggtgaaaccccatctctacttaacatacaaaaaattagccaggggtggtggcaggtgcccgtaatcccaggtacttgggaggctgaggcaggagaatcatttgaacctgggagggggagtttgcagtgagccgagattgtgccaatgcactccagcctgggaaacagagtgagactctatctcttaaaaaaaataaataaataaaaactggacaagatggcttacccctgtactcccagcactttggaaggccgaggcaggaggatcgcctgaggtcgggagatcgagaccatcctggctaacacagtgaaaccccgtctctactaaaaatacaaaaattagctgggcatggtggcacacgcctgtaatcccagctactcaggagctgaggcaagagaatggcttgaacccaggaggtggaagttgcagtgagccgaaatcgagccattgcactccagcctggtcgacagagtgagactccatcccaaaaaaaaagaaagaaaggagggacattgagcttgtcatcttacctaccacaccatggtggaggtgctgatgggttaagagtttgtatgtgggagttgtatattcattcactcattcactcattcattcgttcattcattttgataattgtagtaaattatacataacataaatttaccatcttcatcatttttaagtatgcatttcagtagtggtaagtgcaaccaatttccagaactcttttcgtcttgcaaaatggaaactcagtacccgttaaataactccacatccccccaccctccagccctggcaactaccatgacactttgtctctatgaatttgattattccaggaatttcatataagtggaatgacacagtatttgtctttttgttactggcttatttcactgagtataatgtcttcaaggtttatctatgtttatagcatgtatcagaatttgcttccctttgaaggctgaataatattccattgtatgtacatagcacatgttgtttatcctttcatctgtcaacgggcactggggtgtttccgctttttggctattgtgaaaaatgctactatgaacacgagtgtatgaatatctatttgagtgcctgcttttaattcttttgggtctatcaccagtactggcattgctggatcatatgatgattctatttgtagtttttgaggaacctcgacactgtttcccatagccactgcaccattttatatttctaccaacagtgcacaaggttccaatttctccacatccttcataacacgtgttattttatttatttatttatttatttaatttatttatttttgagacagagtctcgctctgtcacccaggctggagtgcagtggcatgatcttggctcactgcaacctccacctcctgggttcaagcgattctcctgcctcagcctcccaagtagctgggactataggcacacaccaccatgcccagctaatttttgtatttttagtagagacagggtttcaccatgttggccaggatggtctcgatctcttgaccacgtgatccgcccacctcggcctctcaaagtgctgggattactgacgtgagctaccgcacccagcctattttattttatttttttatttatttagagatggaatcttgctctgtcaccaggctggagtgcagtggcgctatcttggctcactgcaacctccacctcccggcttcaagtgattctcctgcctcagcctccctagtagctgggactacaggtgcacaccaccatgcccagctaatttttgtgtttttagtagagacggggtttcactatgttggccaggatggtctcgattctcttgaccttgtgatccacccacctcagcctcccaaaatgctgggatcacaggcgtgagctcctgcgcctggcctattttgcttatttttaatagtaaccatactaacgaatatgaggtggtatctcactgtggttttgattgcatttccccaatgattagtgaaattgagcatcttttcatgtgcttgtggacccattcaatcattctttttttttcttttttgagactgagtctcgctctctcgcccaggctggagtgcagtggcgcgatctcagcgcgctgcaacctcctcttcccagattcaagcaattcacctgcctcaggctcccaagtagctgggactacaagcgtatgcccccacacccggctaacttttgtatttttagtagtgatggggttttaccatgttggccaggctggtctcaaactcctgacctcaggtgatccacccacttggtctcccaaatggctacgattacagacgtgagccaccacacctggcccattcaaccattctctcattaaaaatacttattaagcactcaatatgcactaggcactgttctagatgctggtaatacagtgtcgaacagcccagatgctcacattcatgatgtgtgtttgagttttgttgccaccatcagctgcgaaatgatgacccttttctgtttctcagtttccacgtttgggtaatgggtgctatacatcagctgctatcaaccgagtacttaattgtgttcaaggccaagtgctaaatctccacctagacccaatccctcatatcagtcccatgaggtaggtcctgttctctgcattttataggtggggaaactgaagcaagctggcctatgtaacaccagcaaggacacagaataaggaagtggtggaggccagcgcagtggctcatgcctgtagtcccagcacttttggaggctgaggcgggcggatcacttgaagtcaggagttcaagaccagcctgggcaaagtgggcaacatggggaaaccctgtctatacagaaaatgcaatatttagctgggcatggtggcgcaagcctgtagtcccagctactcaggaggctgaggcaggaggaccacttgagcccaggaggtggaggttgcagtgagccgagattgtgccactgcactccaaacttgggcaacagagggagaccctgtctcaaagaataaaaaaaatggagacgttccaatacctaacatttggctgccacagcacacaaaccacatgatctatttcataggactcttgggagcatcaaatgagttggcccacctagcaagcaccaaacgcacattagctcttgccagtattactcactcccttatattaattcttcccagttcctcctttatccctattctttcccctactttcctttgctggtcatggtctgcctgtgatctcaccttctgctatgcttatattcattcattaattcattcattcattcttcattcaaccctcatttctttctctctctcttttttttttcttttgagacggagtctcgctttgtcacccaggctggagtgtaatggtgcagccttggctcactgcaacctccacctcctgggttcaagtggttctcctgcctcagcctcccgagtagctgggattacaggcacccgccaccatgcccagctaatttttgtatttttagtagagatagggtttcaccatgttggtcaggctggtcttgaactcccgacctcaagtgatccacccgccttggcctcccaaagtgcagggattacaggtgtgagccaccgtgcccggcctcagcccttatttcttgaggtctcccgtgtgccaggcctactgccaagaaatgctgggacacacagaggaatcggactcccatgccctaccccctccaggaactctcagcttaccgaggacgaagaagatcatctaccaactaatgcatgtcctacggggcacctcagagcaggaaactgacccaagttcggtgggaggaatgagtgtgcatgtgtgtctgtgtgtgtctagggaaagcctcctcaagaaggtgcctcctgagctgcctgctgcaggtaaagtactacatcagcaaagaatgtgagctggaatgttccacagcatgggcagaggtctgcagaactggacagagctgggcagttgaggaaactacattgtttatacttatatttttaatttttttctccagctatgtgctagaggtggtaaaacattaactgttcccaaggatgagaaaatagctgaggatgagcatcttaggaggggaaggagatgaggatgcatgacccctagaggcatactccacccctcacacacctctgcttgcttcaactactccatttctctccagaaggttccaggttccctgcagaaagagactggaacctctctctccccatccccacaggactagagactacaactcccatgatccactgcggctgctcttctcacaactggactccagacttcacggggtctcatgggaaatgtagtcctcatcggcttccgcatcactttccttgttttttttcccacgcatttccagacttttcaaccaattgagaggtgggaagcgccttgctattattgaagccaacaacaccctctttcttacagaggtgggagccggaagtccagagtgctggagcaacttagcgcagcttacaggaccaaggtcctgtagccttgcagtgagtgctgcaaggatgttagactttgggtttttttccttgcttttcttcttttctttaacaggcggggaaacagaccagagaagttgaaagtttgtcccatatcacgagtcgggctcaggagccaggacttgcggtctcccaagcagcccagagagagaaggggtttggggaagggaagggtcggttgtcagtggggttgccccgcccccaaccctgaagtatccgcccccaccactgccctccccgctcctccagggttgaaaagaggcgtctgcgtgaagatcaatcatttcccggaggacacggactacgaccacgacagcgcggagtatctactccgtacgtgggggtccgggacagacgtggggagtgggtcaaatcgcggggcctggaaggcgtcggggtgggtgccgggaaaaggcactgggactccggcacttggatcgacacgccgaggttagcctcccagccaatccgagtccagatagtgagatcctctggtccccgattggctgactgatctcgttcccgccccctcctctcaccttggggcgggctgagggaggatcctgggcgctaattggccgctttgctctctttggccctcgcggcgactctgcgccgtgactggttgtggaatcccggactgggattggccaccgcgccgcagagctgtggggcaatctgcggcggtgacgggccactactgggagccggctgggaaagcctgtattgccattggtagctaccccgagaacgcggcaaatcctaaatgatgattggctgcggcctcagccaggttccgaaatcgcaaaatctagttgcctggggttttaggggtgggtggaaaggaaggactgcagagaaaaagaggagggcggggcggggagtgggggcggggagagagagataaggggaagaagggagggaggaaaagagggagaaagagagatagacgaagtcaggcctaaagggggtagggagggagggaaggaggaagggagaggaagggagtgaagagaagagaaacctggaagattgaagaaaccaggcagaaaaggaggggagagagagacccaggaagatagaggaggccaggcgaaaaaaggggtggggtggggtggggtggggaaagacctaggaagacagatgaggccaggcagaaaaaaaaagaggggggagagacctaggaagataggtgaagccagacagaaaaagttgtgggtgggggtggctaggaagacagatgaggccagggagaaaaagtgggagagagacttaggaagacagatgaggccaggcagaaaaagcggggtggggggggacctatgaagacatacgaggccaagcagataagaggagagaggggagacagagccagaaagatagatgaagccagcaataaaactgggtggggtgggggcgtgaggagaagaagggaagagaaactcagaagtagattcagcctggcagaaacgggaggaggaggaggaaggaaggaatgtagagagagagagaaacccagatagatgaagcgaggcagaaaatgggagggggtgtggagagaggtagtaagtgatttgcgggatatggagaaagaaattcgcagacgagaggaaggaagggacgagaaagagaaagggagaggatccatggagaagttgggagaaaaacagggagagtgatttcgataaataaagagggggaaagatattccaagagagagaaaaatagtccgaagaaaaaagaaaaggacaaagaaaaagagggagagaaaatcagaccgagaaatagagaaattttaaaaacaggagagagaatgaggcaacagtaaaataaaccagaacacagccggagagagagaatcacagaactgtcgggaggcgccgcgagatggggggccgggaagggggcgcaggcggccgcgtctgaccgccctcgctctccctccttttcctttccttcctcccccgcaggagttgtccgggcctccagcatcttccccatccttagcgccatcctgctgctgctcgggggtgtgtgcgtggcggcctcccgcgtctacaagtccaagaggaacatcattctgggcgcagggatcctgttcgtggcagcaggtgagaggcagagggagggggcgaccggggcggcccacctgggcgcgcacgtgtgtgtgtgtgtgtgtgtgtgtgtgtgcgcgcgcgcgcgtgagtgcaagtgcgcgttcgtgtgtctgcaaagccaccttgccccgagcacccccgggggcccggagccttcctaggcggtccccaagctccatcgccacccgctgggtaaggtgggtgtagttctcgcgtcgccttcggaggagtaaaccgacacaggcaggtgtctggcgcgtaagacgccgggcgcttaggatcccaagcccgccgtcctggagacggaaggggaggagctggggagggggtgggaccttgagacacaattgggctcttgaggatagagaggcggggctgggtcttggagggcgggcccaggagaggtagaaagtgatctgagcgccgatgaggagcctgctttaaggggcgggcctttggagactttggtggatccaagagggggctggtcctgggaaaccgtccagggccgggaagtggaaactaaaggggctgggtaagggagactgaatcggcccttgcccgtggccatttggagaaggagaggctagaaaagacggggcgatgcctggaaaagccaaagggggaggggttatgtccttaagggcacagagaatcaacctggctgattgaagcaagaggccgaccaaagccagtcagtacctgggattggccgtctcaagagctagggcctagacgagcagagagctaggactggaacacttaagaggcacgcaattaaggggtaaggccccctttctaccccgtatgagtagcattgggaaattccaggggcagagcttttttggaggagtagaatacagagaagagggagggctttgcatatttgaagagcagggtgtgctttggggatgggtctagatctgcaaggggtggggcttggaggatctgaaaggccggagtagctggacctgagaccggcaaggacccgagaccggcaaggaccctggccaagatccgcacggggcggggtttggtaagctggaggtggggcctagagtagaaggcggggcctgctttattaaaggcaaatttttgaccagtaggggagggcctagaatggatactccggcaggaattatatgaagagagattagataagtgaaaggcagggcctgatcacagcaggatgacatcattaacagagttcaaaggagcagagggatgaggcttgggaaaaacccaggtttataacgttaagggtggaggtagactaactagggcagggcctggaaactcatctcatcaaaggtgggttttagaccagtcagggcagggcctggactcgctgggagtggggcttaggccacctaggggtggggcctggaccgcttggggtggagttaccaccagccagggtggggtttagaccagcagagttgggaccttagctagaggagtggggtttatgccatgtgggggcagcccagaccatctgggggtgggtcctagaccacctggggcagagtttagaccagccagggctgggttagaccggcagaggtgggccgtgggctatctgggggcaggacctggaccatccagggccgtgtctggaccattcagggcagggcctggaccacctgggggtggaatttagaccatctgagggggtgcttgagcctgcctgggccaggaccacgcatgatgcagtctggaccattggcggccctacaccacctgggggatggagtttcgaccagccggggttggattagaccagcagaggtgaggcctgggccagctaagagtgggccggagccctctgggttggagcttagaccagcagggaagcgcctagagcatcgggcggggagttgtgttcacttctggcaggacttgggtcagccagatccaggacgggggtctagaccactcggggtggggcctagaccgcctgggggtggcgcctgggcccgctggcgcaggcgggcaggggtcggggccgggggcgggggcggggccgggggtggcctcgaggctcccgtctgaccgtccccgcccaggcctgagcaacatcatcggcgtgatcgtgtacatctccgccaacgcgggcgagccgggcccgaagcgggacgaggagaagaaaaaccactactcgtacggctggtccttctacttcggcgggctgtcgttcatcctggccgaggtgataggcgtgctggccgtcaacatctacatcgagcgcagccgcgaggcgcactgccagtctcgctcggacctgctcaaggccggcgggggcgcgggcggcagtggcgggagcggcccctcggccatcctccgtctgcccagttaccgcttccgctaccgccgccgctcccgctctagctcccgctccagcgagccgtcgccgtcgcgggacgcgtctcccggcggccccgggggcccgggctttgcctccacggacatctccatgtacacgctcagccgcgacccctccaagggcagcgtggccgcggggctggcgggggccggcggcggcggcggcggcgccgtgggggcgttcggcggcgcggccgggggcgccgggggcggcggcggaggcggcggcggggcgggtgccgagcgggaccgcgggggggcgtccggcttcctcacgctgcacaacgccttccccaaggaggcgggcggcggcgtcacggtcacggtcaccgggccgcccgccccgcccgcgcccgcgccacccgcgccctctgcgcccgcccccgggaccctggccaaggaggccgccgcctccaacaccaacacgctcaacaggaaaaccacgcctgtgtaggggcgcggcgggggagccgaggggcgtgtccggggcgcgtgcgcgggcgcgcgtgcatcgaggctgccggggtcgggggcgcccccgctttcccccgtgagcgcgctggagactgctgggcccgccccacgcccaccctccccgcccccctccccctccgaagcagggaccccgagggagggggcaggggagggagggggccgctgtgagggagcgtcgtgttttatttttttgggggatctatggggaggggggagggccatggtgttttttgcagtttcgagatgttttctttttcatgttttgctgtgtgcatggggggcggggcggggggaggggagggagggactcccagcccagcccaactcctggagaggggcccataatacacgaatacatagttacacccacaaactatatatatgccctatataaagagacacagcgaagggatgcagaaaggcagaaagaagggttggacgcgggcattcattcatttttttcattcattattccacaagggcttattaagcacctactgtgtaccaggcactggtacataagaaggcattggagcaggggacacgaacgaggcacagaaagggccttctcattcattcattcattaccggcaatttatttgtgcgccttaaaaagctaggcattgtgctccgtgctcagcgtgcaggaggcaggaaaacagccaggggccccgacgtctcatagagtaaacatcttgtgcatgagacaggcattaatcgatcatgtacatacacaataaattacagttaggctataggagaaacgagatgctatgaaatgctccatcaggggagcctaacccagttgtgaggaagagatttcagtggacagtgaaaggatgagaagaagccagcagggcggagctggggcaggagtgtggcaggcagagcagcacgtgcaaaggccccggggcaggaaggagcttgcagcgagggctgaagggtagtgaggcaggtgagcggggatcaaggtgaggccggagacacagacagggccagattgtgcaggggctcgtaggtcaggagttcagattttattctaggagtggtgagggccgtggaacgggtttaagcaggacgctaacgtgaatggtgtacaaagggaagacaggaactcggaggcaagagtaggaggcagagatgtgctgaaatacagcatcaaacatgggcacgggcccttggagctcacactcttgtgggaggaagcacgtaattacacagatgctgaagcatagtcatggtgtctggtgtgcaggagaaagccgtggggcttagagactcatgtgtctgtcactcgttcattcagccactcacccattgccatttttggccatctgctaaggtaccaggaagtgtgttaggatccagatccccaggggtgaaacagactctagccctgctctcaagcagtttattgtcatcaaacaccgccatccaggcagggcaatcggtgctggaacccggaccaccgtgggtaccgtggcacacggtggacagagtgaccaactgccaggagtgagcagcacttggggtaggcttcctggagaatatgatgcccattctgggtcttgaagaaatgagtgggcatcttctggttgatgaaaggcatgagaaaggcttgtggggccaaagaacaacttgggtgaaaacgggaggaagtgaacgagcatgatgtattggggtcagtgctaacagttctgggatgctgatgtacaaggtggggctgggagatgaggccgggaaagtagccacaagctagagtgtaaaggtaccagggtggccgggcgcggtggctcatgcctgtaatcccagcgctttgggaggctgaggctggagtatcacttgagcccaggagtttgagaccagcctggataacatggcgaaaccctgtctctacaaaacattaaaaaaaattagccgggcgtggtggagcacacctgtggacacagctactcaggaggctgagggaggaggaccatttgactccaagagttcgaggctgcagtgagctaggatcgcggcactacactccagcctgagcaacagactgagatcctgtctcagaaaaaaagagaaaaaggtgcctgagttccaggcagagggactgaggctcttctaaggatggtgagagaggatgacagctgcgcgggggcaagggctgtgcggtgattggaggggatgggtttgaagttcactgagaaggcagaggggacagcgcccagtaggcttcccttccatatttgctcagcaagtgtttcctgaggcctcccccgaagccttgtgctgggcggtgctgggagtggagaggtgattttgatcttgccctgctctcaaggggctcccagtctggcgggaaaacaggcacagacgcagcttgaggaggacgtggcagcggtggtgccatgctgccaggggctctgcgtgcccttctcttgacggaagggtacagatcagagctgggtgttcagaatttctctccgaggcctgtgtggaaggaccaggaagagagagactgaaggtccctaggaagaattctgccaaggcggtttcaggaagagatgctgggaaatgtaggaaaaggaatacaaatcagtgagacggagaagcgctgagtgagagagacggatacgtggagagaagagggatgccggagcgggtgttaaaagagacaaatctggccgggtgctgtggctcctaatcccagcactttgggagactgaggcaggcagattgagctcaggagttccagaccagccaacatattgaaatcttgtctctaccaaaaatacaaaaattagccgggtgtggtggtgcacgcctgtagtcccggctactcaggaggctgaggtgaaaggatctcgcttgggcctgggagggtgaggctgcagtgacccgtgatggcaccactgcgctccagcctgggcgaaagagcgagactctgtctcaaaaaaaaaaaaaaaattgagagacagcaaatatttgctggaagagggagagggaactggttaggggagaatggattctagagtctgaaggccaaacagaacgagagagagagagagagagagagaaagaatgaggttgagggtaggcaggaggaagagcaagatggggagggagggggagagcaggagagaccaaactagtagagtcacagacagagaaaaagtcaaagacaggaaggtgatacagaggagagagaagaggaagaggagagactgacaggtgcacaaatcagagaagtcccagagatagcagaaacacacacagagacagagatagagagggagaggtaagccggagacagactcagagattcgcacaaaaagcaacgtggagactcagaagcaagcgcagcgtcaaggaatgctccatttctggtgtgttgttttcccagtattcaagaaatatttattgagtgccaacctgttctagacccaatctcggccaggggatgtggtggcaaatagacggacaagggcctgctctcctgaaacacactggagagataaacaataaataatatcatttcagtaaccaaaaagtgctttaaaaattaagctgaaggccgggcgcagtggctcatgcctgtaatcccagcactttgggaggccgaggctggtggatcacttgaggtcaggagttcgagaccagcctggtcaacatggtgaaacttcatctctaccaataaataaataaagtagctgggtgtgctggtgtgcctgtagtcccagctacttgggaggctgagaaagaaggatcacttgaacccaggaggcagaggttgcagtgagctgagatcgcgccactgcactccagcctgggcgacagtgagtggtaacagaatgacagagcaaggatgactttagatgaggtccttggagtagaccttgtggcagaggtcacagagatgtggattgtgagtaggaaagagaggtgagaaagtctgggggccaggcattccacccaccagaggcagccccaaagcccagaaaagtagcaggtcttcgaggaggcctgtgcggtgagcagatccaccataggacagaggcacagggtaggggctgatcagttagggccttggatccttgggaagaaatctgaattttattctagatctgatgggaagtgcttggagggttttgagcacaggcatgccatgatcatatttttattttcttatttatatttattttgaaaaagagtcttgctctgtctcaggctggagtccagtgggctgatctcggctcactgccaacctccgcctcccaagttcaagtgattctcctgcctcagcctcctgagtagctgggattacaggcatgtgccaccacgcctggctaatttttttgtatttttagtaaagacgggatttcaccgtgttggccaggccaatctgaaattcctggcttcaaatgatccacctgcctcggcctcccaaaatgctgggattacaggagtgagccactgcgcccggcctcatatttttatttaaacaagaacagcagaattacattgctgtgctgagcatacgtagacttcaggagtcaaaggggaaggaaggaggtagcgggctgttgccttcctctggttgctggaggcctggaccaaggtggagttagtgggatggaggaagtggaagaaggcatgggattttggaggctagagcctgcattggtggtgaactggatgtcatagaggagggaaggaaaaggaaccaggaagagaagaactctctgaattgggcacgcacatctctgatgggcaccgatgaggattgttaccaggaacgaggagactgggatcaggaaagtggctttgggagggaggaaccaaggcttctcttttggatgtgtcaagatagatctgccttcgagaaatccgagttgtggtatcaaatagccagttggatatgtgagactggagtttgggggaaagagaggccgtggctcaaaaacgtaagttttggaaacgtcaacataaagccacaggattgggtgacgtggcctagcaggggggtggggacagagaagcgaccctggccagagccttggggacatctacatctgggggagaaggggatgtagcaaaacgagcttaggagtgatctcgaggtaggctgaaaccaggagggttacagagggcaaatgcacctttgtgtttcaagaaggagaggagacagccagctgtgccaagggctgctgagacttggacaaggatgcagagagcagagtgaccattaggtctgatgacatggacagggttggtgatcttgataagataagatgtcagttcagtgcagtggtggggacagaagccctgctggagtggaggggagagagaatttggggggaagacagaaggaaagggaattcaggcaagtgtgtgtgtgtgtgtgtgtgtgtgtgtgtgtgtaactgacacaaaggccaggtgcgatggctcacgtgtgtaatcccagcactttgggaggccgaagtgggtggatcacttgaggtcaggagttcgagaccagcctggccaatatggtgaaaccccgtctctactaaaaatacagaaattagacaggtgcggtggtgcacacctgtaatcccagctacttgagaggctgaagcaggagaatctcttgggcccaggaggcagaggttgcagtgagccaagatcacaccactgcactctagcctgggtgacagagcaagactctgtctcaaaaaagaaaaaaggtaaaaaaaaaaaaaaatgaccctgaaaggaagtagggagacatgcagatagggagatgggaggcagaaaattgcatcctgcaattagctgtcacagcaggcaggagcaagagagatggggaagcccagggccaggaggggaagatgaattcagggggcagggaagagaggatgctgtcagctaggctctggcagatcccctagccagggatgctctgcccagctcctgtctcttgctgctgtcagcgccgggcacactctgggattccccctgtagaccctgtcaagacctattgaggtgaaggggaagaacacgttttcatcattcattttcagaaataaacattcactcagttcttggaaatactttctggccaggcttgggggctcatgcctgtaatcccagcactctgggaggccaagacaggaggattgcttgaggcttggcgtttgagaccagcctgggcaatatagtaagaccccgtctctacaaaaatgaaaaatgagctgtggcgtggtggctcacgcctgtagtcctagatactcgggaggctgaggcgggaggattgcttgagtccaggagtttaaggttgcagtgagctatgattgcaccattgcacttcaggctgggccacagagcaagaccctgtctcagaaaacagaaagaaagaaagtcaaagaaataaagtcaaagacaagaaggtgatacagagaagacagaaaaggaggaggagagagactgacaggtacacaaatcagagaagtcccagagataacaaaaacacaaccacagagatagggagacgtaagccggagaaagacccagagattcgcatagaaagcaacgtggagactcagaagcaagcacagcatcaaggaatgatcaataaaaagaaaaaaaaatatttcctgaggacttccaagtacaaggccctgcaatctcaggccacttctgtcccatctctgccttcagagggggggacaggtagtccagacaattagaatacagagggggctgtgttctgacggggccacgcgggcattgaggaaacgcagcaggcccctcccctagctggggcggggatgtctgtgtgccatcatctcactccatctggtcattcctttgcccattcatccatccattcattcaagtcaccccatgcacattttccaagactgcctgtgacctggccctgtgccgggtagagctgaggatgccaaggtgaattcctcctgtgcctggccccggccccagtctgctggaagaaccagacacagacaatcacactgcggggaaacacgtgctccatcggaaaagtccagagcagggggtgggcagagaggcccagcgtgcaccagagcctcgctcaggtcagcgccaggcctgcctggagcagccaactgtgggagaagaaggagttggtgaaaggtgggtcccacctgggccgtccacagaagggctgaggggtagggggtgaggggttgaagatcaggccctgccgccatgccacacggctgtcctctgtccctgctcctgggggagctgaaactgcatggaaggtcccccaggggtgccccgtctaataaactcgatgaagagga

SEQ ID NO: 781 - DNA, 128597 bp, Homo sapiens
tgttagtgtttagtcattttaataatcaaaaacagagaaaattaccaaaagtgaaattcacagacaagaaatactttaattaaatattgtgtaaaatgaacatttttatacagttaaatatctgaaaaaatgtacagataaaacaatcttattgtagggtctttaacagtaaaatctaccatttagtgaagtgctcagtcttgagacagtgaagtgatgtgggcattgactacttaacctaaaacacaaaccaagtgagggcatggggaagctggcaggcgttctcagtgcgtccatgtgagctcttttgtagatcaaacccttactcgtacaaaataaaatggaggcaatttagttccaaagtgacttctcaggctttcccatgtagctagaccttgtcaaccatcacaaagccagactgtgacctgctgactcctggggacattctgtttatttaattttgtccctagaatgaacactttgtaagttgtgcattgttgatttttgtcaagaaggtattttaaagtccctcctttttgttttaaattcgatttctgctgcagtttgcaaaatgtttgctgtgccgtgtctgcaaagcacttagtgcaaaggagaaagaaaaaaaaaaaaacacctgacacttttggtctcactgtgggtttggcactaagaggcacgatatctgaaggaggtcattccagttttaaaagtacggacagtgctgttggaactgaccacaaaaatgtattgttaaaaaaaaattgaaaaccagcagtgatttgggtccccctgaaacctctgtgaatcggaggtgggcccaggagggtgcaggacgcagcagaaatagtcccagaaaggagagacgggtcatgcagcgggcttgtgcttttttgtgtgtgtttgtgtgttttacaccatacatctccaaatgaagtatttattaacaattgtagtgtaagcctgtgataaaatagcacaaaggttctttaaagaagttcacttttaaggcatcagaaaagttaatgtggcaaacattttaattaaaacatcagaagtaaattttattttaaactttaggcctctgaatttttccagtaaacacagttcagctatgtggcaaagtcaatgggtggcatctaaaatgactttttacattctacaaaaaaataaaataaaataaggacacagccccaaacggtgtcacctcttcgcggccgctccacatgcacagaatctactaggatttgtcacggccgggtggcaccgatttgttttgactatacaacaaacttttttttcaaaagtatttgttcagataacttaaaaataatataaaaataaacaatgaatttgacttttcctcaaaataaaaaaaaaaaggatggaaagtctaaacaatagcatattttttgaagtacaaatgaaatgtaaagacactggttcagcttaacgaaacagatcaaagagacaagttcttggctaatgctcttcccagtatcacaacaccaggccgtgatcaaaaaccaatacagacaagaaagaagaaaaaggaaaaggtgggaaaagcaatgtacaaaatttcaaagataaatacaatatttataattgatatgttacaaaataaagtcccttagcaactgcaagtgttcatgggaaagtaagtgtcaaatgaagaccattttattccttataagacacataaggaataaaacttgtttttctaaatattttaagtggatctgaaaaaaattcaagacaagtgtataaatatttagctacaactttggcaaaatcacaaaagtctacaattttataaccacatacaaaacacattagggaagaaggatctagaagtcaaaaggacaatttctggtacaagaaacatagacctcacagtagcctaagaatgcaatagtatacagtgctagcaaaagttgaaaaaatgttgcagatcacacttgcttaacaggaagctctagcagtgggagaatattggaaccaacagacagtagcattttttctctgtcagtgtgcttgttgaaggcaagagaattcaatatcaaagttacaatttctaactacaataagttacaaagtttcatttcatgaagatgaagttaagcagtgataaaccctccctccctccctgccaccccagtttctcctcatcatatagtcatccttttttccagtctgatggctcatacctccttggccctctttttatcaccacaaaaaaatatttcacattatagagatacacaaccattgtgaatctaagtatgagtacagaaaaatgtttggaggcatttttcatcagcgtttcatgatcatcaaaatggtgcattcacaaagtttctcccaacacatagcaattactagacatggccaagacggagtcggaaactttatacaaaataggcgtcgctttgttttccttattcttcaggactgagaaatgtgaaaatatgagaaaagttcagtcaataaaatggaattgttcatgaagaagtaggctgtttgcatgttgattcttaatagtttaaataaaatctttaaacaaagtcttttgtagcatttcaattgctgctgatttttttgaagatactgtttccatcagcatgtcttaatatactaaacgtgtcccctgaagtccgtcctttgatgctgggtgctgcggaaggtaaacagaagtccctcacattggcgggactaccagcccagacatagctgcaagacagaaggacagagcagttactgcaggctcccccacgcgccctcccgccaacgctgacgcgggcggggctgcccttcccccctattcaactgggaggctggtcttgcacagttccgtccaccagcctcgggcgtggttagggcgtgctggggaatctgcttcctgaggtgggggcacacgtggggacaacaacccccagtcctgcccctcctgcagccctcctcaaaggcttctttaaaggcttcttttggaaaagggaagggctcctggcactgctgtgtgcagaggctgcagcttccccacactgaccggtgcactgccaacaggtgcaaagccaacggaggcccggagccccctctgtcgagagaggtgacccagcctggtcactcccgtgacgccagtcaaggccggctcacaggccctgctctcgctccctatgtgagaaccagactggcctcagtttccccctctgcttccaggtctgggctctgaccgtgcggtcatctctctgtatcgtaatggtgagtcaggggctctccagaatcaaagccactcacagcccacctgccctggaacctccaggcaagggccacggagagacgtgagtcatggcaccgcctcgggaccttttttctcttctcaggaaagaagagaaaactttgcacgaaaacgccaagtggggctgacgctttcacatgaactcctggtacgaatgtaatttaaaatcttttaccgctggtgttgtttaatttttgtcagaatgatcgttctcattaatttatgtataacatattaatacatttgttcatgtagtgacgtgagcttcaatttctcagttcattaatttcaacaatattaatttatctccgactcaccgttacaactttacggtttggaagccctgtgcgtacacaccgcgtaggaggtgccgtctttcagccggcccgaccccgtgtcacgggcagggccgcggcacctcaccacctgcctctgcaacgaccctggtgtggtgcccgctgatggcacgcaggccagtcggcggcacttcgggggcctgggcgtcccttcatacgctaacggatgttgtgaagacaatgatttcaaatcactgatacctttccagttccttttttgagcattagttcatcaaagtgaaatatgccaccgacttcacaaaagggccagtttgtcttctccgcggctacgtcctcagcacccagcagagagcctggtacatagtaggtgctcagtaaatactggttgaatgggttcatgtttctaaaggagtaactggatttgagtcactgggaggagcatataccaaaggtggtgtctgaaagaggccagatgacggccacttaatttaagtgcctgcgggcctcagcacctcacaaagggccactcgcaagttcatgaggcctgggggcacccatgtggctctgcccgtcacacacatcacaggccacgtgcagcctgcacagctcagatgggccaggcgctgggcaggcacagggtgcccaccccgtgtggcctcatctgtggacagctgtgccctcggggccggcccttctccctcctgattctttgaaagagatcacgtaggaaaatcagctcctgtccacagacaggactgcaacctggtgttggtacacacctggccctgggtctagacgcacacctctttccaaaagacagtgcagccctgctggatgtgtggcccagcagataaggtggagaaccaaggcccagcctcgggacaacgagggtagcagattttgagatgggctccacaggtagcatggtgccccgccattcccatgccagggctattttcgctgctttgtgcatagcaggctgcaagcccaggagctatgggcagggcagcatcctgcgctgagaagtgccaggccccgggcaaaggcccattggctgaatcagaccgacagtgaccacagctaccttcaccacactcccgccttctcttacgtggtcccacccccttaggggcacagggtgctccaccgtaagtacactaggtgccgtcggaagggtgagctggacaaaaaccaagaggaggaatctggtcctttctggggctcagtgcacaggggtcctcgctgtgaacaccaggcagaggtggcacgcatcaaggtgggccacgggagaacatgcagcagtcacagaggtgccaggagaaaggccgagcccccacccccactcccatccccacccctggagaggacccagcactggcccacggccccgcaccaccctcaccttgcagtccattcccgttggcgctggtgcaggaaggaggaggagaggcttggggccggaccacgggcgcgaaggcgctcttctgtttcactgcggagatgacattggcaggtgagaatgagaaaatgccgtgtgtgctgctacagtttgaagggagggtgaccgaagaggctgccatggtggggctggacggcactactgcaacaaagcaaacacggtcagcacgcgcggccgcggcacagcgccacggcgagagggcaccaaaggcctcgcctcggacgggggggcaggggcacgaaaacaaaacatgacatgcgtctggctcggccacgctctggataacaggcaagctcttttgcactggactttcccttccaattgagcagcccattttgttctgattttgttttggtttccaatgagatcacatcgggcccgttttgggtcaatttacggtcgccatttggacgcccagcctccagggccacccttccttttatccagtagctcacatcacagaacatccaagcaatgcacacactcgactcggtagtgaatatgaatctgcgtgatgacgtgtgacaaaaacagacacttactgccgtagggagagttagcggaggagccattaagaaatccaggcgagccagggacccctagactggccatggcgccacttccatatccattcatgctagtgctgactgtgttgtaattggactgctggggagtactgctggggacgtagcctcgcggggacacgctgcttgtattgcgactgtagccgactgttgaaatcccccccccggccaaaaataacattattatcagcgacagacacttggggggggttccccgagaatctatatcatatattaacattgctaattgaccctgtgctttccacctgctctagcgcctgctgccagctcggatgaccttatcacgccaaccctgctgccactgtctcaccgtgagccccatcctgtctctgctggcttcaacagccagccggggcgcgcttcgatctcgccgtcagtggctttcacgtttctctttagaggcaattatcaacagcttggattcctggtctgtccccccacgctctgtgaactttcggcctctgtagaccttcaaatgccatgactgacaaggagagcttgtttgtggccgtaacttcccctgaaaggctgtttgggggtcttcatttgtatggttgttatttctatacatgggggcgttcgggggacatggaagcttcattcctgccatgggagcttgtggatggacgggaacaaaatcagcaatagtatgggtgaggtgttttctaagatcactgcctgcgcgcttttcaatgaagaaaactaaaatggacccaaatggcaagatgcagcggccttggctggcccaggacactgcactgtgggatggggtgcggggtggggaaatgggggtctgtctccatggattcgttccaaacttagacccaaatcccgccgtgcagtgcgtccaagcaggctcccctcagctccctaggccatggctatcctatggcttagcccagacttccaaggaaagcaaagtctcttatgaacacattgagggaaacttctagcaaataccagtgacccgcatggcatccattggagctgccgtttttagtaactgggctctctgagtgttcttaccccagcactggctgggaggacctgcagcaaggtcttcctgagcaaaggaaccagcagagccagagagaacagaacgctacggacattccccagctggccctggacacgtgcctcttcagctaaggcctcaaccaaccctcggagggcgttcagggcaggggtcctcccagcatgctggcataccttggtcgttggcttgtgacgtctctgacacgttgacggctagctggctgctgaaggagttgacgcccatcatgcccgtgtgtgcagggttgttgcccagggtggggatctggttgtgattgcggggaacgctgtacagcgcctcggcgatgtccgccgctcgcttcaagatgatctcctgcagcaggagcaagtgggagccggcctgtcaccccaggcccggcccagctggccgcactctcgggggcccaccatggtggcatcccactgtcccttgcccagaccatgaccaaatctatttcttaatgggcaaagagcttcccctagaaaatcatttactgacgcttttgaaagtgtgcaatatctggctgggcacggtggctcactcctgtaatcccagcattttgggaggtcaaggcaggcggatcatctgaggtcaggagttcaagaccagcctggccaacatggcgaaatcccatctctaatgaaaatacaaaaattagccgggtgtgttggcaaacgcctgtaatcccagctactcgggagcctgaggcaggagaatcgcttgaacctgggaggtggaggttgcagtgaaccgacactgccctactgcactccagcctgggtgacagagcaagaccctgtctaaaaaaaaaaaaaaaaaaagggagcaacatttgctgtgttctgtcctgcatgctgtggggcgcccatccagccctccctggttcccagcggcaccaacaccgtccacccgccactgcacactgcagatgggtttcaaggctgtgcactcccgctgtgacaagttttttctgcttttgggtcctgacaccaactcatcatttctacgtgaacctagcgtgagggcaaggatgggaagccattctcacatcagactcctgtggagtcgctggaaaagcatgcttatgtccagaaagcccacactggagccacgccggctgcccacgggttctggcatgggggggaggatgggcgaggggagccgccctccacctacctggttgttgtgaggcattccgtataaggcttccaccaggtccgccgcccgcttcagtaacacctcctaaaggaagagcagacaggaggtgattcatgggaggaaccggccagttatcactgcccttcagtaccagttccgtctgcgggtgtggagaccagtccccacccacagcgacccgtcctggccctgccgtgcacttcgaaggcaggcacagacaggaaggcacgtgcgtgctgacaacactgtttgtggcctttacaaggaggctgaataaaagcgttttctgtggctcctccatccggttgggctcacagaggtgcacggacaagcgggagggccggcggagaacgagcccaatccgtgcctgaggtttaatgacggagtcttatgggtattaaacaaatacacacatggcggagatatgaaaggcccaggcaccacatttgcctgttaattcctagcactttagtggtgaagaacaataagtaattttccatatcttaattaaactggcagagtccttaaagacaacatctcacccctaattcacgccccaaatttgcaagtgagttcagtgcttattcctctttattttgaacaataaagtgaattaacttgggttaatctagttctttcataatgacattaagaaatttttcaattaacctctttgactgcatgttgtaaaggacttcataaatgccttcacattccgagagtgtgcgcgctgtgcctgggggcttggatgcaccgagttttgtcttatccacgtctgcacgcctacctccagtttacgattgtgcggattaatccagagtttagttaattttaaatacaaatgggggcttacgttttaactttctctaccttgagctgtaataaaacggagctgagctttttaataagccgaggccaggcccaaacccctccccagcatggaagacgggcagagagtttctttccaactccattcagccaggacagtgctagcacagaggtgaagagaaaaattccctgggtggctggagcacagtggcctcctgcggaccccaggcccggtctaggagagctctgcggtctaggagagctctgctggtccaccttttaggtgtggaggtgtgtctacatctgggcacctcttgttaacctgagaccccaaaggtgactggacaaaaagtaaggcaggtggccttcgctcctgggcctgtggctgtggccttcccagagagctctgtggtgcctcacagacacaccagcttatgatttctgcagattcacataagcagatttcagcctgaacctcttaatgcaaatacagtgcagtcggctggtgggaagcaggcccgtaatgactccactgttaaatctgtgttacatctgagaaggcaacgactgccttccaaggactcactcgcctcattgtttccccatctcccccaacatgccgactctggaccctttatttatcaagattaatcactacgggcatcactttttgtgcgtgccatacgttcccaggaacagcacttaatccagaaagttcccggatgggtggctctgacaatgggcatttacctctgaaattggtgccgacgcttgatgttgcatgcatctagtttgcatacaaataaagaattagacttgtcatgaagcaggtataatcaatgaaaggcccagctgtcttaatcaggtttcgttagcctgagcagctctctgtgagcaagataaagtgtttttcagaggtattaataattactcataatctctcctatcatatcgcaagactttttacatgcctttcaattttaagcaacgattaaagcaattaagattgctgcatttacaagctatttttcattcccagaaaatatcctacacctacttgtccatatggtactttgcaattggaacataaggatagtttaggaaaattacgtatgctcttatcctaatctgcctattactggatagtgtcttaactaatgaacccgactttctgagctgctcttaagtggtggtcttgtcatatcagagagacacaaaacgggtaacccaatcagtcaaggatgctttgaacaagtttgttttgttacaatatgccgagcttatgcatactgcctcatgctgtgaatacattagcaccgaatggtgtttgaaaagcatttcgatggaaatttcttagccacaaccataagtgtaattggctgcctttcaataggacataacagacttcaagttaaatggaaactattaaagctcaaatgatttctgccgttgtttcatgacaaatgtacagttttattattatgagtattcattcttgtacagtggtcgacagcgatttgaatatacatgattattcacatgcccgatgatctagaatggtatatatcatcacagttaaaagaggtaaccaaggtgacgttgcttcaggtgctaatgtcattataaaactgtaaagcaattattctgttagttcttgcctggggttatgaatacattgaagagtgcagagccattagatgtagctacttcaaaaagcggggaaaagaagatgaattttaatgcatgggtaattgctcaacatgaccgcattcctaataaatttttgtatattagaaaaaaagaacagaatatatttgtgtatgatgcatgaaacagaaaaaaaactcagatgaaatgcatgcaattaattttatggtaaaatcattttatgactatgcaccttataataaatataatttgttagagcacaattccatgcataaaatgtaatttgttttttctgctttcattttttttttttttttactataacatgtcttagccttgattatattgtttcaaataaggcttaaaaagaatgagaattctttagtctctgatcacttagagacgtcttcccttccaatctctatttttgccacatgagtgcctcttgatattgcctttattttcattctgggctttgtgtgtgtgtgtgtgtgtgtgtgtgtgtgtgtgtgtgtaaaacatttgcctatttatgccactcccacaggataaaatgggtcatttttgatggtgcctaaaattaggaggtaaacttcaattcaagccaacccccctctctcagaagcaacactattcgcgtgcatccaaaacaatgtgtgtgcaatgtattggctttctgtcgccccacaattacccatcaaaccacgtgcattacggagcttcaaaaaaattgctgcaaaaatcaatattgtggtaatattatcaactgcggggtgacgccgaggagggggcagcactcctcggcaaagccttattgagacacacgctttacatctgcggaatctcatctctcatttctattcttttttctctgtctctctgcttgtgacacttacggctgattttctttattccatttcttttttcattcaaaatgtatgttaaggccaattgctgttttacttaggacccactctgacccttgtaaagcagcctcagatggctggcttaaccatgatgaatcgcttggcagtttaatttacatgccgctgaactccacatttgggtccattagaacaaaatcaaatatttatgttgtttattgaaactgctagatttcatctcgttcagtgatcgttttatgtgaagcctgaacaatacgttttcacctgaattaaaagagctaagtaatatggggcagtgggctgtgggctaactgatctgtcaccctgctggagggcttatgggaaaaaatgcccataactgagaaagtcttctgtcccccggggaggcagaagcccttccctggagggctggtaggcttcccaggggtcccatccaggcccccagccgccctgggggctcagggaaagaaggtggcttggaggaggctgggtgctcaccaatgagggccctggcaggcacgcggtcacctgtggcgccaacaccagctgccagcggggaggactgtgctgtggggttctgcagggacctgaggggagtgggaaggtgaccagggaaccccccgagagcgcagctgctggggtgtcttccctgagggccacccagcctcaaacccagtgcttccatgggcctgccaaggcatgtggtctgtctatgggatggcgggacccagtcactaatcctgcacacaaagccagccctagatggaggctggcagcaaagccctctgggtaaggatgttgcaggcctcgattcttcccggggaaacactcgttctgcctgggctcaccctcaggaacaaaaacccctccgtgaactgctctgcatttgaaaaacatcttccccagccctgatgatcctaacagtgaatatctgacatccgttgctagcatgttcacaaattaaaaagcagcctaatgacatcgcctatgttcatgctgagcattaaaaaggtaatgtctaaaaggttttattgtgttaataaaactcagaggtggtcaagacttggtacacacagggatggaatgtaaaacaatcagccataatgttatgacttcatttttcattttgcattttcaactctgccttggaaatcagatagggcttctaaagagagaaagagacaaaattatatcaaaggaaaggaaaaattataagcttgacttgtctttaatgttatacatcaaaatggaatttctgtgatatgtggcgtgtgcataaacaacgcgggcagcttttgtctttgttgaatttaaatggaaagtccctctagatattaatatgtggacttcatttgttagcctgctaagtcagggacttataacaaaagctttgtaaacaaaagattaaactgaatcgagctttagaaaatgaaaggaaaacaagagtcaagtaatcacagatcagactggggctgcttagatggaaatcagagcaggccactggagtggaaaatgtttaattgaactatttcattacgcggaagtttatgtccccctcacagaatccaaaatatttgttatcagaaaagctgttctttgcttcccttaaaaagatggtcctttggagatgagatgtaaaactcgagccgtctacgccttctctcacccttcgcccacctctgaagctggtcaggtgcgggcccgggcagctcctcacacctgtcggccctgtggtgggcacagagtttggggaatctgcaatccccccttcccagagcacctgctgcccccaaaccagaaccagcccagtggcggccccaccatgagcggggtgccacttgctcttttactaaccttgggtaacctttcgggatcacccggatgtcttgggatcactttctgcaacctctgaaagccgtaatctatggttggttcattaagggctgcaacaggacacagaaatgtagatcaggttaattacttttatgtcatccattactcgtttattgcacacttacaaataaatgtgtagttctcctgctctgatgctctctaaggcaagcacccctgaatactagctgtgtcttaaggaatagattttccccctttcttttgcacataaaagcaacgattatttctgatctataattagactggaagaaagtcaaagggtgactcaatatattgtaaaaatggtagtgcagtcacaaagttacaggtcttggggccatatgtagcaatcaccaccatcacgatgtgatgtctgcatcacacggtgccttccacactggccagggatttatgggaaactggcaattatgacatatgtccagctattgctagcctcagatttatccctgtggtccttttttgtctagcatattgcctgagcacaaaccaggcaggaggagcacttattcttgcaaagctttaataatctgtgaatggctgcctacaaactgatgtagggcactatcattctacagctgcaatccaccagcctcacgaaattgctggccacaaacagtaattaatctttttatccctcaaattgtaattttgactatgaactgtgcgcggccataaatcagcggcacatgcgctgtgtacagtgcatgaatcacggccgggactccgtccgactgcacacactgtgtttaacaagctttataaggagccatcgggctttattatggctctgcctgactccaacaaaaactgagcctggaggcccggggacacgagttaagatgaaaatacttattggagtacattacttcttgatgtagatggcgttttccgtggagtcactccacggtgcgtggcacaacataaatcagaggtttttcggagactaataagacctgccaccatctattcattactctgcctgcaatttgggccatcactcattagtaatttgatgattaacacgccccacctcagcaggtgtgcaaggtgcgggggcggacacaaagactgcggcttccggagaggacggctagggggccgcctttgcaagtgctctccaaaataattggtcaccgttctcgagtgcttgggcgtcggcgcatcttgtaagcaacgcaggaagcctcgcacgtacactcaataatgcgcccgaaagttgaggaccacaatatgatttgacattccatcatacatcccggagataaaggtccgcacaggaatgtgaagtaagacattttcttgttaataaagcattgatccgatgtattgattttacatgacatggcttttgctgggattttgccctcttttttctttgcaaatagtaaagctcttcaaaatgcctcggcgtatgtgacatggcaaaatttctaactctctgtgatgtaaattctatatgtgtaaaaccacttcataatcagaccattaatcatcagaagctgtcagcgttgacttgggggacaatttgtcatgtctctgcctaggcccaggccagagtgtcaggcaaaagcatagttcgggccgcggggcgcgtgcgcagtcgcccagcctcaccaagcgacttggtccaaaaaggattagataaagtattacctttcctgaacagggaacaaaaaaggcggcccactgcatttctaacgtgtcaggtttctcctctcccccagctaatcaccatgactgtttgacttaatgaatcggcctgatgaaaggtgatcagaaaagatagatgggcggccattattgatttcatgcaaatgcccctgacaggtgatagacgctttaatgcaagctttcagaagctttatgacttgtaataaccatacactctcattctgggagagacgctttccaatgtttcagttgaattgatattcttctttgatgcccaaaaatatgtgaaagcagggtaagtacatgggcccctttcacctctcagttcagcccaaagagcacttatgtcttgaaagcaatgccaagaataagcgcggcactccattggaagttcggatgtgaggcgtaattgtgcactgtgggctcctgccaggctggatgcgggccgaggcaaggggctggggctgccattccagctctaaatcccttccaggggctgggctactggaagcccagtgagttcacgttcaagaattagaaaaaactgcccctctctttttaaattgcaggaggaatgacacgcattcgtggttctgggaggcttctgatcactgaaggtgggggttcccaatccacctctgtgcccccaagagcacctgccttctacagagctcctgggttctgcaaagcctggccaactggtggcccctctggcccacagccccccaaaccctacagaacccaccaccgccctgcaccatcactggcaagttccccgacgggaggagaaagcaccggggcctcacacacatctcatgagccctccgcacgcagagtttacgggcgagagccctgccgagccagggcaaggcgctggcacgtccagtcacagagccccgagccaggccaatcaataccactttcctgttttagaactgggtaattatgagggggagagattgcctgacctttcacctgcgctgcattactttgctgatattaagataaattgcctgattttgggtaaacatatgctgcaattcaaactgtcagcactggtttgctcagggataatttgtattgatctcccagcttcttcccaattttgcttactgacctcgtggataattagagaaggagccttgggtgagctcaagtcggggatgaagaagaaatatgaagaagaataaagcaaatttgttttatgttaatatttgtgggtcctccccccaccctcacatctgtcagcatctggagagccgtaaattaatgtacttggttcccgagcaatttattcccaggaattgtttagcagcatgcttagtctccgaacacatgtcactgggttaaattaatttaaactctgccttaaacacaacaaaaacaaatgttattttctactgaagggggaaaaaaacaatacgtttctcaaaattttgagaaacgtattgtaagctcccaactttctgcatggaattccacatatctggatctgagaggatgagttttctaagaaatccccccagaagtaattagtgcccattatttgtcctgaattcaaattttgctacgatgggttgctgcgtataagagatgaatgtatgtgtgaaattatatcgtttaagatatgtcagattacaaggctgttgtatcaaaagtcataaaacaaatctcccctgtgaaatatctctttattaaccgtgccataagatattaacattcctcatttagtggagggccttttatctgtttcaaatacattattcgtccttttagagataaactgtattaatatccatttgagtaggctaccgcggcctaatgcatagtaatttttgttggagagcttttattttagaataagaaaattacacagcaataaaacctgaatgaatcagaagctagaatagccgggaatcacattccatgccaaatgaggcaagcagtcgggcagcctgtgaaaggccagatatccggctatcatatgcaggccagtatccagagcgggtcatacaaatagagcctgacacgaccacatagactcaatgcttcctgcacgctggaatagcctacagctcgggaaggatacatatttaaatatatttgagtgtactggagttaatctcgttactttacatgcattaagtcataacagaagaagcattctaaatatttaagtcatgcccgtgtactgggggattcatcacaccgcacttgatacaatgttaacggtctgtgatgtcagttcaacttgggattgctgcagctaatgtggcagcagaaatggcatcaggcgctgagctgcagctggggccagagcagctccaaccggcctgctgcaattagagacgtaccggcgggcaggaggcactgggattttctttcttgtgacatacgtggttgtagttttcattttgatggcttaaccttctttgtcagccagccccgccctgagttcatgttgatctctaataccccaaaatgtatatgattattttattagacctgaatagcaagtccgttaacttataaacgtcattcaattaaattaagcaaggggacacgttcagtacttctgggttgataacacagaaaaaaagaaaaattcggattggaaaacatacacgtttggggccagtgagcactttctacaaagagtagtggaaccatccatcttaaatccagttcctgcaccaaacattttatcaagcagctactacatgcctggggcttggtcgtgggtccccaccagctgtgggaaatccacccccaagggcatcctgtgagcagcagccgagagcagagggaactgctgcaagggactctggcagtccagggcgttgaggtccccccaaggcctggaggctccctgcctgcaaacaggactggactgtggcaggaaggaggggacagggtgaaagagcttaattgtgatggcaacctcctgaccacccctgcccgggagagctggagaccagcccagccagcgagcagtgtgcgccgcctgtaagtactcctagagtaattgctcttccagccacagttgtgtttttaaaatagtgtcattaaacacacaaggggggaactcgcaggtaggaagtgagacgcttttagcattgcctctccattgtttaagcccaagcccagcacgcagagagagatacaagaagttttaggtttagcgcaaattttcttcctgcctgaaaaacctgactccaacaataaaaacaggaagacattcatttgcttcattccagctgctggctgcagctattaaatgagttccagtttcatttcaataatgatcatcttcctgtagcttcccaatcatgcatttgtcataacgcagtaattttctagctacaaacagatcctcgtaatgaggcagtttttcacattagcaacataactacataataagaacatctgcagttccttttccgagggacaagaatgcgcctcaattaaggcaatggggattgttaaataagatatagtatattttactaacagggagacccagaccctaccccaacagactgcaagccgtcagtgtgcctgaatgaacacaggttgtaatgtgtaaaaattaaataaagtaaaattaaattgctcaatacaaagacattcctctagagggtgttagtgatttcagtgacaaagtgctatttgctgacaagtagtttacacattaaccagctgaatccaagggggaaaaatgccaatagcaattatatcaccttgaggttattaaatgtcccactgataagtaactaggtgaacttgaccaggtgataaagactgctgtgagcaaatgattgtgcggtgaagaatgtttttctgtcctgctgtttctccagatagcttttctttcaaaaatgactgtataaaaagttgcattaaaaatgtgtggccacggaagacaaaattgatatttagctcccccctgaataccttgcccccaccagagcgccttcatcattccacctcaaaaacattacacaaagtctgcaaatgcctgctttttctcccttttttaggctttaaaatgatgctaagttcttcactttatcatcaactgtctcctccaagtgcatttcatctataagaaattcagatgctcgggaaattaaaatttcaaagatctgctgcaaaaaaaatcaatggggcgagatcaatgctcatagaaatttcatgaactttgaactgatccgggcatgatgatgagaggtagctggagtttcaggcggctgatggctcctcacatggatgaaaagcggccagggcagctgagaggagggctacgttttagatgggtttttgctttcatattttgtccgacaaaaaaattaatttttagtctatttcagtaacaagcaaaaatagaaaaaaaaaatctgccttcctgatacgacgtgtaataccccgcttcttaagagcacctaatgctttgcacattaacgcggccatggaatgaaatcggttccctctgcagccgattgcaggtgcaaattaatattgtaaaatgaagatcaatgcatggacagggccagatcaatagtggctaaattattgctgcattttcctcctcattcaagatgagttgtgttttcctctcaaagtcaatactttgcagcttttctcattaatttctcaataaatttggcaatgaatttcaatcacagcactcggcagggtgagccaggcattgtggtgtgcacgggaagcacaaaggccttgcagcctccgcgtcgttcaccaggggcgctgcccgcgggggccggcctggctccccagcctggcaggaagacgtcaggtcaccctcctcctacacccagaggcaaaccttgtgtttgccctcacagaaatgacagtggcttttctagcatcctggccgctcccgtccgtggagctccccagtgccagcgggggatggctcagacctgcctagggtcaccctgggtttcacaccagtgactccagcatccccccaacccgctcactgcagggtatttctgtcgaaaagtcttctaaggttgagaaaaacacttgacttctaattggaattagagccgcctccttcgtatcgggaatattgttctggaattcacacagacagcccaaccgggcctcgtgcacagggaccagcttccattcaccactgcctggcagtggatggcggcattgtgatgtgacaccaggcacagaaaaggggacagctcatcttccttgtaccaaaataatacccttgctgacaactattggattgcattcaaacaattctgtttacatacctcaaagaatacattggatgatggcttttatagtcgtgtggaaactacatctacccagtccagccctgcagctcggaaaactaaggcacgtggcctcctcacttctccgtggctttcgcctctggggacgggactgggggagacaggcacttcccaaggcggaggttctgaggtcgggaagtgggccccaggtatcctataaccctcaagctccccaagaaggctgttctaacgttttaacctaaggggagaaatgcctggaaacaaaaggaagagacaccacccagtaaaagccaccctcaacatgataaaaagatgtgtgcgattgaatgctatatccttttctttaaaaaaggaacatcaagtgtccctctgctgccacgcctcccagagactttttgcagggaggagagaggtcttaagaaccaaacaggaaatctaatgctctgtggagaaccctctgagcaatggatttgcacactttaaaccagcggaaaatctgcacacagaggtaaacagaaaaaggagttggcaaagcccaagcccctcccgaggccagaggtgtccctgccagggttgaggacagaggcatccctgtcctgtgctctggggtgggccacactcccgtggggacgttcccagccaccccatgcacttgttcaggcatctgccctccccataggaggaaggccacccaacaggtcaccctctgccacgtgcctgccctactcagtgcgatgtgcacagtaggtgttcaaggtaatgagtaatgcaggccccttggagacatctggccaacacagaaggtatcacattttcaattttgaaaagccaaagtgaatgtcatgtttccatatgttcacaaaaaaaaaatgtattcacacatgttcctggcagtgttttccataacatccaaatgttcatcaatgaatgaatggataaacaaaatgtggtatatccatacaatggaataatactcagccatgtacaggagcaaaaccttgatacctgttacaacagggatgagcctggaaaacacgcaaagtgaaagaagccagacacaaagaactatatataatgtgtggccccatttataggaaatatctggaacaagcagatggatagggaaaggaggtagattcatggttgccaggagctaggggagggcaggaaaggaaaaccaaggcacaggctgccctccatgctctcacttctctacggctgtcacttctggggaccaggacagatccagagacagacgctacccaagggaaggaggaatggggcaacagctagtggacacggggttccttttcgtgtgaagaaaacattgttgaattagactgatggttgcacaaactttgtgaatatacgaaaagccacttaattgtatactttgggtgaattctgtaatatgtgaattatatgtgaacaaaatacagtgtttttagtgaaactaacgtttctcatctgaattagaatatatgtgccagctccatctgtactaaggaaatatcttccagggccggagtgccgtttagaataaagatgtgtccagtgcctgtgtaaaagcacagggctccgcacaggtgtgaacaagacagagcccagcagtgggggaagggcctggtgtggggaatcgattcccattcagggagcataactctgtttcccaacattattacccttttcaatctccatggaggcatttttaactcctggtttttcaggctgcataaagaagaaaaggaatgttctaaggcagagacgctttaaagacatcaccaagattaatgtaaacactggaatccccaaaagcacagcccttgaacacagcatgctggattatgtgtctcctataaaaccgtcctatttccacataggggttcccaaatgccaaggtgtactgggaccagaaggccatcgtgtcctcatctgacctccttcttgccacggcagcccccaacccagccctgggcctcccccctcacagccccatgcccagctggcactccttggcctggaactcctcaacgcctgctgctcagcctccaggggtacagcctctacggccacctcccaaccatctccccagggcgcccctcctctcaaatctgccagcgcctcatctgctcctcttgtcatcggatggagtgccttctccattttgactattttattaacttttccatgtcccgcttcattcccgcaagacctcaagtcagtgtgatagcaaatgtggcttctgcaccagacacgtgccaactgccatccagataccaggccccgggctgccaggatggagactgtcacttcccttggcaagggacccactgccgggtgggcaggtatgtcaccccacctgatacccccaccatgagcgcctatgagaaccagtagcttccccgcctctcagtatcacctactgtgtccaggtaggagaacactgggagccaggggcagattccaaaccatgttgatggcgagcttccacagcacgccacaccttcacataagacaccgtgctcacactacgcttgtcctacagatcattcccgccagctggcattttgcaaatacacaggaaaggcgaatcaccgatgttggtggactctggggtggtgaggaaggggagcagtcccctggtgaacacggggctcgggcacgtggcaggtgttcactatcatggtgccacagcaaagccagggcatggcctggaacccagtccttggggttgtacataccaaatgccagcttccctgggcagtgggcatgtgaagctgcagcccaataccctccgtggtgtctgccggtgacacgtttctctcccttacagggtattaagactcagtggacttctgaaacaatcaccaccctagcctatggcctgtttacagtctttagtttgggacaggccacagcctgatgccaagcatgtggtaaagcagtctcgatgccacctgtcctgaaggctgttccatcgtaagagccctggaggagccgccaccctcaggttggtgcctgtttggaagctcagtgcccacaggcctaagcttgggtgggatgtttctgcagtgtgagcatgttccttaggaaaaacaccaagtgggtcttccgaactagggctagaagggatggccatcaacaagcatctgactgaccccagcctgggtgcctggggctgagacaaaaagggccagtggggagattcccagccaagggcctcctttagagaagacaaggaggtaaaaagatggagaaaaacctcgcagaatccaccctccctaatccgaccccctggatttcctgactttaggcttcctcagatgcctagagtgcgggtccaggcctcagaggctccagggctcactgtgccaggctataagctctctatctgggaagacacagaaagggctatctcaagagtgcagggagagggtggcatccagaaaggaaaggaagaaaagaatgaccccggccacgcagtacctctaagaaactttcctcccaagatgatttgcaccaatgctgaccaaaatctgccacggcctcctatctcaacgggagcttctctatttaaaatttcgcacgctccgtaatgacccttcgagagtgtgccctctgcacgcacttaggttccttgtgaagtcaagttgctccatgtgctcgtgaaaagcatctgaaaactttgattttgccttttagtgtagcaaacagtccacatcgctgacagacagccttctatttgttgttgtggctttatttcaaagccactctaaaagacaaaagttacgttttactcattttgctttttttttgttttggagatggagtctcagtctatcttgctcaggctggagtgtggtggcacaatctcggctcactgcagcctccgcctcccgggttcaagagattctcccgtctcagcctcccatgtagttgggactacaggcgtgcgccaccacacctggctaattttttttgtatttttagtagagacagggttttaccatgttggccaggctggtcttgaattcctgacctcaggtgatccacccgcctcagcctcccaaagtgctgggattacaggcatgagccaccacgcctagcctcattatgcattttctacaacaaattaaaaaggcccaactgattgaaatgatagttttgtaaaagcactttttctcaggctaggcttttgtaatccaagcctcagcctagagccaacgtgcacagacaggtctcaggaccctccaaaaacagcctcacatgaaaccacgagcagccaggctccagcactgtcactgacccagctggcggggcacacgctggagcgaaacatagtctatcgattccagccatgggctgttagcactgggcctgatgtccagccgtgtagatttggtgggagggagcttgaggcactggtaacttataagccagaaagagaaacagaggcagtgtttggttcttgttcctatttttccaggacaacagagtgatctatttcacctcctctttggtgctgaaagaaccacgcacttctgtttcaggtcctctaccgacatgtttgtgctgatgtctcccttggtcttcagagtttaacctgtgggagttgtggctggagtgatctgtgatatttaattttacatgttattatccccgctttattctgcacttcaggtgatcacacttattttgttctaaatggtctgctgctcttctcccacagtcccacaccatctcctggacccactccaagctgttttcagaagcacgtcctactcaatcagaaactcaaaagtccggagtgtgatcccgctctacccccgactctcctccctgcagcaccgagaaggaccatcgcaaggtgggtgaggagcgggaccagaggacccacctactcagggggcttaacaggaagagggccgggcccgcctctgccatcctcaacccaacaattaccaagtgaaatccagatgacccttttgtcctttggggaagatgaatggccgtcccctgtctgctacattttgtcaggtttggtgctgaagagtcaataccttcaccttgacatggaaactttgtgatttatcagctcatttctcctcctgggttagcgtggccccgatgagagcagccaatcggggtgcagggtgcagacttggtcacagccacttggaaaacgaccaaagccccctcggatgacagacaaatgtgtcttgttagcaatagcccaaaagcgcttgacttgtactaataacaaaaaggccatgctggtcaccgtgggtctaaagacgaagcaccctgtcaccagcctggttgggaaattagcaaataatgttcttttccttgataaatgggtgacagctccctctcaccaatcatttttaacatgttgatgcatgcctatgatcccactggaggagcagaaaagtttactggccctcaattttcagatgatgaatggaactctctaaatgtgcgatttctgtatgaggtatagttcattttaagcaattctagtaaatgggtgtcactgattaggacaaatagtctacttgtgcaatagcacaaacggtgtgtctcattctcctggcctccttggagacaggaaagagaggggacagcagtgaccctggaagccctcccggccccactcttcaaagggccgtgttatcgaatctcaccccagcacccacttagcatgctggcagattaactgatcatggtttgggttgatgctgtgccgtagcagtggggaggacagcggtgggagcctgccctccctcccttcctttgtggctctgcctaaggggccctgaggacccttgaaatgaccccagtgatggcagtgggcctcactcccaggggaaggggctgaggcacagatgcacgccaccccacttggtacgaaaaaaaaagtcaccctttgccatccatatttaaacaaaggacaaaaactaaagtggcgtcaggagaagttgtgttgttggagtcacgcattatcttgtgattatcccgattctgggcaggtccagagtcagcctgagctgaacacacagacccaagctattctctgatagaaccaacctgatagaaaagcaaaggtgcctggagggtgtctattcttggggggttcactggggatcatgggggggacacagacatccttggacaccattgactggtaggtttgaagcaggacagccagtgtggctgcaggagggcccactgcagacaggaacgaacagtcagccacggggggcccctggccacaccacgggatgatgagagtcactgacagaattgagccaaagattccccaaactccaggacccatgaggaaagcatgtggtttacatggaaggaaggcattagcattgagttgagcatagtaaaaatagtatgatttgtgggcggcaattaagcatcatttgctctgtgcatccaagtaatttgtttgaggagcaccggcctgggagacagcaagctggggctggcgtggtcgaagggcacagtcgactccgcagtgctgacgggaccgcctctcaatgcacacaaaagatctttaacacacttaagaaccatgagtgctttcacaaggggagtgaagtgggactaaattgtggacacccgccaggagacacgggagaaaccctcacccagggccaggacagccctggaggacacagcgtcgccccttgacacactgccagttttaaggcacattatgactttaaaagaaagaagaaggaaagtaaaccataaatactgtatcagaaagaacagaaactgttagcaattactggttgagtaacgatttcataagcctgaagctgaatgaacgtccttgtgcagaaaataatcacttttatgttcccatctagtaactgcatcccagggctgggagcggtccaggtattccgccgtcaagagctccctgtgtccacttcggatgtggttgctatcgactgccaatatcttgtttagtaactgggttcagtctgtcgcagacaacatgttgactcccagtaatttgtggtaatttctttaatcgagcaaaagaaatctctaaaaggagggtgggtcaatcaaccatccgggtgcaagaaaccaagagtaagaacacccgacccagccacgtccccagggtcccatgaatgatgctggaagtcaagccacctctcccaaccggcctcagtgcttttgtttaataggaaaccattctgccaaatggacactgttggaaaacagtaacacacgcatttgtgccatgatgcttcacacttgaaaacatgtctatgaaagtagtttcctcagtaacataatttcaattagatgcatacaaattccaatctgtcttaatcaaataacactgtaatgcttatattctaattaaaaaataatttcttttattactcttaaccatttgatgcgtttctacgggtgaaattataaatgcgaaactgcccaatttgtgtatactgcgagtttctcaggtaggacattctgggactattttaattactattaaacaagcaaatggcacactgttagacaaatattaaaacaagcattgcactcagttattaatttgcactatttacttttaaatgcagcaaatatctcattaatttaattttaggtgcccaccagtttatattgcattttacagtctagaaggcaatttactattaactggcaattacatacagagtgattgttaattctgctcctaagtgctagccgcttgaaaattgttctctctctctaatttctgaccttcttacaacagggtgaggcacatgggaatacaaagaaccagtatggaagcgctggacatgtcatttgtgactcattcttttaattcaccgtgctaatcaactgaaccgccacagcctcccaaggtaattgtgtctttataggagttgaaagcagcaggcaaaagggcctggatggatggggcctggcctgccttccccttcccactcggggttgactaatagggtctggttcagaaaaatctggtgtttctcagatcactgtaaacagatcattgaggccctttgcaaagcccctcccagcctctggcgggcggcccctcctctgagcacaggttcattagccctccgcctggcggccccagccggcctcacgtggggaaggttaaatgtgagggtgtcccggcagcctccggggctgggggacactgatgggaaccagacgcccaggggacggtgcctacgtcgtgacatgcaaaggggctggctcagttttcagcgggggagtgcaattcccggtgattacctcattgtccccatcaattttggggcaatgcaaatcagacagaagcttccaggtcagacaggtcatgaccctacctttcctctgctccccagcctgtagagcctgtatcccttacatcacctttgaaatggatattcctgttaatgactggggtgtgggggagccaataggttaacctccagccaggaaaggctgggctgtggcaagcatcaccaaacacccactcatgggagcatgtctcgatggaggaaatccctgaagcttcgggcagccaggaccctgagcttgtgcctgagaagcccagtcagccccagagtgggcacaatatgggctgcagatatagaaggtgggcacttggacaggctgggtgggggctggaactaaggggtccactggtcccttagtaggaggatatgagacctggagaggatatccctggccaaggaaggcatcctacctggctggagggcaacaggaacaggctacagacaggagagagctgccccctccctgcaccagccccagagcagcaaaagcagggcccggccatgctgggaattggggggacgctgacatcacaggctccgccacaccatgtgatacctgccagccagtgacaggcagctcctcccaccctacacatccgcaactgtctccaaatgcacagcccaaggcctttctctgcagcactggggacagaatccccaggagacagcaggcaaagtgcaaagaaaggactggacctttcagcaatcttctttcttaaaaaagtctcatttctaacaatagctgtgcagacttccccaccaaaaagcccacatatgcaaagatctgaactcatgaaaggatccactgaaggcatccactaaagcattcatccgggatgggctgacagtccagtgtaagaacagggggcttattcatccatttttgtgcagaggaagtcagtcttgccacatgcaaacacatgtcactttcatgtcacaaaccaggaccccgcagcagacacaggcacctacacaggagcccacccctgccatgtgcccgccgaagctcaggtgctgctccatggctcacaagcaataatcaacacccgctttcctaaggagctcaggactcgagcagagtcccacagaacccagccgaagttcaccctcagtgactttccacaggaaggaccatttatggagtgcctgccatgtgttagacactgtacataagtcatccccgatccttgccaaaaccttgccagatagagcagaggagaaattgggaccacaggagtaagcatatgcccaggtcccagtctgtctgcaaacaccaggtctttgcacggggcctacagcctctacagccagatgtgccaagggactcaggggcatgtggtacacataccaacagtttgcacaggaggcatgtggaaatgtgcaccgtgtggcttcagcacacaccggcaaggtgccagaaaggaccccccagcccacggtgggattctgacatctcgcctttcccaggtacctggggcctacagatgctgcactttgttgcacagcaaaagttcttaattgttgaagtgtatataagtgtttaaaaggttccccaattttttgaaccccattgtgacatgtctttatttttttaaaacactgggattccaaaacctagaggagcagccctctctccatctcagagtcttacatggaagccaagaggtgtccggacatcagctctttgctatgcccacctcccctgtggtcttctggcagctcctgagcgcctggtcctgtgtgtgctggtcccacagaaggtggcccctagtgtggggcaggcactgcctctcccatcctaaccacatggagagtgctgagctgtcgactggacacctctgggacagcagccctggcctgccaccaagacccatccaggcacaccctggggtgacgctgggcctgatgtacagtgggcagcggcaggatttatatcttgcctttcttgctcactccgtccttcctaagaagggaagaggctgaaggacgtctattgcctctttaaaccttctgaaagcagagggggcttagcatcctccatgtcacccgctctctggacagaggagaggactgtgtcccattgggcgtccttcaggtggtgatggcaggagttgaagccccatcctctagtccaggttcctgctgtggtcctcatggccaccccaggacaccaggccacagtcacccagccactgcacatgcaggtcaagcccacagatagtaagtattcatcttgctcactgtcactcggttccagcaggcactgtccatcattaaaaacatctctcaaatgtcacagcctttggagttggctaagattagaaatcaaaatgcaaacatgccttaagttgaagtgagttgtttgttttgagatagggtcttgctttgtcacccaggctgaagtccagtagctcaatcaaggttcactgcagccttgacctcccgggctcaggtgatcctcccacctcaccatcctgagtagctaggaccacaggcatacaccaccatgccccactaatttttaaatttttgtagagacagggttttgccctgttgcccaggctggtcttgaactcctgcactcaagtgattctcctgcctttcaaagtgttgggatcacaggtgtgagccaacatgcccagccaatttgaagtttagttacggcatttctcaacagcaatcccgaacaagtggggctaattcagcccttgagtggacaaagcattgtatagaacaactgtaagatagcaagcatgtgtaactgcataggccacacttcctgctgacaggagtctgtcccgcaccctcaaagaatacggatctcctttaggaagcagcgtcatgcagggttcaagaccccaggctggagcaagaaagaccaggcttacatgggccttgcatttacccggggtgtggcccgggcactgacttcatcacctctctgagcctcggcctgtgcaggagaacagcagtgacaccacggggaagaggcatagagaccggtggacacacggcccctagccccacatggagccaggcatgtgggcagctgccgcagtggtagctgggtggctgttgttcctaatgactccccctgccactttgtttacaggtgagaagccccacaaagggagagaggtaccgaaggtcacacagccacgggggctgccccatccacggcttcatacgccatctcaaacaaagatgtggaaactgcatatccagctaaacccacaggccaagggggctttgtctgtctttccacagacccctgccctctctgtacagtcctcccgtgccctcatgagcacctcctggtggggaggaggcctctaccgctttcccgcagaagctggagctgtgaactcaccggtgtagacaaagcgcccaggagcacctttgcagaactgcttggatttgtaggagagggtcacttcgacgacgccaggaatgtgcctcggcggggtctggactcggatggcatggggagttatcagctacaaaaaccacacggtgaacaggcgctcagcggcgctggctatgagaggcggacacttgccagttggatataattaccaaaatgagcacaaattggaccatcgtcttggaatgccccctcctagctgtcacccagagtcccgggacctacagtgttttttaagaaaaatatctgcaaatgatcccaggttttagtttgcaggaaaggccacagggcatcattcatatgaaaattgccaccatatgtctccttaaacctgcttctcgtaattctagcactaattgttccagtggacgggggacctcgatggcaggttttaaaccccagggctgcagggcaggggggtgttccgtagccacccacgggagaagctgctgccacaggcgaacagtgcagtgtgttaaaaggggaatttgccatagggcaccttgtgtcaatacactattgacagcttgtcaaatccattcatgaagacagcaacagcgcgaagctgaccgagtccgcgggcttacctcgctccacaccaacatagttccgaatacaacttgcagcccgtcaaagaagttgtcgccaattatgatgacggtggcaccccccgtggtccagccttcactgggactgatggccttgatgcacggagtggctgctcacacaagacagagaaggcagaccttagagccccgtcctcctccgacgctgggccgctcggccaccgcgcgtcccgcggccaccgcgggaggagaggcgcgccgttcctccaggcggcacgcaaagggcaaccgtagatcagcatgttgatgtgtttaaagcaaactattaaatgttttataaaggaaaggccgagctgcggaatactagtgagcgagaaaaaaatggcttgatatagcaaattatgtgtcagcgcaaatatgactattacaaatgattaagcattgcatgcatgtggcatgtcgatttatctgctttgctgtacagatctaagcagagtcaatcaaaaggttgttgaaggagatggaagagcaaatgccttgcatttcgattcctcataagcagctaattgggttgggttttttcatccgcgaactttgccttttagttcaaaacttcattttcctctgtcactccacaattactacttttcacttttcatcaggaaaaaaaatcaaaggcactatattaatacttttgtcaaaggtacacattttacatctaatattgtttgtcgacagggatccccgcgccgctggcgtgacctctctttgtctcgggagctctcgcatttgcatgagttattacaatggtgctgctgcaccggccgcagaggcagccctgctggggcgggaggggttgggggcacacagacagcagaaggagggtgcaggggggaggggaccaagaggccacagcccagggagacaggcaggcaggagtcccagcacggtgccctcggcagccttgagcaggaggccagggccggggctgagggctgcaggcctggtggaggccggctttgatcagcccttcctttacatggtgttggcagaccttttaaactgcctttgatggcctcttgtacatgggctcccatgcaaaggaggggttgtttgcatgcctgcccacgcctgccaaagcctcggagcctgtcacctgcagggcttccgcagcccgggccaggacactatcctcaggaccctcagactactctaccctttaggtgagctgggaggttacctttggtgcacaaggaagaatgggccatgtaggcctctgtaatggttgccaggtggcctcttcgatgtacaggtctccttgctgatgtttggacacaattacaccctaaatggcgggaggcccaggcctcagtcctccaagagaagaggaagcctctacactaagccctgggacacccagaggtggcatcccttctttgtcctgccttagcatttgggggtgttgggggttaaagatgaaccctagaataagggactcaaccctgaggcccgaggagtacccttgctgttttggtgcccttccgtcgctcacagcaacctcgagggctactggcccaaaaatgtagtaactaagcttggtaaacaattagtggcttaaccaagccacccgccccccaccaccccgccagctcctggctttgctcccccacggctctccagctgcagacaagagccctccaaaggacatcttggggccttattaggttgttcatcttatttgagcccctgtgcagctcggcttcagataaatcatctttttagactctgggtcagatccggttgcacatcttcataagcgggagttttccggaagcccgcgtgccgtggtttccctgacaggtcagaggcagcgccgtgcagacactgtctagttaatcaccattagctattgttgtttagcacaccgccgacatgccaccttcctttgtttgctttaatgttggactagcgggggttatatttgctcattccacgcgcatctccctccgcagcagaggcgcagagcacacactgggaacctgcccttaactagcgctgttgacttcatgctaataagttcatacaaattttcatttctgaggcttccgaatgacatttgcttttcttaattgcatggagagcatttgaaaaggatcagctctctaaagactgacaagtctcctccaagggggtgaccttcatcagcacagccaattatggcaaataattcacaaaaaaaaaaaattacagtaaacaaatttactttggaggtgagaaaagaaaaaaagaatccaggatctactgcatgcacaagagactgctatctggcagctgtggcccagtggaaagccacatcatctcggaatttgtagtgcttctcagcggaaagaaaacacgggcctgccttggcctcctccacagtgatagccatcttccttctgcctgtatttgcatacatttcagtgcacatatagagagggaacatgtgttcaatgggaaccatagcaaaatgaattacacagacagcgttagagatctaatgatatacgcgcacaatacactcaagcagatgacaggagctgggcccggcagctgaagatggcagaggaggagcagggaagcagtggggacagggagcccccacactccccatctctttcccggcctggccctgtgatgggaggcatccctgaagacagatcctggtctgcagctttcagcgtggcccaccctcctggggccccgagctgccagggtccagagaaaggaggcgtggcgagtctcccctgcggatctgacatgcgccaccatgacctgtttttaactctgaggatcctctcagctacttgggagaagaggcgctcacaaggaacaccctctgcccatcgtgacccccgccggctctccccagggcctgcggggactggcttatcctgtggccagggagcccaatggctgggatgagcatgtcaaaacgggagcgtgactcaacttggaaacccgtgttggagacccatatctttgggtttttttcctttcttttggggtctctccaccctatccagtattctattagtaaacagcttccccagcctggtcccattaatcagccctcctgagtaatatcacagcatttgtcaccttcctctgcattcacaatattgaggcactcaaacaggcctaatcttgcctcatgaagacttctttgttctgcctgctaaaatgtcttgtaattgtgcttgggatgtccagatggctggctgatactccagctgataggattatacctttacctctcctagggccatctgttcgctttaactcgctaaagccccgcagcctggattcagttgtccttattgcataaacctaaccgcattacggcacttggcatgcaaatcgcttctgtgctgcaggccgggtgctgggcagggctcgcggaaggtttaaacagggttggagtcgtttacgaggggacaagtgacaaggaaaaaaaattaaagcctgagttctactgtgttgtgctgaaagggagaatggttgttttccctcacttgtgttcaatactgtaaataatctgccttgctttttgtgagctcaaaggacgccgtggcagacatccacagcagcagcagggggaattcgtttacttggaaaccatcagcgactgtgtacacactgctggtgaatattagatgattggataatgaggtgttagctaggagaggctgcacgcaagcacagatctgcggttttggggggcactttccttaaaggatgtgggactgatgtagagccagcctcccacccctgcaatctgtcctgagcaggcagaaggagggaaggggtttgggggacaaatatgcgcagacttaaaaggaacttcctaagtgtcaactctctcaggaagtgacagaagcataagccctgccatttttttctagggcacttgataactgggtattaattacaaaaaaataaataaccctactatttatgacaaatgcctttttcttaacgatctgtctatgctagtcctcagagtcaccctattggcatttttaaattagtagtcactttctagggtgggacaagatatttcaatctcttgcaaggaactgacttggtttaaatgtcgagaaacaaacaggaaaaaatcctgagcaagactgcttctgcaaatagcttttgattagttgggttttatctccaaggtacccactagtggcctttatttctctaaacgctacattttctgcttacagtcaaatgctttttcatgctacttacaaaaataaatacttgtactttgctcagatcataatagctcattagaggaggctgattttggacctagactacaacctaacaccagagggctggggaggccccttgaacctattgcgtgaaagctccactctctagggaagcgaggaactgaggaccggggattcaaccttcttaattgtgaacctcattagtgacggttgctaagcaaaacacacacctaccttcagtgcatgggaaggagataaacaatacgtcacaggctctaatgacatcggtgcttagggcgacctttaattattatatttttgttctcttataccttagtcattaatgtagaaaaacaaattagtttatttttgtggaccacagcagattcataaattgtcttccagtttttgtctgaattatatttcacgctgataatctgcacacgcttcattcattttcctgtgcgtgcatctgtctgcctcgtgtgtggctctcgaatgtgggacctcgggatagaggatttgtcttaaaaccatttagttttacaggctctttgctctaaaggattcgatcatgctgttttgtttgcaattcacttaaaaaaacactcacattactttctccacaattcatattggtcagaatctcgtaattattatgaaatgtttaatgggggaagtggctcttattctaaaggggatgtgttcaattgtgggtgctgtgcagagcacaaagtgggatgtgcctgaggggctcggcgcaaggcccactgtgtctgagtctttctgcattccgacctgatatccaagaacctttctccctacctaccacccttatggaaacccttctcttttaacaaacaaaataagaagtcaatcaattgaaagcatttggttaaaaaaaaaaacgtatgctggttggtatttcaccccctcctccttgcccccactcttgtgtgaacacgcacatacacgtggatcacatgcacacgcactccagccagggacaggaaatggtcctgtcccttcggagctgactggaccaggatgtaaccacccactgggcctgcacgaggtatctgggtatgagcttctggatgggcgcttccgacaaaccaaaataaaaccaaataaattaaaatcgcaagaaaagcagtaagcaaaagaacgcctggaaacatgaaggccgtggcaggtgaatgggaaagtcccgctgttcaataaaggagaagagaaagcctaggagggctgtctccccttccacctcggggacaccccctcatcctgccttggtgcaggaggtctgaccaagggcgggggcctggtgagagtaactccacatgaatgaacataaaggatggtgcaaagaaaaagaagcatcgcaaataaaaaaagacatgtaacatgtgcctaccattttccagataagaaggggccgtaccttctgacgggtctaggcggcgggcccgcctcccgtgtttggaattgttgtgcacaaacatgttgtctgacacggccagcacgtggccgtccacgttgactgttgtcgatacaacaacctgcaaagatgaagtggatttgaaaatggaattggcaaagaaaagcagagccccctgttaggcaaaatacaagccatcttaaatactgcagagcacaaggaaatttcacgtgttcctggacactgttgatcgatgtgcgttcacagcttttttggctaatgggggtgggtgggttgttttgtttgttttgttttgactcaagattgcttctcttcaaaacctgctccactaattacagtttaatctcctattatgctaacaagtgaattcaattcagagaaatattcttctagccattagcttcagaaacacccctctagccactcattttaaagccgctgttttgattgatctgttcacatattgattagaaagtttatctaattaaaatgagttcacttgagactggcctcccttgaagagctgggaggattcagagttgcccaaaaaaggcttcataaatcaggaacattcctactgcccacattttatcaggaaacgatccctgggtcaattttacaattacatttaatgtctggtaatgaactttttttcatctgaaaagactgagttgaatatgaatagtgggagtgttttcaatcctggaaaggtattctttctcaagttcattgcaaaggctggcaaggaccctggtatgccaagggaatgtcctctctgttgcggtgagaggcttccattcttaggtccaggcacaaaggatgtcgaggggagagatcacagatcaggccctcttaagccctcagctgcctcgtggtagagggagaaacgaaaagggccaggcagggatggccttgcagactccatagacctgcccaggggagcttgccacaaacatccagaaatggcatccctgaatggacccaggaaccaggaaatgacaacctggccctgagctttctttaacagaggtggtgcattcatcccggactagctggagctgcaaagatctgaggccaggtttcatctgggtcttgcagaagcactcctggagcttcagcccagctctgacctgaaggaagggtggctctctgccacagtttgggcacactcggccatgtctttgagtcagcaccacccgagggaaccacagccctacagagaattgtgcggtggttgcacgtgagtggagaagcggaaggggttcccagtcagggtacaccttccctgcaaggcccagacaaagcacgccatgcaaaatgagcttaaaagccaaggccaccataggccttagtgaatcgcgacacatcagtgttgggtccgcacatgtaaggaatcccctgcaccagcataatcggggaaaccagggggaggggcgcacgggggtacacgggcgatctctgtactttctgcgaaattgtttttaaacctaaacttctctaagaaaaataaagcctattaataaaataattaaactagttacctaatacaaaatgaatacaattcattgtattcaatgagtcactgaatataaaataattaaacatacaaataagtagtattttcaggggtttaacaaagaagccaaagcttatgtttatatatgaatacatgtgcaagtgatggcttcttctttttttttttttttttttttttttttgagatggagtctcgctctgttgcccaggctggagtgcagtggcacgatctcagctcaccccaacctccgcctcctgggttcaagccattctccttcctcagcctccctagtagctgggattacaagcactgccactgcacctggctaattttttggcatttgtagtagagatggggtttcatcatgttggccaggctggtctcaaactcctgaccttgtgatccacccgcctcagcctctcaaagtgctgggatgaccggcgtgagccaccgcgcccggccggctttttcgttttaaatctcagactccacaagatgatgatgcagcaggggcggtacacacgcatcccacccaaatgccctcatcgggggcagcttccctggcatttcttccccttggccactgccaggattgttgaggtcgcaacagtgtcaagccacccagaacctcaaaaggttataagtgctggcccagcatcccaggtccagccttgggtatctcagcaccctccttttttgaccactgcccactggctttgccctttgcagccctggtgggaggtggctttgctgcccctttggtaccacgagtgggcctggcagcctctgcctggaggagccaaggcctgttcctggtcacccaggtgccccccttgtgttctacctcccaggcccagccctgggcattgaagacactctacaaatgcattatctgaatatgatgcaaagatgcgtaactaacactgaggtgcagacttaaccctttttacgttcctaaacatgataggttaaagaaacatgaaaaagtaaaaacaaatttaaaaagtttttaaagacacaggctttgcagtcatctacatataggtcagccacgaagggtaaagagtgtagttcagcagagagagcaggcaagctgtgctctgtgtctcacctgggctgtagcacctacagaaagctgctgagattgtgaaagcagctgaaactattgtgtaagcactgccatcctcctaggtcagttacaccttctgagaggcatggggctcagctaaagagaccagaggaagttctagtaactacggggtctgcagtcaaccacgagatcacctgtaactgacgctgtgttcagtcattggtgagacaaagaggacacagcccctcagccctgcctgacttccattctgcttagaaggatcaatatcaccagtatcctgtgaagcctagtgcgtgacaaatggaagcagacccaactgttcgcaggaaacactgtccccagctgcagacatgactgtgggcgggcccaaagagcccgcctcctctgaccagctgaccgggcaggcatggagacagatgtcacgtgattcactaaaggactgaggcataagttaaatttctgagaaatgctttgagctatttgatggaaaaactgggtaaatcccaaacaggaatcattctgctcttgggtcattcatccaagctagtggtcatttccattagccgccaaattcttctctggctggttttgtattctagcccagactatttttacaattaaaattagcaaaatcatccaatgtgtttaccctgaattagcttcctaatcattcacaaaaaaggcaagaaaaatatgaatctatcataatggtacataaatctatcataattcatccctgaaccccccccccccccccacccagctacccctctgtatccgtcttttggataaaatcttctgaggcaaaccagagacaggacttagcctgagtttaggaacagatgcaactagcatggaaagtgggcaataagaacacagtaaacctcgggggaaggaagccgaggccaggaagagactctggcagttgcagaggtctgtactaagcaggtgcagatccctctatgaggaggatctcagatctggagtattcccaaaaggttgcattatagttctcctcccactgaaaatcaatccctcaatcaatcccaaaagaagcacttctgggctgggcacggtggctcacgcctgtaatcccagcactttcagaggccaaggcaggcggattacttgaggtcaggagcttgagaccagcctggaaaacatattgaaaccccatctctactaaaaatactgggtgtggtggtgtgcgcctgtaatcccagctactcaggaggctgaggcaggagaatcccttgaacctgggaggcggaggttgtagtgagccaagatcgcaccactgcactctagcctgggatacagagcaagactctgtctccaaaaaaaaaaaaaaaaaaaaagcttccacatggccatgttttcaaagctaagttcgctgttcgctatattgtgcccacattagacttgatgaatctggcatactgaatataccagatcattcttaaagcattttatttgcatatttttatcaaatgcaccaattccagtttgcttccaagcccttaaagaactcaagattacttcctgaacagttgcaaatcagagaattcaaatttggtatgaaaagtcaggaccacggtccacgtgtctttgagaaatgtatacctggaatctccgcatatctcgagggttgcctgcattcttcaaacagttctgattgcacttgaggaaaaactttagaaagaatctataaaaaatacaaaaagatgatatttattagggttatcagacaaaagactcaaactttttaaaagacactcttgcgcagggaggagtggagactcaaccccacagcttccacacttccctctagggggcgacattgagaagaggctctgggagaggcggcgaggaggcacccagaaatagccacacaggagagcagtgagttgcatttgccttgacgctgtgggtgtccaagctttatgataatagctgcgactttcgcattggcatttcttggctcaatctttgcacaactgcccattaaccatgggggaaacattcagcccagacaggcctaccatctcaacccactaaaaatgaaggatgcctagttaaatttgaattttggataaacaaaaaataatgtcccaaagcatactcctcactaaaaaattgctgttgacctgaaatggaaatttcactggatgtgccatatcttatctggcaaccctaattccagaggctaccactgcctaagcaaacacacttttaaatatgggttttaagagttacagtagcgcctgtaatcccagcactttgggaggctgaggtgggcagatgacttgaggtcaggagttcgagacaagcctggccaacatggtgaaaccccatctctactaaaaatacaaaaatcagccaggtgcggtggcatgtgcctataatcccagctactcgggaggctgaggcaggagaatcgcttgaacccaggaggttcagtgagccgagatcgtgccagtgcactccagcctggttgacagctcaaggctctgtctcaaaaaaaaaaaaaaaaaaaaaagagttacagtaggtacagctcttaaaaagcaattggggggtggggcaggagaatcacttgaacccaggaggtggaggttgcagtgagcggagattgcaccactgcactccagcctgggcaacacagtgaaaatcggtctcaaaaaaaaaaaaaaaaaaaaaaatctaagaactgattgggaggcatattgttttaaccaagaattcttgaggcggtaatgaaactgttgctgaggcagaaagcaaggaacagcactctgcagggctggggaggtgaggccgaagcgagtgctatttccatttcccgccatgccttgcccttatgtttcatggcatgaagattcaggggtcctgacagtgtgttgagatgctgtgactaaaacgtcatcatgttgtcctccgcattcctgcatgctcagtgacattgcaggagagctggcttccagtctgaactcaaagaacctgggaagccaggctctaccactacccacaggaaaagtgggtgggggggtttctccctgtataacctctgcctcaacttgaaaaggccacaaccaagaggtcccagagcttgggtctgtgctgaaacacccactctctgcacgtggccaagcatcctgtccagcaaggtcatcaacacaaacctttctctacttcctcccaaaatatcatctgtcctacttggtgattattaatttttgatgaagtttcacatgattttcttacgttcaaggttcctcgctggcaattagaatatcagaaaatgaaaacactcaacggaccaagactcatctaagtgcccccccagcatatcctggatgacttcttactgtggcagaagaaaatccaattgatgggggaaagagtggtggccacttaattaaattttcctgcataccatgaggcctcaccattttaggccagaatttacatcttttattaactcacctcacctatacacttagctcacaatgcctcttcacaccatctgccatcagcatacagtaagtcacttgatattccacccaccaatttttcctaacaaccactgtgcaattaaactccacacgttccgcagcgaggtaaatgaggcgcacctgcggccacactgcatttgaactgcatcagaaagggcctaacaaggtgagggcgccaccaagttatcgtcctgtcaggcaattaggttttcacttcggggacagcaacacggtgcaattacaccacacattaccacccagctaatcttcggagcaggcgccggcccgagaagctgctcatctgcaaatgtacctgcacggagccatctccaggagctttgtttgtgatttgagagatttctccccagctccagaggaggtttctttaaatttcttgatgtcttttagacagtcacccttttacctccaagagaacagagcgagttttgatgataccctaactagccctcactcggcactgtcatgaagagctgggtttggcattcttaggccttcactgtcatcctctgcagaaatcagcaggacaaagtcgggtgctggaccccagaaacatactgagcatacccagggtcaagtcaagcaggtgcagatacacacctatgcacacatacacacatgccacccacacatacacacacatgcccacacatacatacacacacatgcccacagacacacatgcccacatgcccacacttgcatacacacacatgcctacacatgcatacacaaatgcatgcacacatgcagacacacacgcgcatacacatacacatgcagacacatgcacacatacgcacatacatatgcacacacacatacatatgcacacacacacatgcattcttgcttgctcactccctctctttattttctatgtggcaatgatagtttctgcttctatccaaactgcctaaagagcagtgcaagtacttgagaaagagctgtcgtgcacaaccctagagaccaggatcctttctgagcacacaggtcccagtgacacaaataaagtaagctcaacagtcaagtggctccatgccaggttcttggggcatctacagggacggacagaggggaagcctcagcagagagaaagaagagctctgcgcttacctcttaccctagttttggtcatgtctgagttggggattcaattaagcctttgcaaggtggctggcaccgtacagcaggtgtgtgactctgatattgtgcagagttacacacggagcaaatgtatgctttcacgaggaggtgctcagtgagccacacgatttcagtgtttggggagggggtgagaaaattgaatgcccaacatgtgaagtcaaaaggtaattctcatcctttactcaattaccctttaattggctttttcctaagaaatatctgacaaccactttacatatctcacttctagagtctggtacacaaagaatttaatactcttgttatgaaaggaaaaatctttcctatgtcagaaaatctttggctttagcaccaataaactctttattactgcaaaacatggatttgctgctccatcacgaagaggcgataaaaattctaacctgtcattagtacattatgcttaattgtgtacagtgtgtctctcgttgcatctgttggcccgtcatcaaaatgaccattatgtgcactaattccctgaccctgtctttatttccctaaagagtcatcatctttcacagtaggtaccagagtaaatcaagcttgaaatatgggctttatttacttgtttctcccaggcagaggggaagacagcagctcgagataaactgctacacgccaggcgcggctttcccagccccattccactcggaaacagcccacagaatcctgggaagttctcaggaaccagcagaagggggaaaggtgtgatcttattacttttgaaatgaggtttcctctttcgcggtgcacagggactaggacagggaaccatatgggcaacctcattcattcttgggagggctggttccaggaggctgagttgtgggaggttccctctactaactcatgagggtcctgtgaagatggaccaaggggcacagtcgggccctgtgccggggaggacaggggtggaggggcagctgggtgccactccggatatcttgagtttaatctagaaatcccgaggccctcatttctgctgggacaatgactcatctgctctaaatagagttgtggccaccactgcacccaaggaagaaagagtttggtcttggttgtgtttgtttcagagtcccaacaaaaaactccagtgccagcataagcgtggagcagcagaatgaggacaccttaaactgggctaaaacaaataatgggatcaaccgttttaactggagcccaatctaggtatcacacaagaaaggggcaagcccccaccgcagtgactaatttcaaagtctgctctatttctgtgtgtttaagctatgaattagttcatttatatttacttttatgaagctgattaaccagagcttctctatctgatgaaaatcattttaattgtagtgttaggctcctgtgtaatatccattacattatgaactgtttaaattctacatgggtattgtgtaaattggccctttgtgagctagcaggcaattaggaccaaacagctctcctttaaacggctacagaactttgtggtgttgttcaggacaatcagaaacaaaggaggctgtttaattgtaatttaatggaatatcaaggagtccgtggcattagatgctggcaacagagagcaggagagaaaaattaactgcaattatgtttgattaaagctatccttctcaataatcagcggtcctgacaggccatggggctctagtgggttccaggatggcaaaaggtgttgagcaatattagggccaataaaggggatattagcatagctaattacagccctgcaaaacctgtaaagggggcctctgtgtattgtaatgtgtgaaataattggccaaggccgttatcaattacataaggaatgaatttggtttgtcagagaaaagctgatgagatgcacttcatctgacaccatccctaccctcatgtttccatgtagctaagaacgtatccacttttatcaaaagctgcaacttaccactggccaaaccactgataaaattatcttgccagcaagtgttgggtaattaatacagcccatcctcaccgccttccctgccgctgttgttctcacctaactgaagccactaatcatgcaatgatgatttctttccctctggtcaaaggagaaatagattgtctccttagaaatgcagtgggcttggcggtcgcaccctggtgattgaagagaaaaaggaaactttgaactgttctaatggcttgctttttgcatgtggctatcacttgtttgaaattacctacttctcagcatctcaggaaccctgtacaggattttttctttaatcatcaagtttcagactgttccagggcttggtttctccagcgcttgaaaacgtgagtcactgtacactggaaggtgtgacactgactggccccctgaaaagacgcctcatcaaaccgagctgtgactcctaggtgcgcgcctacccccacgcagggttaagtggccacgctgcaaggaaagagctctggctcttagcacagcctcccgtgcctgggttccagcctcggtcctagaaggacaacccccttttgcggccctcaatgatgggtaatgtgggaaatcagagtcaagaataaaaaatgttggtatcttttattgtgggggatggggggaacctgcttttgagttttaaggcagagagctcttaataagcagcaaactcatacaacagtggatgggcctgcaggccatccatcaaaaacccaaagtgttcgtgtgtgaatcatggaggtgacagcttccagaggttcctgggggctgcagagagccctattccggatcgagcccccatgttttcagttactactgttttaatacgtaataaccttgacaaggaaaaatgagtactgaaaaccagccagaaaacacagttttaaaagtcaccgttcactggtggttgctggggtgggggaggggaggatggggaacagctgcttcgtgggtacagggtttcctcttgtgggggtaacggggacatttggaactagatggtggtgatggttgcacaaccttgtgagtgcactaaatgccacagaactgttcactttaaaatggttaatttcatgttatgccaacatcacttcagcgaacaaaaaacgtcctgccccgaaggagaacacaagagtggggcacgtgatccgaggccctcatgggggccggtggctgcagcctttactgtgctattgaaatgaaatagttaagagtcaaattaaaagatagagcctttaagagacttttccctgactgataagagtggccagtggagtgcttcctcgaggtccctgctaattactgggaagtccctgaaagcagtggccacagctgtggtgtgtgcacacccggccatcagtcgctggagtattgattactgagcaattctagccgatcgggttcgggcgcttcagagacaatgtgcttccctcacaaaacctgtaatgagcagttcctatacaagactacattctgctgacatcagatctgtgcactaagatagtacacaggtcaatacgtattggatttccaaaatgcgagggtcttaatgtcaggcctctctttttctctcactcctgccattagctattactgggctcacgttctttaatgccatacgggagaaaaaatctgctccattagtctgatttattcttcaaatatgccatgacaaattgctttaacaccagacttattaaattcttgtacatttcaagttatgggtctcatatacttgtagtgcctgcatgacgtcatagcgaaggggcagagggcggcaagcttgaattttacagctgtgcccagatgtcctttgttgggggctcccctctccaggcgagaggtctggatggctggactccccaactgggagtacctggcctgcacgtgcatgctccccgagcacacacgctatcctgcatgtaaatgtagatgtatgaggatttgaaaatatccacggcttgacttgcagttcaacaacgactggcctttgtctggggattctggctctactgtagccgagcccgtctctagtggactccagctattttacttccctccgctgtagtaaccacaccgcattaacaatatttgtactacaatcgccaagggacccacttcccagattctatcacttctttatctcctgacaaatacctcactatcgaacattattaggtttagaaaattaacccttcacagcctagagccacactaggccccaccgtccctccaaagagccttatcgctaaatttctgctataatggtttttcttttcatcacaatttcagcagcggctgtcaagaggcacttatagataccatgatcttgtacttttgcaatgattctcattaaaatgatgccaaagagatctgatgggatttaatggctttgccggccagttcaatatccccttccagaacagatccccgccaagtcctccgtttggagaaatttgtatgactcgcattaaacttttccgggtggttttaatgtgttcagataagtaaaatccaggtagacactctaaaggcaagtacatcccagagctacaagcttcgtcagccaccccactccgcccgctgtcagtgttctagttagtattttctgcaactgctccggatatttcatgatagttttgataaggttatctgtttcaaagaagtcaactgcacaacacaaaagaaatgtgaagtgcactatatttacactagggttcttgtttcaagtgcctatctttctttcccccctttacctatttctctatttctaatgggcaatgcagcactgacattatttccccagcagatcacgcgccctgtcaatcagtctgtattttgtctttcgctgcgggctcattaaaacagcttcctctctccctctggacactgttctatttgccagctctgatcacgaagctccttatttaagaaaaatgccagcatcacttggctcacaacagacgcacccccctgacttgttgccagctccaggggaggcttttacaggttatgcagagattaagtgcctatgcttatcccaacttagggtttcaagcctctcccaccatacgcgtgtgtgtttttagggatctgaagatcacgggaatgcttctttcgccatcctgattcctgatggctggggaggtcattctcaaaataaatgtgggtgagggggtgttgtttttggttttaattttttttttttttttttttttttttttgcttcccatctccaagtgggaaagatcttgttaatcctttcctcctcggatgtacatttcccccatccacaccagcttgcttaattaagaactatcatctttgtaggctgaattattaataaaaaaatcacattttaaatcaagcctgtgcatgcacggaggacaccagtgttggacctgcctatgcggctctctagccttttaggtcctgattaaaaacttattaaaacattataaatgattaatgggcgcacagctctgagtggcaattattagttttaatgcaggtaatgcagcttaatgaggggcacatgtgtgcaaagccttaacttcattactcctgcgtgtcaacatatacaagagaaatgtgtgtacaggtcatccattactcggaacagcaccgagccctctctcttcacctccctttgttgatgagccaggagccataaattaatcccgttctgtggctcggggaaggaccaaggtgttaaaatctcagtaaaccctgctcggctccccacgccaccaggcagctgtgttggaatatttcacagattatctgttctgcggccctctggtatgtgggaatttttttttccctgggatttttgcaggtcgtcattgtctctgctcagaaacaagagctcccgacattcagagctgactgggtttctttcccttcttgttttaaaaggtctgcaggggagttagctccatcctaccagtgcctaattcacattagcacggttctcctaaatcttcagatgtgattccaatgtctgtccttctaaccgctcctctcctgtcgtgtggggtgcaggagactatgtatgagagacacagagagacgcacacttgagtgcccctggtcaagaaggggttttaacactggaatgcagaaacagaaggaaataccgatcagcgcctggctgcaacatggagatgtcagggtaagcacaggcccggggaagaggctgggtgggggttgtgggcgggggggggggggaggtgaatagatgcatttaggatgctgagagtcgggggcactggcccacaaagaagcccatacaagttgcagccccacctgggaccctcagccctgggcctgcaacagcccacggctggggagcatgccactcggcccaactttgcacgtcacctttcattttctgtttttgtgacaagcagcttgatccagcctgatctccactatctgtttgaagagtattcaggactatttgcatcattttatcgctaatgtataatatatggctctaaagtgagcccaagcgctgtcttgttaccgagcataaaaaagtaagggcaataaagatacattagttctctcaagcacagcggctataatgcaagcaagaaaggttgctgcttacagttaagaggcaacctttctgcctggctaagacaatggaagagtaaagaaaatgtcaaatcaagaaaagctggatttagagatgaggcagcccagaatgacgttggtgccatattttgtggaactataatgctgttggcagcaaagatccgtgtttctgattcatctagggccgcatggcaaagctttgtcagtctgtgcaaggtataaataattcagggtgagagatggcaattacagggccctgcacaaccaaaatgaatattttatgaggactaaaactgctctggaatgaatcatgcacatggagtcacacatggcgagtggtgggttcgcacatgccagccccaagaagagaggcgccgcggccctgatctcctttcagagcgttgactataaacctggcgaatggtaagaggcaaacaaaatcagctaacccgcccccacgctcctcatagatgctcagtccctaaaacgtccagtagggaagcccgggaccatgccatagaaactccttgctgatccatcccaatcggcctcgtggtttgcttatttttctccaattgttcaaactattgatagggtaagctgggaaccttctcttcgtgagaaaaggacttgaatttcttgcacagggagaagaacagtttcgttgtcctcgatggaacgtgggcgtgctccaggaaggagttgcagcgagcatgcgtcacgccctccgcgtgattttccattttcctgtcggggagcagcacccgctatggctcttcctccgccttctggacctgaacctcacatggtcccagtcaacagactgaagggcccgaggcggtggcttttgcgtccttagatccaaactggcgcgtcgaagttgctttcctcgctttgaaaactggtagactcctgatgggggcaggatttaaagaggtcgttaaaggctgaaaggagggtttcatctgttacatttccttccaaaatgctcctggtgaattgctagaacaaataacaacattgttcacaaggccgcggaggcccagtcccactggtgaatggccattgtgtttgtccagctactgatacctgcgcttttgtggaggaaagaaggccggggccacgacatcggcgcagcacaagcatccctctgtgcggatgcccagagcgggtcccggccgcggtgggaaccgaacaccagatccctctgagaaggttttctttaaatccagctccaatgcattgtttatgaaaacaaggctattaggtatattaataatttgataaatagggatttgtccttaattattcatgaagaacatttggcaacagtaaaattatattcgcagaacaggtttataaaccagctaattataaattaagtatgcaagagaaaattgctaaccttgaaattaaaatattttatgattctgcaattacaaaaaaaaaggtagggaattatcaaaaccccagtgtgggcagagggagcagcaggcctgggcctatacagatggtggcggcgcacaggccagaggcgtgacagcagagggggtggaccgggaacccctgtcccctccccaacagcccctccagtcggggtttgtgcaactttccaagagctcatgggaaggaaccagcagctgtccacaaggcagcccagcatctgcagaaggccctggtctggttctttgcaaaggacatggtggtcccctctgctggccgccaaagccctggcaggtgaacagagcagcatgtgccctgcagagaagaccccaacgcccctccatgtcactgccctcccgctggggcagggtctacagagagcatgggggccaaagggacaaggccagagctcgtggcacaggagcgtggtcccgcttgtccccactagagggcttctcggacgggcctcagcggaaaccagcaaacgccagggtgggcgggcagccttgggctgggagcagctcctgcctgcaacacacttgggacagacccctcctgcggctgggccgtcccactgatatgtgggctctgctgcctgagcacagctttcttgtcggacggttccatcatccacctgctccccaaactctgcagcctccctgcaccccccacccgctaaacagccagcaacacattcccagtgagttccacacacattcccttgactcatttgataagagaagacagatgcaggggaatcttccgttcactttctaatgaccagatatcctcactcataatttgggcagaagttaaaagaggaaaacaaccaggataaataatgaatgtcctgttgggtgcagggaggggaagtaggccatattcctccacttcttttcccatggctatgtcacatctgcaaaaaaaaaaaaaaaaaatgcaaaccgtagaggctcaggacatgcagaggcagcccccgaccacttttactaccctgtaactcagtgactctttccacattccctgaaatcaacgggaaaatgagcaaagcccattgaagtgccttttttttttttttttttttttttttttttggttatgaagagtcttgacttccctgagagtcaaaagccccattaattgttcatgtaccagaggtagtgcagggcacactcatgtgcccgagtccttaccccgacgcttggagacacagctgtgggtcagacagccaaccaatcagggaggtctctgggaactcagataatgaaaattttttcatgtataaaatccttaatcaaaatgcgagtggtgtcatcttgcagtgcagacactgcaacttaaaattaatatacaacagaaccttcagcagaaggaacatccccgggctgtgtggtacaagtgaccctgaactgtggcctggactgccgagaccccaggcggcaggccggctccaggccagcatcgagatcccagggaaacaagctgttgctgcaccaggatccccaaggcccggagggactccaaaatgtgagggcaaatcggcaaagatgatgtagcacaaagagcgccattaacaccataaggtgtgacgtgcacagcggggcctccgccagcctaatactgggcacggctttaaggcaccgtcaaccaattagtttaactcgatcagctagtatctaaagaatatttttatcatttggaatagactatttaccatttgataggatacatttctttctttaccgctgggatgctccacagatgctaagcaacttcccctaacaatatttaaattgcttacaaagcctctctaaatatttgctatgtatttagcatgcctaagatttgcccgttatcccaaagtctttttgttgtaaattgcaattttacaacttcatgctcgtgatctattttgacaaagctctgctgacaccctctattggcctctgaaggcaaaagagctgatactccacgagtcaccagagaactctcaatttgttgtgagaccgcgctactttgccatcctcaatctgcatggagaaagattaaacattcaatttgttacttgataggccacaaggttcgccacttaccatacaaatggaaaacattactgtcattcctcaacttgcttgcctgagtattttattatttgtaatatttacttcagggaaattatgattcatgtcatatttatcttcatgaaaaatgagcatctaaatggaaatcaccttttgaatgtaccgggatatagtgtaatactaatatgcttcatgaactataaaatttagtcacagtatatggatatattatagcatgactttaatactctcccatcaagcaaattttctctgtgttaagctgatactctgagccctgattccagtttgataatcattacacctacatgatggtacaagtcactacttgtagatttatgtgccctctcagctcttttgcattaatctgcctctgaataagctattcgcacttcctcccgtgcatgcaggaaattggaataaggtgcaaatttgtaggccttaaatctgaacaagcacagacagatatttttcacctgataccattcatttgtttcaagtaaatacaaaagacattttttattctttgtctttgtcctaaggccgttcttcacgaaaacgactgttgtgtgtttccctccatatttacatccatttttgcagaagtcagagttaaatgaactatctgcaattagctctgagtcagacttgcagtgatgtctgtaccaatacagggtccccagcaggccgcgccatcctttgtggatccgtggcccggtggtctgccacccaaggaggtgatgccatgtattacaagcacaacagagctcagaggcccacagcccacttttgagaatccttctggataattggagagcataaacttcagtggctcacggcgtctctgaggccctggtaagaggcattccaattcattacagaggtagttcagaaatatctaaaagtgacaggaagagcttggcgtcactctcccccaattatccgggaaattccgagattcctggctaaacccgtcccaatctcaaaccttttcctctcagctgacctgcagccaatcaggctgttaagggagattgatgggcccgcctctctctggccaacggcctgcctgaggacccagggctgggacactggcaggggaagcatttctcagcagcggcaagaaatgacagagtcaagtgaacttgactgagcaggatgatcccgggtctctccccgggtcccaggctccaactgatgagtagcggggctcttagtcgggttcctctttggagcccttatgaaactacctggggccaggaggcggtgctggggtgcccccaaggaaacaggagaggggtaggtcttcacagtgtgcacatgcccctgctttggaacccactcccgtaaaagcagtgaataattaatttgatgaactcaatttccatataaaactgttgtcattggaaccataggagccaagtgcaatgagctgtttggcgatttccacttatttggggattttggtgccacggatgccggacacctgtgaggtgagcaacaccatgggtccagaccgggaatgaggcctcctgtgacggctcagagagtgagccgtgttgcatgaatgtttatgtgcgttacaaattaatgataatcaccactgaccataaatatagcacaagaatcacacgagagggtcatagctacgaaccagctacataaatagagtatgattagtccatgtctaagagtacattcatcacttaatgacttttcccattatgcctgcacattttatctaatcagaaagtaagcctgcttgctttcactgagcagggttaacctaataagactgctgcttaaaccacatcgaaacgaggcataacaagccagcttgatgaaaacgctttcccaatctgtgacaacgcacttgaacgtcgccatcaaatcataacccccaaatatgtattttcccattttaggggagggcgccggcagccagccgttaattagcatacttcccatgctcgtcatgaagtcacgggctaatctggcacacacggttcggaacaggctcctgcctgaatcaatcgtgagagcagggcgctgggccctccctcccagctctccctttatatttcaatagtcctatgacaataattgattgtgattcactcctgaaatgtaccaatccccgggaaatggcatgggctttcattcatcaatttcagcttcataagtggaaatttatacaaggtatgcagatgtttagagtttggggtaatcaataaggagtaaataaagattggcattcactatactccacttgacaagccccagcctaatgtttgtcaagcaaattaaacacactcagacttttcacctgctccgacaacagcaccacatatggccctgaagttaaaaataagaaaatgtgcatacattatcatacataatgtacaactccctccatttaatatgcaaattttgtaaaatattactgaataccttctgttctaaatgaataaatttgaattgcaattagaataatcttgtataattaatgaaaactgtcaatttttgttcataagtaatttgattaacatgttgataggacacttatcaagttcagtaaactgttagattaggaagatgaaaaaatttgaagaaaatttttaccagctctgacaatttcccctggcatggtaaacaaagacttgctggcaaacttcctgacgccgggaacgagcctctccagctaatctgcaaatcacagcgcacgcatgaaacccggaccaccttctccatttcttctgcgctcccctcctctccagctaagccagagtttaaagctacagttaatttcattgatcagtctgactcggaacgtctgctgaggtcaacagcaaggtgagcgcctctgttacaggaagcgtgcaggcctgtcagcagacctgctggcttccctggtgggggtgcacggggccccacgtgtgagggactctccacagccaccctccgtttggggtgaacaaagcgcgtgcttctcctacccaagccccactccccaactcgtgtggctggagatgcaacccacaggcagaataatttcggtaaaggcttaagtgcccccctccttcctattaacctgctccccagtcctgttcctgttcttattttctaatagaaatgaaacttttatgatatagacgtgggctggcttaaagggaaaatctgtcaagctggtgatctgcacttgggtgtctcctgcgcagaactttagatgtttaattcataaatcctgtcatccatgtaaacctcctgatttcataatgaataactcttcatcatttaattaatttaataatgcctttcaaaatccataaatgaagggggttctaaaatgggtgcattaattagtcacaacgagggctgaggactcacttgtcaaccctgagcctgtcagttttaggacgaccagaagagatgccaaggtctgtacccatcacccaggaccttgcccccgtggctggcacatcccacaggtcccaggggagaggccccctgcagggctcggtgacctatgatccagcaccttgcctctgggccccgcctctgtgccccagctcctcctcagaccgagctggaaggaggctttctactctgcttggaagctcactgaccaggctctccattgctcactggggccctccagctccccaggttgcagcagccatggctctcccaatagcctggatgaccctcctgcttccagggcagactcttccagaaaactgcatctgcctggggcctccacagagcctattctaacatttgtcaacatcatctgttttcaactttgcaatatctcagcttcctctgacagtaggtaaaaggcatcaagattcccaatgtttacatgctgcattttcaggaagttgccagagggacagagtctcctgctggtgacttcctactcaggctggcagcagcctgtctgcagatgtgggtgagtccctgggtcagtgagcacaaagtcctgggcaccttctggggcaaggcagtgctcatggcagaggctgtaaagcctgcaggacgggtaaagccaggcaaaatgagtgggcatgcggaacggggacagtaaggccaggttcagccccttgttctgcttcttcctcatgggccactgggcgagacacttaattttgccgagattccattcgtccatcgacttcatggagctgctgggaggactatatggaattgcttgcataaagacctcatgccttcactcaaccactgcctcaccagcaggagtttgggaagccacctggctgctcttagctcctgattgccctctgcgaagtggatggatgcctctcccccagccaggctccagagggagtggacggggaaggaggccctgcgacaaggcttcgtatgcctcccggcaccgaatctacctgaggctcgggtgtaccaagagcgggctctggacaccacactgagctgggctgcggcccagctactggagaagctcccttgttcccatgggcagcttctcctccgagtatgggtaaggcatttccattccccttcagacctccacagaaaaacccaatgagtatcagtatgtcatcaggggacaaaggagtgaatccatactctcaaaattcgacaatcaaatcttaccagaggagtcctgaggaccctggtaggggagtggcctaaacacacctgtgcttctccacctgggacaagggctggtgtgcagaaatgctactacaaataaacttgtatcgatacttgtgccattttaaaatgatacttttgattactttcctatcatggacaaggacatgacacagattatttctctgcacatattagttaaaaaaatccagctgactttagagtttgtcaatatcaggagaggtaattaactgttttgaaagaatccgtaatgtgggactttgtaatggcatcatttggagtcaagtcacagatgcggcgtgtggagccatactgtaattaggaagaaatgctgtacaggttttctactaattagcaaattatgctgaaaatagcatcaagctaattaacagttattatggcatttttgaaagtatgactttaattagcaaagtcctgacgcatgcaatttcaaacttgtccagaaaaacacaggacatgatcaagaagctacaaagattattatgaagaagtcaaaatgcagggtggggggaaggggcttttatgatccatctgagttcccatttagatgaaagagcatgtgtatcgtccaactctgccaaaaaaacccaggccggctgccggatgtcaggtggcctcagtggtcatagcagccaccatgcaaaaacaagcccgagctcagctggtgctgggaagattcacttattctacttgaatgcacattaaaagagggactgaatgaagccaagcaacaagacataacctgacagctccgctcccggccacgcggccaccgtcagccaccctggcctggcgtcgcccgccattcctggcccctccgagcagctggctggacggggcgggggccggcgtgggccgggtgtgggggtgcgacaggcccttgggggctgcccctgtccctgcacagcgagtggggggctggagtttgcaggacgtgctggggcgcggcctcctggcgagcctcccggaggcggtgcaccgtgcagcccttgagctccgctgacctcgccggtgcctttgtcttccctgctcctcccgctgctctcctccttaagcattcccttttgttgtctcagagaatgagaaaaatgccatctcttcccaaagccccctgtagctccaactcctgagagctggtgacacgcccagcccgtagccacctttcgccctgcgtgaacttggcaggggagtcgaccattaaatactgagcagaggctcaaaccgagagagaagcctgcccacgccgccaccccaggcctcctctttattgcctgtccttcatagagagggaaagagccttgtagccaagttttgacatggccacatatggcctcttccatcaatctgactaatcaagcatcgaggacaggcaccgccagcctgattgccagccatggccatctcactgcaggcaacctgagcagagatgggcctagacgggcagttggagctgggagacaggaagacaaagccggtctcctttcggggtcctgggatgagcactgtggtcacagacacactcgcggtgtacacgggccctccacgcagccaggaaggggttctgctcttcctgtccaagttcctggggacacctctagtccacttgggccccactttcctgcagggacctaggagggttgaaaggagatgaggcccatggctgtgtgggtgagttcttgggggtacaccagtggccccaggacctttgtggaaccagagcagagcccagcggtgccacccatctggaaggcggtgctgcaaaaccctgaggtgcatggcctcttctcccatccaccctcccctgcagactggctccccctaaatcaaggggggccaggcagacctaacaaacagaggcaacacctatgcaggaacttcctgggaaaatacagaggaaacccagcacacgacccttttatccgagaggcgaagcccgggaaggttctcgagggcgcccattgtctccgagcctgcccactgtgcctgcctcagagccctgacggacagctgacattctcctatttattatcaagaagtacaagttttgatgttatcagagtggaaaaacagcccaaatgtcaaagcctgaatattttccccagtttcttgaaatgacatcttactttcctacatttatcgtgacggggccacttgtgggtatgcgagtacatggcggccagaggcagatatcattgaactttgttggggttttgttccagcatcctccaaatgctgcaatttctgcccttttcctggtgaggaatttcaaataattctgttataaatgcctaaagctggggctgctcaacagaagagagcccgagctgacccgttgctgtattaaattttcatatgaaaagaggactttgcacatgcagccaaaagggcagagctcagcgctcctgttgggctcccagagacaagcattttctagctctgcatgcataaaatgagctacagtaggtgtcagtaattaaacgatcatgtttcaaagtcttgacaacagtacagaagcaagagaacaagacgataatttcattagtctgaagagcaaagtcataattaggtgcctttcacagagtaaaagtcatggacaaaaggtacccatcctgcccggctgggtctgcagtgcaggagtgaaatctaatacggggtcccgggtttacggggttcacccatgggcaggagactgcaggcaaagtctgggtggaaacaatcaggctttctttggggcggctgagaaaggaaatgatatagaaacagcctgaaaaagtcagcaacaatgggatatcggtgggctattgttatagggaaacctgaattcctctccttgttctggggaccgccccccaccccaacccagaaggatggcaccatggctcacaagcacggtttgcatccgtcgccccactccagtcattaaccacattataaactgactttggtaaagtagcatttatttaaaactaaactgttgggatgggcacttcatggaatcattaatgtgcagtttgatgtttctgtcagtttatttatctctgtctttacttgctgaggtatttgcatatttaattgatcaatatgctccccgttcctcttgcacatctgccaagctggtcccagcctcttagacccctcatttctcaaagtgacagctcgccgctgcccctcctcccgcgcccaggccccgctgcgcctcccgcagcaaggctgcccggcccgcggccggcgtcccctctgcacggctattaattttgcatcctcggataacgtgcagcctcgagtaaggagaagacgtttttggtgtctgatctgtaaaaagttctcgagacagattttccacacggctacacgtcggagcgcggcagcaacatgtgtgcgccggctcccgttcagcatctgtcactgtctcctcctgcctccgcgcagccttgaatcggagctgcttatcagcagagtgtcagaaatccgcgctgccttctcttcctcgtttaatcttttattaagagctacattgtgagcttctgatagcgaatgtcctccacttcatcattcataaatcggagtcgacatcaataaggtgacggcaccatggaatcaaaagcagcgtggttaactgccaatgaaaacgtcttaaattttctaaacaatccgctggcatttcttgatgccagcagagtgccacaaagccccattatgtgtgtcggatggtgaggaacataaggaagttgttctcctccaggccccgcctcaccatggactgtgccggaggacggtgaggcagaggccggcgccctggaccagcctgggtcatttcaaacaggccaaaacaacagccagccatgtggctaaaatgtaaataaatacagccttcccgacttgctgtgcgagggaagcccaggaggagaaacggacatgtcccagttgctctttgaaatggccagatccagccggagggaaggccaggccggggaatggcagcagggttgaactcctccacaggtgaggacacaccaggggccacactcgcagaaccggaaaggacgccagcaccgtgcgtgaaaaaaaagccaagaaagtccaggtgacaagttcctatgctggaacccggccctgcatctacattctcctcttcgctgatagccaggatgcttctctctcctcttgattgatgttttagtctgagctgtcattagttaaattaattttctctccaagatagtggaataaggtccacaaaggcaaatcttatgaggctgtaaaaatagaccatcatttggaggaaattcagatgtgttccctgctcttgtcgttgctgcagaagaacactttaatttgatatgaattcctcaagagaaactttaaattaacttagatttagctgtgtttgagagatagcaattcaaagcaacaaaataaaatactctttgctgactccggtgtttccatgttcatgctcctatgtgctcttctttattttctgctcaggctaaataaatgccaatattcaccttgaaagagtcatcataaagtaactcccctgggatacaaaaatatccttctctcatcttccatccaaacagtgtcagatgaagttaaaagacctggtaaatgtgctaaaatctgcttatgtgaattatttttttccaggataactgagcagccatcacctaagctgtcaggatgcaaagagaaacgcagaaagaccgttttataacctaagagcaaggatggggggtaggagggggctggagagaggcacacggggaggggaggaaggacacagaagccacagattccccagcggtcagcaccagcaaggtcctgggggacatctggtgcagcctccagggacagaggaggcctggccagcaccggcccaaggtcctcctgggcaacccccagtgccctgacctcctggactcactgcctgatgccaaagggcctccagttctcctcactttgaggaaatttaacttgaacctctttcatgagagatcttgtttcctaaacagcccccaacattgatggtgctgtagccaggctttgcctgtgagagcactcatgaggagcaccgtagcgggggtgctcctgaacttctgcatacagatttcttggctttttccgtcacagcctttgacacccatcagccacaggcaacctgggtagacttccatgggagggcacctcagagcagggtgactgagttcatgaaggtcccagtgcaaacccaaaggtcttgggagccattgaaagcacacatcacccaacacccatagagccaagttcagggacttgggagccaataaaaccaggtattacccaacacccatcagagccaagttcaaaggcaggttccatgcataattctttgggctggtaagtctttttctggcacgccctctgataagaaccattctcaactgtaggatgctcttgacatctaagtgggtccttccaggtcagacagtcaagtacatctggagtgtctcatccaagtggctgtggccctcttagctgggaagaagccagaggctgccagtgctcagctgacatctccacatgacttaccaccactctggcaatgtcataattatgacgcctaaacttaccctgtttatttgcaggccagaggaatgcatgattgtttatttttattacaaatattgatggtaactcacaggcacttacttcattgccatttctagtgaaattgcccatcataaaatatctccagaattctgatcctgattagcttccagagctggtccagggtgcgatcctaccatttgtcttaattttattttgctctccctaactgcacacaccacttcaggaatatctggaattttgttttaattgtacagctttcaactcacaccacatttctctttgtgttgaaagcatcccggtgatttatcctcattattgtgtaaataggtttcggcagttctcagtaaataaaacaaagactgacaggaggagaagagggaatttgctttcctaccaattagagtagccttaggcagtacttttaagaggagataaatcctgcaaatcactaaaatgatcctgtcacatgcaccaaatattaaaatcgcacagcggcgccctcggtacagtttgctctggtttaatgagttggggtgggcctcgtggcgagggctgcaacgcacagttggggacccttgactgacagcagagctcacacccaactgcagcttcccaacctgtgtggccagatggaaaatcacaatccggcggaatccgcagctttccagctaacgaacattcccaaattgtctttacagcgtctacctgtaaaacctttccccatgataaataaatgcaaactctgcttcctattagctgaggtgatgcttttaatacaaaatctacagcctgtgcctactaggggagcaacatgttaacttctgcaactggggaagttttcggggaattagaagtgagtttacttcatctagcgccacacttagttccccaccacaacgcagctagttagttgtcctccacaactagttagctggggaaacacaaggaacttccagacatttttttttttttttttactatgtttcaatgcctcatctactttctccagctttggggtgaagtggtccacctaactccacggcaaggaaaccaatggaccccatgaacactttaacgagagttgtgagcccatcttcttcaaggctggtgtgtgacctggggtgctgggtgcacgggcgtctttccatttccaatccatggccactggggttcagaagcatggcacgctatctgggaggcacatccatatgggaccggtcacaatggagctgtaacagccatcaagatggttcaccataaaacccagcagaaagtcccagaacagacaacccaatgggcaggcccagtgttttgcgtttttcagtaaccacctttcttctctctgccactgtcaggtcttacctggtgacaatgacacttggtatattgagcaacaactgttagcttgttacagcatctttgtgagactctttatgagcgtgtaactaactgtacgaaaagaactcccataacccgagacccggggtcagtaatgcattaaaacaaaacaagacacacaggatttcagtacagcaaggactcgtgtggaaaggggtgcctggcagggcaagacagaaggagcccaggtgctctgagccagcttccgcccaccctgcccctgggcctacccagcctggtaaatgccaattcacatccaagagacggcggcctctctcaggattccagaagtatttaagattcacaagtgattctccatgaactcaccaccactgccttccaggatttggaatgaaaacgcctacaagacacagaagcaacacaacaaagagaacacaacgcaattctgtggcttcgatgaaagtcatacacacgtttcacctttttcttgacatcttagtttttagcctccaactgaagttccattccactagtattagatggaaccaggtgaagctgctggttttgagcatgtactggttcagtatatacggttcagtctaatattttatgcaaagtggatatcaaaaccataaggccaatttccaaagtaatattattttctttataagagatgtttggaaggcccttgggcatagaaatccttggactgggcttcccttgtaaggaatgacccaaagtgtctgcatttagtagctgtggttatcttattctacctgctctttttacccatgtagcattccataagcacctgtgctcagtgctaaatttatgaagaaagagattacaaagatagcatcacacccttacaaagttcagattacatcccattaaacaatgtcaaattgtcaagtactaaacctattcgatgaggaaatgtattagagagatactggtgcattgttttacaaatatttgttgagacatttcctaatggtccttctcgtggataaagatccacagaatcaggagtggggacatattgggcctggaggaagatgtgatttttgatgagagtaaaatccttgctcccaaaggtgctctgagaggcactttcttgctgtcatggggagtccatgaccccaggcagtcatttggtggaattttaattgctgcaaagtcatcataggaatcacagcattttactgccgggagaggagtctcagatagaattcaatcctaaagttgacaaatggaggcagaatgatcagccagtgaagtcccctctccttcccatctgttctttctgtcctcaaaaccctatacacgattccaaagggctccctggaaaagttgctgccactctcagaagagggggtcacatgactgaagaccatgacccaagtttccttcagctggttcaggataacatagttggtggaagatattcaggcagtttccttttttcctactttggaattcatgcccttccacctagaatgcccatccccaactcatctctgagggtgtgcagacccttcatcttcatagccaggaccccaaagcctccagggttcctgcactaccccttggttaggtcttaactggtgacaatgacacttggtatatttagcaacaactgttagcttgctacagcatcaccccagagtcatcattccccaacacattattctcctgtattataatcatttgtttctcccacctcctgccaaacatattaagggatacagggctatgaatatggagatggatggatggacagacagatgattaaatggacagatggatggatggataaatggatggatggacagacaaatggaagatagatgggcagatggatggatgaatgaatggatagacaagtgcacatatggatagatgaacagaggatgcatggataaatggatggatgaacggatggatggatggatggacaaatggatggatggatagacggatggctggatggacaaatggatggatggatggatggatggatggatggagacagacatctatggatagaactatataatacaaatatatagacacagacataagatttatatagatctctctatccatccatccatccatccaccctttagagcaggaatattttaatcacctcaactcaaattagattttgaataaatatttcttgaatgaataaatgaatggataattagttactcctaaacgaacagaagcaactccttaaatagctccctatattgcaactgcaaattttcatggagtaggaaacagacacaaaattataatcacgagacatttctgaagcaaagtcaaatttgtccataaggtgagggttctgccaccatgtccatgagataaccagaaagggcaaggctgcgcctttcagggatgagttcgtcccactagagatgtgccctctagggtgaggtgactctggaccccagggctccaccctcagctcttccctgcccttgtctttccatcaacttggggctggagactccagggaaagtgtagctctgtcctgaccttgatggcaccagaagggctccagggtgcactgtgcaacatggtggccacaagccacaggtggcaactaggcatgtggtaggggccggtcctcatggagatgtgctgtttgtgtccaatacaccagattcccaaacttagtgaacaagataaaatttaaaatatgtcagcaattttatattgactacgtattgaaataataatcttttggctatatgaaggaaaaaattctttcttatattttatattataaaaatattatctctttttactttgttagtgtggttacttgaaaaatttaatagtcaaaattttaggtggctttcatgtgtggtttgcacactgttcactggccaccactggtctagggagcaggctgggtctctccaaggactgaccctacctggcctccccactccatgaagaagtagggatggaggatcctcccaggccctcacacaccatctctagaggatggcagcctctgggaggccacacagctcagcgagaaccgcagcatcagcctctccaggacggtggcggggaagggaagggcttcccaaccgttgcaggtcctgggaaccctggaattgaactcgcctccaccctgcatggcaacctccccgctggaggctgccctcgtgggttgggcccccgaggtgacatttgtttcattaatgcaacgctcaggcactcaaacactgcttcacattctacagcgattccaaaagtgatttccacaatatgatttacatactagccgagtgtaaatttagaataatttggcctgaatgatccttactagaatagatggccacaagaaaagaatggtgaataaaagcagccttactcagaatctaagcaatttgctggcaaatacaagcagcatttccccagattataatttacactgtattaactgtcaagagcgcttttgagaaatatagataacaattcagatgcaatcgatagggagtgacagttgatttcaaagcttaatgcaagacaagaaagaaatgactggggcatcagctctggaagaataaatttgttttgtatttgatttttgtgttaaatttattactgccaagaagagctctctttcaataatattaagaacaagattgtgaaattgcaacatgttcgtctcccacagttttcacagcattgccaatataaaatgatgcccctgttcagtactatgtatagatcccattaaactgctgcagattcctctaactttgaatttccgcgccctgtacaggagccctcttaacccctctctgcactggcagggggctctgtttggaccctcaggtggaacgggccctcttctgggtgctgtcacaccctcctgtgagtctagggagaggacagtccctatgggaccagaggacgcttctgcttagttctgaagtggccttaacaataggcttatttctagaaatgcctacagttggctgtttctaagatcagagagttctgtgaaaacaaaaacttgaaaaaaacgtcaggctaaacctcaattgtttgattgagaagggttggtgtatccctgtcatagtcaatagaagctttttttttcgattctgtcaaaatgtccagtgtatataatcttagggtttcatgttcctctgtgcaataccacaagaaacttacttgacaagtaccagggaaaaaaaaaatttcccttttagcccaactctattatactccttattctctcccaccagctggggttgcctctccgcagccctgcacactcgaaaacccaccagcatggccagaaatgaaatgatgaaagttgccacagttcaaacttctccatacttctcacttatgacatgattgattttccttcagagtgctcaaacacaggattgtctcccttcttttttcactgtggaaacagctaatgtatacagcctcggcctgccagagaagggggaagcggctgacatgtagaagaacaactgaaatgaatacggatgaaatttgaaagtgcaattttccatctgtcaatcacctttcaaagggacccgttaaccaccaatcgggagaccctgggcgagggcgcccctgtttgcagctctccacgccaaaggccccttggcctcattaatcaagatattcactgctgatcaaagttttgcacaggtatcctgcactgacttggaatgctccaggaatattttattaggtttcttgagatgctattgataatttatattttgaattaaaacaaatggtctcctcttaaacagaatttgattaggtgacgacaaaatctatttctctcactctggtgatggtacgtggtggatcctttcccagagctgcctcagaaggaaatgtgaggtgctgtggcattaataatggatagtcaccccaacccttcctggccgcagcaccaagatgcctcgaaatacagccaattaaggtttatttaattattaaggttgaataaataacagcgaaacatgttaaaaatctttcagtttcagtcaatcataataaaaaattaatgagactggatagagagccataaaaactgatagactgcgatcgtgaattataaattggtattgattttttcctttgcaataacactctcaggtaatcgtacgttgtcgcatgtaaagtgcactctcctggttgagactaatattaactatcaaatatagatgagacggaggcatttatgacacttcagatatcacaaacaaaaagcaaaaaatacaatttgtggaataatagcagcactgaacagagaatcctagggtgtttatgggagctggccgggaccccactgagccatggatccataagacacagctacctcattcttctcctgccatttctcctctgatatgttaccttgttagtatcactaagaaaagcataaatattttttattatttgtgaggctcatcccgtcttgcttaatagacaggccacatggagttaaagccatattatatgacctggtgcagaagtgatcattcaaaaacccaaagcacatattttataccgcctggctttattaattctaagcccccaagaaatagcgggaggattttccagctttctgtttattgaagtaacgtggaaacaaataagacatttccctaggctagctcagataaagtggacaattactattggcattccgcatgtaaatatttaacacttcacagctagtttgcacctaaatacccattagatgttgctacaagcctggacaccatttcccagcagaactacatgggccgtcctgggcaatggttattggattagggcgaatacaaatctcattccaaatagcgctggaaggggacacgggctagaggagacgggatatacctgaatagggtggcttccttgagtgacacaaaccaactcctccaagaaaactcagacaaagccagtgtcggcgcagccaccgccgctggcccagctaattgataagccgcgttgcagttcgttagtggcgttgatcggatttcccttgtttgggggaagcatagaggagacatcatggacacaggccagctatgcacacatgtggctgcctgtctgagttcaatttccgcctcctttccactgtctggcctggaacaaacatcgagaggtgcaaggccaccatttttttaggatgcgagtgatccagtttacaccaataagtatggcccataagtcgactctttgcaaattctaaacacaatgcaactgcctctttaagtaactctgcttcttaaagatatactaaaagtattcttttaataagcaaaccgtagtcagagttaacaatgtggactttacctgcccactctgattttaagcacagctgctgaaggctttccttctgaattagaagttactctgccccttggctggcatttggaacttgaaagtgaatggactgggattactcttcccagagggtggctcttttatcctttaacttccccatgactaggaaatgccactgcccagaacccatgatctccccatggctgccctggatggaagaggccagacatggagggataggccctctgcatgggtctctcttgcaagaaagcaaatcccatggccatgaacacggggatccccagcctcccaccaaaccacaggcaattcacaccagcagctccttcctggacgcccttcctgtgcagacactacagactcttgaaagcaactttgttcacaacctctctggcctccagttatgctgctggaaaagtagatggccctgggaggtgacactccctcggaacagcagccactggacagggcacacgtttggtcaccctggctctcagagggaggtcatgggttctcactcacctggcctgggctgccatctttggagcagcagctaagccttaaaaatcagcctgagagcaactgtgacaaactctggaagtcaagcctggaaaacatacctgggaaggtggcccagtgaggctggtgtccgggcagcactgtgcatgctgggtgcctgcttgtaccccatccaagcctgcgaacccccatgctggccagggaccctctgtggcacaccgtcagccgccaaggccctggggtccccccagaacagcagcgcccacccctgggctcacagactctaagagcccttctcccaaccctttcctcgccgctctgacctctgcgctctggaaacaattactcctggaaggcctgtcaatatcattatttttacaagaaatcaatacgcctcacaaagttaatgggggattcaggcagggagcgtttacctcctcactgtcaggggctcgggctctgctcagcgccgatgacagatccgccgacaccagcagacagtaagcaacgcgtggagaggaggctggcactgcaggcaggcgtggaggccgtcagcagtgccgcgctaacgagcccgcccggggctggagcccactcggaccgccgggccaggggccatgtggggcagacaccccagagctctgcccaaatgaggcctgagtcccctctgtgaagggaatcggagccttcaattacttgacatgtgtcctgtaagcacagactgtacacatactcaagtcccttggccagtacggggcctgaaagaagagttaaccgcatctgttgtctttaacaaaagagactgcttctccttccctgcccaaccctaacacttacaaaattaaaaaccaagaaacagctatgtgtatgcacacacacacacaaatacatacaaatatacctgtatatatattcacaaaccaagtcagaagtaactacactgatgatcctaaaatccaaattggaagggtccgaagagccatcccccaccacagtttggcagatatacaccaaatctccatgaaaaatatctcaatacatcaattcaagtccctatttttcttatccgagatgccaggtgtacggattgtccacccagctcctacgctccctgctgtgggtccccccttcttttccccatcacctcccccagagccccaggtataggattaaaaattaaagttacaaagttgtccagggcacagaccttcagcacgctctagcccacactgagacagcaccctaaaatccttcctagacccccagcctccctgttcagcagcagtttctgtccgcaaacctggcctctgcatggtcacgtggtccaaggggagggttccaagcagctttactgctgccacagcctggcatatccactcctggggcacaggtgccagcagggccatggccgaagctgctaatgaaacgatttacccacacagagctcagcgcggaggctccggatccagcaccaaccaccagcacatcatgatgggtaccaccgcccactgcccactccaaacccccacacctgccttccaggtaactgcagggcccatggagaacggggtcattcctttataacagagcaaagcatgcctctgcccccacacggcacatggcagtgaccaagccccacagctgtgagggacctccagcccacgggtgggccagggccagaccaggagccatggtcccggagcacagggtaaggtcacagggatacttctcctggcctgacaggtgcagagacccacaggccttctcatcccacagccagctggatagaagcattgcagagccacagcccaagccttggcttagaggaccgtcctcagtttacccaacaggccctttctctctagaccctgtcctggctcctctctcactcctgctccacctccctctgctctgccccattcgccctcccctatccattctccaatcacttccctcttccatcccatttcagaaacccccatccccacccaggcccctgaagcttggaatagtgtccaaaaggccgccaagaaaaggcatccacctgcctcagctgctccagcctccttggtgggcacgggatgggaagaggggtgaggaggggctgggggctgctgctgggctcacggggcagggacagttagccgacctgtcattcagaaccgtgtatgccaaagcactgctatggaaaacagcatgaatgagatctcatagttgatatgggggaaatggtgacccctcactcctactccaagctgggaagcccaagcccaggtggactcccaagtgccctctcacccacagggaggccggttcggcagccgaagggagctttgccaacaaaggaacaactagagtgggcaaaggggtctccgcgaggcctcatggaggaaatgcatggctgcttcctccccagagcaacgcacggcccagcaagaacacgtgacctcagtcagatgtgcacacaaactcaacgcccgggtgtgcacgtccacctgcgtgggactccccgtgaaggaatgccactgaatgaagagggctcccgctaggacccacaggagcaactgccccaccaccaagtacaaaagttgggggaggtcctcgcgcaccaagaatttcacctaaactggctctttcctgcgcatggaatatcgccctccactcctggcctccaaggtagagggagaggcaagctggaccccggaaccctaggaagggccctgcggctcctctccccactatcaacagtgtggaatttacaccgggcctttacatccttaccaggcgcttcacagctttttaaggccttaatgcaaaccatatgcagagctgcctgctcaccaaggcctccagcagctgcctcctgattggctcctgcaggatgggaaatagaggtctcagaggggaaaaaacaacaaacagatctcttgtctacaaagcagaactcaaaacatttttcatgcattctcggcttctctaggagcagcaggctgtttaaaaaaatacctggcccaaattgagcatttgcttgacatgatggcaaagtgagtgctattttctgttatattgcccctattctacatcgacaagaatatattttttccctgttcccaactgatttcacagtagtgaactccgtttatgaattatctgacacatttcttgcaattcttctgacaacagtgctcagtggaaatttcaaggcccctctcttctgacaagtagaaatatcaatatttgaataaattgtggattttaaacttctcactctgatgcgccacagcaaggaagactgaattcttcttttactgggtctaatccccctgagcctcaggaagaaatctgtatgcagcgtttcattacaagaaagcagtactgagtgacatttgaaacacatctaagtcgacctgatgaagtttacttccttccaacaacaaatagcagctttgtatcattcccccttcttgggggaagagcagcacaactctggtgtctgagcaaaaaaccgaaatgttgattcacaaattgacagcccgatctttaaacaaatgtgtttcttggagggaaaacgcagctttgttcgagctaggcatttttctcttgcctgacagaagcattccgggcctgattagaagggccttgttagggtccgtctcagacactctgactccacgttttaacaagcatgcaaagaaaacagcataaagataacaaaacattgtcattaccatctccggtgactctgtgtgcctttaacacttgcacacattttctcctggtggcccccacacagttgcatgcactgggcagggcccaaggcttgctccagaggtccctaaatgagggactttctgcactcacagagctgatggactggcaggagcatgcaactccagcagcatcctcttcttttcttggatgaataaacatggatagtttattgctgaaaccatatgtgggcctgagcagtatgatgaatggcctgtattttccggggaacggccggcagagccgcctcctccaagcccagcctgacggtcctgaggctgcaacctcgagcacccccagagctatggttccctgaaatgtattccttgtaaaaaataaataacaagatacaagccagaggagaaacctgggaggtgctacgaatgctagatcaccaccggtgaggggcccaggggtctggctgtgagcctcagtttccccctctgtgggagggggtggcacccacccttcagagcaaatggaaggccccgtgccaaccctgcacacaggcaggactcggccaggccaggtgccatcttctcatcttctcatctaaatcccagactctcttccccaaaagctaagctgagtgtatccagccatatccttcattcactcatctcgcttctcatccgaatggaactccacctgaaaactctgcatggatgaccatggtctctcgtcctacctgtggatgcaagagcaaggcctggtggttcaagaacacccatcccattcacaaaacccactcatgcaatttggaagtatgagatcccaatgtaaaaatctgttggggtgaggggttcctcgaaggacctgaggccaggctggggccaggaaccaaagaggactccaggggacatgacgggcagaggggctgacctctcccctacccacctccctccagccctgcacccacatccagctttgaagaccgaggcggctgaggagggcaatcttgcacatttcagacaaagagcatctgtgattttcccttggcaggggcacggcgttgggcatcagtgctctgggcagccttgggagagggagactcccaggcctgcatcctaaggactggcctggggaaggtggggcacaggctggttcactggagcccagaggcgcatgcaaggtgctttcgaaaataccgttggccactcggaaccgcagggtggggaagccactccagcagtgagaatggcaggagagcaagcaaaatggccgaaaacaaagtgaatcccctgctgggcatgcagggcttggaacggggctggttcctcctctgagggtaggaaaggagaaggctaccccttcacctgagccctgggcagcaggggccacgggcacagaagacccactgtgcggccggtccatctgaaagcacggggcagggcgggcccatgctccacctttgccatggtagagccacctgcatgggagaccctgggaggctcctgcagaggcttcagctgccccggccactactcaccaggtgtcaggccccccaccttctccctgcacccaacgggtgtcatgagaagggaggctcagtgagcaataaaagaccctcagggtcccctagggcatcacatcaagtctgggaaagccagtggccagaggctgagagaacatgaggggcagggactgtatctatgcatctgtgaaaagagaacatgctttgcatggctgtgggacagagcccctgagccaagacacaaatgtgcttggcaaacccttgggcccttcaagagtttgctgctcctcactgtgtgaagaggtcaaggatgcccatccactggggcagtttcagcctcatggacagcactggggcagagggagggatgagggagaagaaactggacattcacttatctagacaacaaatggttctcagatgctgcaatggggcgctgggaactcagcaaaaggctctgtgatgtgaggcctcatttcaatacaagggcccaagacccagggcccagcccggagcaggaccccccaaaggatggctgggggttcctcttgttggcatctgggacaggaaagggggagcagtgagaaacctcaactcccaaagttactattactcaaaagtaaacacaaaaacactttctccagaagagttatgatttaaaacactcacccatgcatgcgcgcacacatgcacacacacacacacacacacacacacacacacacaaaaaagccaagacaagttgggtgttgctacgaagtgagtcggggagcccattcttgcggggtgtgacgtcccatgaagtttgttgtaacgagcgacagcccagacatcaatgctgggcgagcacagccgccgagagtgcgggaaagctgtgcccacagatggccaagcatgtggaggagagcacaatattttatttaaatatccaaatacgaacacattcccgcatggcaccaacagccgcctgaacacgcccgatgccggcttgtgctttttccgttttgtctagaaatttgggttgcactaaattctcagctgaatgaagatgagaaggggctggcagagggggtggctccagctctctgagaacctggctccttcccgggtggcagggagagatggcccctggggagacggggagggtgcactgcctcatgcccaaaccaccagcttctagttgagaaatcagaattttctctgcagaataaggaaaaagcattgtcaccatgattcacgtggagctggccacactcaggaaattcaatggggtcccacaggggctccgagggggaaggagagggcctgggacatgcccctccagccatcatggaacaggatgggcagggccggccctcactgctctctaacagtgaaaagccacatctccactttggaaaacacaggcatgtgagagcctgggggagagacgggcgggtgcactcaaagcctccctggcaggggtgagaccaccaggcccaggtgcaccacatgcccaccagctctgtgaccctggacaagccacggttcctcgtgagcctcaggctccgcaacttcaaaatgggaatgacagtctctctctgtccaccacctcatgctcagcaagaattaaatgagacaatgcctaggaaatgcttgaccagcccctgatctgccctggcatgtggactggattcaggacgggtgcagaaaacgacaccaagaatgattatccgtgcggggcatctcgtgttgtttccgaaattaggcacagcctagagaagcgtttgagagcagtggagttgaaggcactccaggaggctcagaggagcatgaaggccaggcttgttgcagtggcccaggtctccacagctcaggagccagcagggccagcgagaggctggatgcagggagtgtgaccccaaatctccagcaaagctcagggcctggccaccagggcccccaataatggacccttcgctgaggccattccctgacctctcagggctccggctcacgctcagcctcatgggccacaccagggacagaggccagcacagcccaagggaggcacagtgagcaggacgaaggtgctccctgggaaatggggaggagttcctgccatagcagaggagggcattcctgcaggggtgggaatgagggctagtgacccccaaagccacatccaggcctgagtttctaaaacatcagcaggaaaagaaatctagaattcccagaagaaaaagagatccattaataataagtacaatagatttgtaaagactaaacccataaacaaaaccggttacttgtcatgtattaaaagtgggacacaggccaggtgcagcagttcacgcctgtaattccagcacttgggaggccgaggcaggtggatcacctgaggtcaggagttcaaagaccagcttggccaacatggcgaaaccccatctctactaaaaatacaaaaattagctgggcgtggtggcacacgcctgtagtcccagctacttggaaggctgaggcagaagaaccacttgaacctgggacatcgcagttgcagtgagccaaattcacaccactgcactccagcctgagcgacagggcgagactccgtctcaaggaaaaaaaacaaaaaaagtggggcacatatcatatgcatattccacctcggcatttaattattacaatgataggtttttacttcaggaaaaccccactaggaaaataaaaaacaactaagtttaaaataaagacaagaaagccagacacaataatgtgcacctgaagtcccagctcctcatgaggcttgaagccaggagtttgaggctgcagtgagctatgactgtgcctctgaatggccactgcattccagcttgggcaccacagcaagaccctgcctcaaaaaaaaaaaaaaaaaaaaaaaaaaaactaaaaccaagctgagattatttgaattacaaatgggattttaccaaaagatttatttcagtaaagcaaaagtatcaggcttgctccctggtgatatttaaatataatttgacttctgtgagatacccctttagtggtctaggtttaccctctagcctcaagctcctcatctttaaaattaggtaaggaagctactaacagtagcagataaggtgtaattagtaaaatgataatcctactgctaataacaatcatgaactgtcctaccagaggacccagaatggggcaggtgccaggccaaccacttggtattgacttccttcaacccccatcagctctgctttgtagatgaggaacctgagacctggaagctggaaaagcctgcccctggtcacacagttaggaaggggcccaggtggccttccagcccctcactgcacccacaaaattgggggatgtgggattcactctcccacccagcattcctgaggccgagggctcccagcctggcatttttgagaagagctcaggcataggttctttgcgtactcatgtcacagcttagttcctcaatgacctaagcgggcagaggtgtccagctgggtccaggggccaagaccccacttctgtctcattctccatgccccacacatttcactgaagaagaaactgaggggagaagtcaagaagtcaagttttcacaaggcctcatgtttaatgtaacttaggagaaaagctaagaaaaaaattagatctggaggaagatcagaaatcaaagtggaccaccagactaaagaggatcggggagcgttgagaaagtaatggagcttggagctgccatttctgcttccctcagcatcaccaggcctgccctcctccgcaccaccaacctgcggtttaggccagacggaaccctgtgtgttcgcatggttgtttaacgatgatcagggccctgccctacccccctccccagctccctgccccaggggcctacaggtcagagccatcaggagtgaagcccagatgcgcctacacatctgtgtgcacatgcaggtgtgatttcatgtctgtccttgctggaatctgggacctgaggctacaacggcaggggtggaatcaggggagactcttggtttactcatagtgagatctgctcatctgcttagccctcaaactccagtccagtgttattttttaatccctgaaacgtggcatgtagcagagtccttgccccctgcagcagtcaataaacacttgagctgtgctctggaggaggctagagaggacttccccagccgggcttaccaagggcaagggtacatcaggcacccgcccatggaagcccagcctgggcacagtgggaaggggacccagccatgactgagactctctctgtccccgaggtgcttggggacagtggggagggcgagtacgcaggtgaccaaacacaacgcagaccaagccatgagttctgggagaagggctgcttgaaatccaagatggcaattaaaccacatgggcagcagggtctctgtgactcggaacatatcactggaaaagcaacattggagctgagcctggaagttggggttccagattctgacaagcagatacggagggaaggctgtccaggtggagggaacagtggaggcggaggctgggaggggtctggcccagcaggcagtggagtgtgataacagccacagggaataaggctggggaaggtgacgaggccagagatagcgagcttctctcttcatccaagagacccactcacggagcctggggtacattctagtagcacaggccacctgtgctgaaaggggccaacaactttcactgtgctctgaccaagggcaccccaggggccagcttaggagcagacttagaaagcacagccctgccccaggcgttgcccttggtaagcctgactggggaagtcctctccagcctcctccagagcacagctcaagtgtttattgactgctgcagggggcaaggactctgctaagtgccaggtttcagggatttaaaaataacactggactggggtttgatggctaagcagatgagcaggtctcactatatgtaaaccaagagtctccttcctggtggcccccatgtctctgctccctgagggcagggggagctctgtttgggttcgccaccatgagccaggagtctgcccagtgccgggcacctgtagatgccccagagatgccgcttaatcaatcagacagaacagcacaagagagaaagccgcccgcccacaagcccaccccgctgtgcagtctagggcgagtatctccaggagggccataaacccgccccactgtgcggtctagggccagtatctccaggagggccacaaacccgccccgctgtgcggtctagggcgagtatctccaggagggccacaaacccgccccactgtgcggtctagggccagtatctccaggagggccacaaacccgccccgctgtgcagtctagggcgagtatctccaggagggccacaaacccgccccactgtgcggtctagggccagtatctccaggagggccacaaacccgccccgctgtgcagtctagggcgagtatctccaggagggccacaaacccgccccgctgtgcggtctagggccagtatctccaggagggccacaaacccgccccgctgtgcggtctagggcgaatatctgcaggagggccacaaacccaccccgctgtgtgatctagggcgaatatctgcaggaaggggctgtctcctgcaccaagggcgggggcggcacagcatacctggagcgactctgggttaatgggtggagcattaagagctcctcctgacccagctggggcgctagcatggacaccactgatgggatagaatttcaaccagcctttctggaacctgactcattttatagaagaaaaaggaacgaatagaaaggaagacatgactccagtggtaaaaccccgaagaatcttggaaagccacgcttttgaaagcacccagcccaggacatctcacatgaaagttgtggccccgcactctgtgtgtggcagcaggtgcgctgccagatgagaagggcccagtaaccatgaaggaccatgatggctggtggtgcccagtggagtgatcactattgtctggggcagaagggggcaccagggtgggtgcagaggtctctgggcctagagtcagcagctggcagtcctagctctcctgcctgaggtttggtttcctcatcctcaaaatggggatcccagtgcccaccagaaggctgttgtgagcctgaggtgccctcggtggtctggggacagggaggggtagcctggaagaagctgccttgtgatctctgggcaggaccaaagaagctccagcatagacagagtcagcctcatcggctaaaagtacacaaagcaaacaagagaaaacagcgagtttgagcgggaaccaactgggaatcacgttctggaaaaagaaatcactttcgatggtcaggaagaatgtgctggatcgcagtgggcaaggggtccctgaagcagctttctccagctgggcacgactgacggcgggggtggtcactgcagtggggccatcctgggcaccgcagggtgttagcagcatcctcagtctcaactcactttgcctggaataaaccctccccgcattggtcacaaccaaaaaggcctctggatgttgtcagatgtcacctgggggaaaagtcaccccaggccaagaacccctgcagacaatcaccaagctgccggcgtcccctgggcagaggatacccccgaccatggggcctcaccgatccctgtggaggtttggccccaggcccaaggaccacaagaaagggcagcagcctccactaggccaccggctcctgtttcaaaggtctctgtgtccatgccacctttgcagccagcccacggcagcctgagtgacaggcctggctacctcaacagaggaggatgtctgcgtgaagaactgctgcccgtcctgagcacctggcctgaagagaggacccctgggggttgtcccagcacagaaggtgacagccacagactgagacccattaaagaactgggatgtggctggcatctggggatatgggcatcagcaccctcaaatgctgaggcctcaaacacgaaggccgccctgtcctcctgagccccacacctgccgtcccatcccagctcactagccagccacatccgcccaagcctggcccgccccctgtctcttgctcatccctgtgtgtcacatgccattgacccgctgtcccctgcagacggacatgagggcagaaccggtcagcttgttatgggggtggccccacgtcccagagtagcataggctcatgagggctgagccaaagctccctgaatccattgggaggccttgaggggtgaccaggctcatgccagccctgcctcgaattcccctgctgtagacataagttctggatgctccattctttgcccaacaagagcagagtcctctctctccctccagccatggcccccgagccctcctcaattatccgaagtgggctgattcccactcacaacgaggccctgcccagagtgggatgcatccccccagccaaggaacagaggatggagatagtgtcccaagacagcatagcaggtcagcagcagggccaggggccaagccaggccacacaggccccagtgcccactgtgtgggaagccacaccccacccgtgccccccggccctcagcacctactgtttgtgcataaatacaaactctgtagggtggggggtgccttggtcctccctataccccatagcccctggagggcaggtctgggtttaggggagctttgtaaacatttcatggggtgaaactgaacttcatggggacagaaaggcgtgcaccacactctgctctcttcccggctctcgccgtccttgcacggcaggctgtggtctgcgtacctacagcgatgccctgcatgatgccagccacaaggacccttccctaggcaaacgaacccctgcgtcacggactgtgaaccccgactgcagccctcctgaccctgatgtggggctgggggctgacgggaccacccagagctgcccacatcttacacaacccagcacacagccagggggctgaagaaaggaaggtggttggggctcctctctgcagaccagaggcatggaaggagggttccagatgggctcagggtgaggcccccccgaccatgtgaccagtcggagctggtcagcacccagaccttccccatctcctctttcaggccctggagtcagctgtgtgcctgcccctctccgggtctcggcttctctctctatagaatgggctgggtgaggggtaacccgaatatctccactcttgcgccaaactgtcagaatggcataagaacatcctgttgataacggcagcaacaatcatgtgttactgttgttattattttgaaccgcagcagcaggccacagtccacaagccacgtgccttccatagtgacttcatgaagcactcggtgacagaagctgctcaacagtagaatcattttgcaatagaaaaagtgtgatgccctcctcaggtctaattactgtaagcggggatgatgtagacactcagtaaaacatactgcagcctcagacaatcttaaaaagaagaacaaagctggaactcacactgcctgatttcaaaccttactacaaagctacagtaaccaaaacagtgtggtgctggcataaagacagacatacagaccaatgggacagaatggagagcccaggagtaaaccctcacacatatggtgaagagatttcaacaaaggtgctaaggccactgaacagggagtgggtggtcttttcaataaatggtgctgggaaagctggactccgacatgcaaaagagtaaaattggacccttacacatatataacaacatatacaaaaattaactccaaatggatcaaagacctaaaagtgagacccaaaaccataaaactcttaaaagaaaacagagggcaaagatgtcgcaacattggatttgatttcttggctacggcaccaaagacaaagtcagcaaaagaaaaaaaatagacaatttggacttcatgaaaattcaaaagttttgtacatcaaaagattccatcaaccaagtgaaatggcaagtcacagaatggaataaactacttgcaaaccaagtatctataagggattttatccagaatatagagagaactcctaaacctcaacaccaacgaaatgattcaaaaatggacaaaggacctggaatagccgtttgcccaaagaagacatacaaatggccgatgtatgtcttcttgggaagatgctcagcccctctcaaagagggaaatgcaaatccaagccacactgagatagagctcctcacccattaggatggctgctatcagaaaacagaaaacaggccaggcgcagaggctcatgcctgtaatctcagcacttcgggaggccaaggcaggtggatcacctgaggtcaagagatcgagaacagcctggccaacatggtgaaaccccatctctgctaaaaatacaaacattagccaggcgtgatggtacgtacctgtaatcccagctattcaggagactgaggcaggagaatcacttgaacccgggaagtggaggttgcagggagccaagctcaagccacttcactccagcctgggcaacagagtgagactccgtctcaaacaacaacaacaacaaaaaaaaaaaaaaacaaaaaacaaaaaacagaaaataggtactggtgaggatggagaaactggaacccttgagcaccccactgtgggtgtggatgagaaacagtgcgggccctgtggaaaatagtatggcagctcctgaaataattaaaaatagaactaccctatgattcagcaatcccacatctccgtgtatacacaagagaattgcaagccaggttttaaagaggtatctgtgtttctttcttttttcttgagacataggttctgctctgttgcccgagctagagtgccgtagcatgatcatggctcactgtagcctcgactgcctggcctcaagcaatcctcctgcctcagcctcttgagtagctgtgaccacaggcatgtgccaccacgcctggctaatttaaaaaaaaaatttgtgaagatggaggtctcactatgttgcttaggctggtctcaaactccacggctcaagtgatcctcctacctcccgaagcgccgagatgacaggcatgagctacggcacccggcctgaagagtccttgcacgtccgtgttcacagcagcattactcacaactgctaaaatgtggaagccacccaagtatccatcaatgggtgaatggataagcaaaatgtggtgtgtgtgtgcacgcgtgtgtgtgtgtgtgtgtgcgtgtgtacggttggtgcaaaagtaattgcagtttttgccattgaaagtaatgggccaggcgcagtggctcacacctgtaatcccagcactttgggaggctgaggcgggcagatcacctgagaatgatgcacagagcctggctggtgtgagggtgggggtgcaaggagaatggggtggggggcttcaaggcgtggctgggatttgggcaagtggagctggcaccacagaccctgggctgaaactcttaggacaatgtgcggtacacagaccactcaggagttcgagaccaggctggccaacatagtgagacccccgtttctactaaaaatacaaaaaattagcaaggcgtggtggtgcatgcctgtaatcccagctactgaagaggctgaggcaggagaatcacttggacccgggaggcagaggttacagtgagccaagatcgtaccactgcactccagcctgggtggcagagcaagactccatctcaaaaaaaaaaaaaaaagaaagaaagaaagaaagtaatggtgtgatgcttacacaacattctgaatgtacttaatgcactgaactatatacttgaaaatggttacaatgataaattttatgttatatatatttaccacactaagaaaattggaaaaaaaaataaaaacaaaaaacatgttccaatcacgctgaactgatgtttccaggaggtaaacatccaacacaaagcccacgcaccacgtagctccttccgctggtctagtgcacgagaattctcaaaagcccaccatgaagaatccaggacagttaggaaagcagcctgtgcctcactgccactgggggccagtgaagatctgtggaatccctaaactggaatttgtgcattaatagccctgatacctttagagcatcttgaacaagaaacacaaagtgggcaaagtgtcacactgaaatgctgagagacatctgaggacagggggcgtgactggcaaaactgcactgtttttaactgagaaggatttcagttccttatgaagacaccttcactgcttcccgaggtgctgtgtcgcagccattcattcattcattcattcattcataatgaataccgagagcatctgacgggtgccagtcccgtgccaggcaggacgagaatggcggaacgcacaccttggcgccagcccgcaagagcatggactccagtggggaagggagtcccccttcctgagaccctgtggagggactgtgcaaggcctagagagtgatgcacacggcctggctggtgtgaaggtgggggtgcagggagaacaggggaggcttcaaggtgtggctgggatttggacaggtggagctggcaccacacacacagaccctgggctgaaactcttaggacaatccgcggtgcatggaccactcagcccaaagcagtgaaacctcgtgtcaccccaaagctccacagggaagcatctcagggcttggggggtggagacagcctgtggccaagtggccagggagggggctgggcagactggagcacccactggcaccttcaagggcggctgggacaggcttactcactacccaaaaaaggtgtggaataaacaaaagaaaaacaaacatgggagaatggaaagagggtgctccaggaaacgaggatgcccctccgctggagggggtgtgcctcactggaggacacacatagccaaggccctgcatgtcagagtgtggaaccagcaggagccacggccagcactgcccaccccacgtggaggcttcaggtgtgctcagcgttccccgaaacggggctccagagcctgctcccgggggacaggctgcaaggtgggcaaggtgccgattcagggcttcttgggactctgaacaggtgggcatcctccaccgtggccccaggaaccgctgctcccttgggcagtgccattggccacgagaggaagtcaggcgcatcttttttggcttgttttgtttttagcaaacctaaaagcctgaagagccactgccagtccattcagttgcttattgcctgagaagcgacacaaccgaccaggctcccgggcgatggggacaaataaaaatgcccgttcccattctgttctcagctgcacaaaccagcacatggccaggaggaaccagcaccagcatgacgtgggcttggtccccgtggtggccattctggtttcacatatttttaagtgaaaagtggatgcaacatatttctaaattcaattaaatacataaaaagttaatttcccataaataccctcagagagcaacaagatctatataccatcttcatgcaattgtaatcaattcaaccataatctccccttacaaaaggcacagaaagccttggggcccaggacacgtggttccatctactaagccaacacgtggccccaccagagagactccaacagcgcctgcaggtggctgcttagcctgcaaacacaccctggcaacgacggggagctcaccccttctcgggcagccatgcctcctatgctgacatctcccaccctgaacccatgcctctggaatgtgaggatcttgcatttcttcatagtcgtcttcttcctttcggccctccctctgccctttgagtctacctgccctgagatgtcccctgaggacagttgggtcccttatccactgggttagggctcctccctgctcagttatttgaggagagtctgctatgtaagcagctctcctggccatcccacgtctgtgcacgatgctcccctcctctgccctgctcagttaggacacagggatggggaggtggagtctccacaggcaaactctatttccaccccaccgtctgcatgttgtcaagtgctcggtggagagcttgagattcccagcccaggactggtgctggcttctccaggcccccactgtctgctaccagaaatggggagaagactggcagaaatgagatctaacaggaaccgttactattccgagcaatgccacttgccctgcaaactcaagacgtccagccgagtaaagaacagttcggtcagcctcatgcgaaaacgactcaggcagaaacctgacagacgtgtgaacagacgtgtgaagcattgtaagctttaaaagcacgtttacgatcataaaaataactgatgcccattgtagaaacttttgaaaatacctaaaagtatacaaaaaatataaaaattaattataaactcgccagccagagctaaccacaattattagtctgattatttcctcacaatcccatttctgcatatttaaacaaaactgggatcatccagtacacacatttttatatcatttttgcctaattttacgtggtaagaacgtttccattgtatgcactaatccgccttctccaggattctagtacagggaccttccataatttatttcacagctccctgttgtggggcagaaagcttcctaaactttattgtgaaaacaccacaatgcagtcttcattcataaattatctgcatttctaggtgcttaggagatattcctagacagagaatgtggattctgtgtgcaaactaaggccctcaccgtctgctaccagaaacctcccacaggacattttggcaattgcttcctgggaggcccatcttcgcttactccactaggtcagagaaggccaggccattgcatgttttctgttctgagagtcagtttacggctgaccattgagatgagcactgcaataatcactgtctccactggcaaatcctgtgatgtgctatcaggagaacgctgctgacacggccatgccagtctgttctgtgaacttttccatatctttcattcatttgataatccattagcagttagattttgtcacatttgtggcaatattagtaaaacggccagagtggtctggagtgtggggagtccttgcaggtgatccccatgaggttacaaacaaggagaccctcgggctgtgctcagacatttcagaatgatggagtttcattccttgataggactcgatgtagcataaactcagccagagtagagtgggaagtaatctggacatatccgatgctatgtcaacatttgtaggaggatggtcttctttattttttatctttatttttatttatttatttattttgagacagggtctggctttgtcacccaggctggagtacagtggtgcgatctcagttcactgcaacctgcacctcccgggctcaagccatcctccaacctcagcctcccaagtagctggaactacaggcacctgccacccacacccaggtaatttttgtaatttttatagatacagggtttcaccatgttgcccaggttggtttcaaactcctgagctcaagcaatccgcccacctcagcctcccaaagtgctagaattacagacgtgagccaccatgcccggccaggaggatggccttcttaataatgccttggaaagccttgttgacacactgctgatagatattaagatggaaatagaatttggagcaaggacattcaaatcagtaatgcgtctggatgggcagaccctagacccagtccaaggaggcccccatgtcagacgtggagccccatgctttgtccacgagagagggccacagagcaccatggtgccatcaaggtggcatcctcaaaatgcacacacaagtgattgttctgcacccaactctgagagttactaagttgccacagaaattagagaccacagaactatggtgtgatgtttgttttaggtgtcaacatgactagattaaggaatacttagagaactggtcaaacatcatttctgggtgtgtctgtgagggtgtttccagaggagcttggggtgtgagtcggagcacactgggtagggaaggtccaccctcaatgtgggtgggtgccatcattggttaggggcccggagagaacaaaaacagaggaaaggtgagtgtctccctctgtctgccggagctgggactcttcctcccctgtccctggacatcagaacttcaggctccaggcctttgcactctgggattcacaccagcagtcccgtaggtgctcaggccttcgccctcagattgaggattacaccatcaacttctacagttctgaggccttcagacttggcctgagccgtgataccagcatcccagggtctccagcttgcaggcaatctgtcatgggacttctcagcctcataatcctgtgagccaattcccttaacaaatccccctctcatatatctatatctatatctgtctatatctatctctatattaacaaatccccctctcatatacctatatctatacctgtctatatctatctctatactaacaaatccccctctcatatatctgtatctatatctgtctatgtctatctctatattaacaaatccccctctcatatatctatatctgtctatatctatctctatattaacaaatccccctctcatatacctatatctatacctgtctatatctatctctatattaacaaatccccctctcatatatctatatctatatctgtctatatctatctctatattaacaaatccccctctcatatatctatatctatacctgtctatatctatctctatattaacaaatccccctctcatatatctgtatctgtctatatctatctctatattaacaaatccccctctcatatacctatatctatacctgtctatatctatctctatattaacaaatccccctctcatatatctatatctgtatctgtctatatctatctctatattaacaaatccccctctcatatacctatatctgtctatatctatctctatattaacaaatccccctctcatatatctatatctatctttatattaacaaatccccctctcatatatctatatctctacattaacaaatccccctctcatatacctatatctgtctatatctatctctatattaacaaatccccccatatatctgtatctatatctgtctatatctatctctatattaacaaatccccctctcatatacctatatctgtatctgtctatatctatctctatatctcctattggttctgtctttctggaaaactctgactaatacctatgggtttgtggtttttttgccctggacaggatagcacttaaagagaagcagaaaagcaattgagaacccaatgtcttggggatactttttggtgtaagtgcattgtagacacagccctttaaggggtctaacatttttctgggatccaagtgcatcttggtaccatcccctcaagatcaagaagagagcctgagtgtggcaacaagactctgccatgcacgctgaggatcctgatggccaaagtggactccagaattacacacaatatgccccagaagtgatgaatgcactcaggtcatctctgagaactgggcccttaaatgacatatagcaagtagccccaacagttgacttccctgtctggggccgcgactgtgagcgccctgagggcaaggccatggtctgattctaacttgctcttgatgtctgccctgatgcctgacacaggccaacaatcagaagtatgctctgaattttataaaacgaagtcttctcattctttctctattggtcttggtaacagcaccaatttgagcccactggttatttcaacttaaactgttgctatcatgaagcaatgcctgctgacctcaagctccctgagcgaccctgtgtcctattcttcccaacccagtagaccaggcaggagggaccctacagggcctagctgggtatctggagtgccctggggtcctggtacccaaatgtctccatacacactcctggcccaagatgtgcagatgttttcagaggtgaccaagcctctgaacctggcggttctctgtggccacaggctatgtccagccaccctggagagctaggccagccagaggaagaagagagggcttggtccgctctctccttatctctcccagaggagcagaggtgagggcaatgaaggacaaagcgggccactctggcaggcagttacacacacggccagggtagaagcaccccctccacacctggaagtcatttgactttctaagcaacctcttgggaagaaggtattattgttgctttcataactgtaacggataaaatgctaagacagaggccttcgtggataacccacttctcacattggggcattcattcctcaagctgcctagcctgggaggcaatccctggcagccagccctcacccctgcaacaaggcgacaagggccacttgcttggcatgtggcaaagggtgcccctgtacatggcagagcggccgccgatctgagagtgccactctgtgaccaatggctccctctcagaaaggtgaaaggagtgctctcaaagcttatatttatttgtcaccttcaaagttgattcccattgcctaaaagatcaatacatcaccatttccaagggcaggacagacagtgatcaggatggtgagcagggcagggggcacatggtgtatgtagctccacgtgcctgtgatgccatccctggaaaaatacttcttgccacgcaattttttttcctgcacattttgcatttcaaaccacagaaacaaactaaaatgtgggaaaccatcacttgttcaacaccacgaagttacagaaggtgcacaactcgctgacagagccggcatgtgaccaggcaggaggccgagcttcggaacaattaaaaccagccgtcatcctcaaacaacccagccttcacctataaccaaggcaaacaaacttcaaccatttcttttttttccttttttttttttttttttcaatttcagaatgctcagtgtagcagcggggctgggatgcatttcactcttgactgggtacagtgagattgctaatcaggattacttgattcagtcaacactgatttcaataaaaagacccaaaaattatcataaatatagagaaagtgcgggcggcagtgacaggtgattaaaatctcattcgcttggaatcagcctgattgatggacgtggaggagggtcagtcctgattccgccacggtgatcatatctgcctctctgcagccacttcggagcacacacgcacacacgtgcacccacacacacacatacgggcaccaagtagatccacaaacagcaaaccgcaggggatgcggcctctcgaaaaacaggctttgaataataactgctgcgaattatgcctggcaaggggtaaggggagctaatttggcaccagacgagctgggacgccccgagtatggggaggaccagtgccgaatagaaacatttgttgaaaactcagactggcagtgtgcatttagaaagatttcaagggctcaaaccagcctgcacagcagtatagatggcattcgattagagctaaagtgattccttgaaacacaaaagaaggaaaaaggatcttgaagccctcggaagccgctgaggctcaagtggtcccttgagctggaagggaatcccgctcccagcccagcagcctctgcaggcgggtgcccgtgcaagaggcacaagcgtggctgaatgtttcctaaggccccataccaaccttcactcgatgtcctctattcctttcatcagccagaccacaggggggctcctctgtgatctacagcagggtcagagcccacccagagtgagtaaggccctgcagggcaggccaggcacccccaacctacctcctcccagtactgcccccagtgccaaacactgggcctcagcctggccacgctgggcgccagcacctgcctctcccctcctctctgctcagccccactctctctcaactccccctccagcagcttcacggtcccagagagaaccatccgggacacagaccaaggccctctgctcctgcgccctgtccaggctgggcttgccagatttagcaaataaaaatacagggcacccagttaaatgtgaatttcggagaagcaatgtccctgcttctccaaaattcacatttagctgagcatcttgtattttgccaggcaagcttaaccctgactgaacatggcacctcagggcctagtattaatatcccccctctccagcctcctcttagtccttgatccattgcctgaagacatgcccctccctccacccttgaagaccccagagaccctccccacttccaggcagcgacatcacgctccccagacactcagagcaaggccccccaccccatccacattcactgtgggtccagcgggtactgaggagatcctgggctccatcttcactagcaacttggggtcaggcgtcatctgtcccttgcacatagtaggtgcccaataaataccagtggctctaactaaggcacctcgccgcacacagggacctgcaggtgctccttcccgggtggctcccccaggtccccctcctgcttcctcatctcagggcccatgtaaatgagtcgctctgggtaattgtttgactattagctcatttgcatactattaagtggcatgcttagcggtggggctgggagtttctaagttcactccccctcatttccctccaatttccagcccattccctcacaagctcctgctccagttgggaagaggagactgaacaaaggccagcaactccatgggcgccaaattagctgccaggtgacaggcacgatttccacatttggatctgagctgctccacccacagtcaggcctgcagtcacagacaaaggtcagtgctcaaagaagcccaaattcattctctgtgcagagctgggccctcgggaaacttctagaaccttctagagccctctggcacactctagaacccaaagcattctgggttgtcaggatgaggtctggatcaggaagatggtgagctcaccttgaacaagggcctactgtgtacctggtggtgatctaactagatcaataacaagtaatgtttaagataagtacatcccaaatatctcatgggatgtactcatcctaacacattagctgtagctggtggtccggttccctaagaaccggaccctctagtggatcatgatgtggatgcattttcctgtctccactccagccaaatgtagccacattgtgagctgcttctcacaggggagattcttgaaggtcccactcgcacctgtcacagcagccactgtggcccatggctgtcccagcacccagagtggagttgggaaccaggcttggatctgcccagtgactggcggcctgggaccagggtggccctgccttcccagctctccggtggggaaggtgggatcctgtcctgcctggctccagcagaaggacccagtgccatcattctgaccttccttctgtgctgcaaactcccaccaacgggacctccttgaggacagagcagctgccaattcctgtgtgaccccaaccctaagaacaagcctcccaactcagcgccaactgcggagcaccaagcacccatatgtaaggcatggggttagatacatgcaccccacaaggctggcgggcagcaggcggtgcctcctgatcagggctgctcatccagagcccagagcctgggcgtccagggcacagacagctctcagccaccattcctcctacgtcagcactggggagtccagaggccaaccccgcagtcactgctgcacagaaacaaagactaagcccatctggagcagagcttggccctgccacaccggggcctcaggcaaagccaagggcatagaatgtgggctggggacaggagaggccaagacaccaagagcggccacgatcagccacaggcaggcatggacaaaggaatggccggggaaggcagagcccaagcagccctggagcaccagggcccctcctccaccatcatccatcggggggcttcctgaagctgccccccccgcccaacaatgcagctggtgcccagggctgcgagtcaacggcggcaggtgcagatggttctgggggactgtgcagagcagccacatcaattacaattgctgcaattattaaattatagaattatatagaattccatttatggaatgatagaaaacattgcgactgactctcacacccacctgacagttataaagtcccctcccttcacctgcaaggtctcagtcctctaaaagtcaggcccagggaaggtgaggactggtttgaggtcccctggcttctaccaggtggaaccaggacataacccctgcccagcccaccaccccctcctgtctctggctcagagtcatcctgaggggcaggaaggccagtgcatctctctctggggatgatgccaaaggctgagaggacagagcacaggagacaggctgcccaggccccggcttgctgagggatgggagaggcccacgggaagtagggctggcctgtcaggggaccctcggcctgtgtgaggacccaagggctatgcaggggaccctcagctgtgtggggaaccaggggctgtggggggaccctcagctatgtggggaaccaggggctatgggggaccctcggtctgtgtggggaaccaggggttatggcaggggaccctcagctgtggggggaccagaggctgtgtaggggacctgcagcctgtgtggggaactaggagctgtggggggaccctcagctgtgtggggacccagggggctatggggggaccctcagctgtgtggggacccagggggctgtggggggaccctcagctgtgtggggacccaggggactgtgggggctccaaggcagggaagcactgctacaaccaagtcccccacagggaacctcagacacgaacaaatcaaggcaggagggccatgctttggccaagagagttcctaattcaacagaagcttttgcctccttgatgacctgggctccacggatcggacgtgtgagaacaaccctcagtcacccctcccgcgacagtgcatctcctacgtgatgcatgccgagtgccaggcgccagccagcttcattcgggccccaagggctgcagtgaggaggagcccagagaatccccaaaagctggactggctgtctgaaagtgggacagcaatcgtgccgggaacaagatccctgagtctacaactgggatcagatgggtgggacaaccacaggccgtagggggccgggtcgacaagggaaagagcctggggttccggggcgcacagagacccctagtttgagcagagggcaggatgatttagacagcactgcccagctaaaggacagaggctcaggacaccccaaatctagacaagccttccctgggtgaccctgagtgggaatacgatccttgagaacagagaggccccagggacctcaggtgggaaaggctagtggtgacagcaagaaaaaggagcaggctttgtcacatgctcctgccctcaagacacaccagcgctgccccaagcccacacaacctgtgggggtctgcaagcccacctgtccatccgcacattcccattcaggcagctacgcctgatcacaagggcttacgagctcagcctgcccacaactgaggccatgggaaagagaaccactgtccagtccccgccccgtgcccacgcagcaccagagacaccgctggggactgcaggtcacatctgtgttcctcactgatacctcatctcctcaccatggcccacccccaggccaacctgtcccgggctgtccctggcagccaaggggagcagctctaaaggagttcaagtcctctccgagccacactttccccaagacgtcactgtgcttgacaactgctgaggaattcccggggaaacattccatcccagcatcttataatattccatccccctaaaaggtgaagcatgatgaaaactcacattttttctaaataatggtattttcttttaagtaggcacatgggtacactttcacaaaatgcattagtcaaaatacttcgaaatggtacaagctattttctggcatgttcattgacatcacatacacaatcatactccacaaccacgcaaactgtaaagagaccaccatgtccttcagcagcacctggcaggagactctcttctgctcctgctgagtttttgtgcgaggctagccccccgcatgaggcttcatcagtgagcccctctggtacacagactgctctgttctagaacggaaattagtgggtttttttaaagttcatggcggggccgggtgcaatggctctcatctatagtcccagcactttggaaggccaagggaggcagatcacttgagctcaggagttcaacaccagcctgggcaacatggcaaaaccccatctctatttaaaaaaaaaaaaaaaaaagacaaaaattagccaggcatggtggtgcacacctgtagtccctgctaccaggaggctgaggtgggaacattgcttgagcccaggaggtccaggctgcagggagctgtgattgtgccactgtacccagcctgggtggcagagtgagaccctgtctcgaaaataaaataaataaaagtaaaaaaatagaagttcatgagggaaaagaagaaaacaatttagcatttttgatgggcagcccaggcaggcacgagcagaacgctcctcctccttggctgttgtccacgagaaaggtgcggctgcaaccgacgagcactgccttgtgtcctgggacctggcctgtgctccaagcaagtcaaggccattgagtcaataggggcaagatgttacatgggggtcttcgtggcccataaaaccaacctggggaaagagaacagaactttggggcagaaccaggaagaacccactgcaggccttctggatccagtcagactgccaaggccaaagtgaccagttggcatctgatgactcaattatcccaactccatcctttaaacagctcctagaacctctgacctgtcccaaacaaataaatgagggctcttgatgtctttctttttcagaggaaacaccaaaccactccactgcacaaaataatctgaatctcaagttcattacatttcagaagcaaacaatcccacccacccagaaggtgcccctgtgtgtcctgtgcgtcagtggcacacacagccttcaacttctaagacctgcctggagagcagagcagtggcagccaaactgtgttcgagcacactctgggggcagtggtgtcagtgctggctggcagccctggccctccttcctgccctccaccctcccctctcccaggtcaaaagtatcctgccacttctcaagggactgacaaatacgaaggacagggtgaaatctgaaaacagcatgatcatgccagtctacataagaaactccagacttcatcaaaaatcaaaccaaccaacaatcacattaaaagttcccactgccatcagctgaaacacgtgaccgttcctctgggcaatgttctgactatgcagatctcatttaaagacttggggtttttgtttttgttttttgttttggttctgttttctttgttttgccaagcgtggtgaggaaacagttcaagggaaattcaaacgacagctgcccactctgccacaacgtctgcgtctcctcctaatgccaccccggggccatcattctgctcctctgctatgcagacttcgtcagactggacactcttcccatgcttctcagcgatcaatggagttagaattcccacgtggaaccagagatcccagagtcaatggcaaacttctgtcacacgcaagctaataccggacttcgtcttaagttatttatagcccaggaaaatggaaccgaccttacggttgcacttaggagcaaaatctttctagataccacgtcctgaggacttacgaggagttatgctaagacctgtgagagcctctagtgctagagggtcccccatgcccctgtggcccacgtccccctctagaggtaccattcctggcagcttcccctctgacggggatgtatcagcctcttttccgagtacacaaccccgagggcccactggtgtccaacaggcaaacagggcacaatggcgtgagctcacctgtgggtcagactcaagcccctgcccaggcacacatctgcactgccatgtcacacacacaaaccagctgcttccctgcacaggcatcctgggctctgtgcgtgcccacagctgtaggtcaggagcagccttcccctcctcctcctcaccttgcaggccctaccctctgacctgtcctcacaaaaccccacgcatttcaagaaagccatgagagaaggggctcatccagctcagccctcaaagctcaaaggcagagccccctagccctctcaatgtgagccccctgggcctcctgggctagtccaggatggggtcttcaccacctgcccagccccaggcacagaaggggaaagaataaaggacccgacagcctggtttcaaatcccagctataccccttcccagctgagtgacctcaaacaagcttctcaatgtccccaaatctgaggaaatgacagtcattataataagagggctgtgagaggcataccttgtaaagagccccatgcttagtagcacttaaaaccatgagctgctgttatctctactgtgggcgggtgaggaatgatggcatctgcccctgccctcctcctcacacctgctaggaagtagggggctggcagaggaagagcagaggtggcctcaggagttctccaggccccctccccacccaggggtggcccaggatgccaggggaaccgcgggggagtctgggcatgggaaggcagagggcaccgcccaccccggaaacctgtcaccagggctgccataaacatcccacactcgatcctcccatgttgggccacagcaaacaggactgcagcgtaaaaccaggtaggtccccggtcccccagcctcggactgcctggccgtggagcagtcccatgtctacaatgggacccaccccagcagtgagcaagacctgctcttagagcttcccaggtcccaggaacacgtgagggagagcccgcccactccctgaatctctcttggaaactcagtgacaacatgtgggaaaatgcgtttattttaaattaggaaagtaaaacatcctacctccatagtagattgagataaataaccactaaattcagcctgttggcaggcatcaagttcaagggacgaaagaaacccatgatgggcttagcgagacttagcaaggatatcagcttacagggcagcaaggggtgtcagatgagccgggctggagctccgcacccttgctcagaaacacaaggcctcaaagcaggtggacacgtgacagggacaacacaaatgtctgttctgccccggtcatcacaaaaggtgtgccaggcactgaacgcctggaggtggcccagcagcccttcttgaggccttgcttctaggaaacccaccacccggggacagtgccaagactaggccacagaggagaggtgctgggtgagcactgggcactgggagagaggagactcggccacagactccgggcaggccaaagggtcaggggggagccctccaggcccaaagcgctgggcactctggcggcggtggaggtgagcaggcagaggtggcagtgaggagatggccagggcagtgagcagcgctccatccccagggcctggaggccagagaaaggggcaaggcagaggcaggaacccctcaaggaggcagagcttggggacaggaccaggctggccttccagaaggcttcctgagtaatgcagtgccaggcctgggtggagctaccaaagaagggctctgcagaggccaaaactgccaagggcagacagcagccatttgcggggtcatcccagggccaggtgctgggtgagatcccaatccagacccacaagggatgacacagggagcaaagtgagctcacaggacagacacacgaggacttggcagttccttgggaatggagcccccccaccccatttaaaagcagtggcccaagctgttgacccctgtgtccccgcagccaggagaaacacctcctatcctcagggagccccgcctcacccactcagggcaccaggcctctctcagcatggacggctccctgcaggttcttagcactaactgattttcatttacaagagcttttaggaagataaaaattgtgcttaagttttgaaagatcatcgcagcttttgagtgattttaggacatttccccaacaagaaaacatctttctagggtggtccaggacccttctttagccctgtggacctgcttcccaagacagtaatataagatgcattgacaaaaataaacccccaaaatcacaaaaacaagaagggtgctgaatactgacgctgggggaaaggcctacagttaggtaaatgccaaacaaaacaaaagcaaatcagtgtcaccactgtgttcacctacccagagcaccagccccagtggtcctgcaagagcgtcccacacgctgtagggacagctgtgcagccttcatgagctcagggacagtcaggtcaaacccaaacagcaaagcagacaactcgggccccggggcactggggaaaattggggactaccacgtccacacagggtgcattccagagatggcctctctgctcttttacgcatgccacgatcacatttatttcttctaaataacgcctgcctgtctgccagcgtggtgactgcattggaatgtaccatcagtaagatcttacttttaaatgaaatcaataaaaaattgtattaaatacttacaactgacttttaaaaaccaggacagactctcctcccatacaaatctaaattggggtgggagggacagaaattttctgtgcagaacgctcaggtacaggcgtttgttttgaagccagttgccagatcacgcgttgacattaattcagcagacctaggagcaagatacattctaatttacagcatgcacttatgtactgctttctaatgggtgtttttctctggattctaagaggaaggtagcagatacaaccgattcctgtcctccattctaaaccactttgcctgcacgatgggaatgactggatcactccaccggctgctcaagaagccaacaacttcctccacataaacaaggcccgccagagccagagagctgccaggcagctcttcattggggccaggcctgacccggccttcccagttggaggggatttcagcggctctccacaaacaaataaacagcaaatacttacaggagacagccttgtagaactgattccttaatcaacagttaaagaagcaaattggatttgccctatcacaaaaaaaattaattccagattgtagttattgtcttaagcacaagaaggttgtcttataggcttggctggataatttcattttaaaagtatcgctaaaatttgatgtcccttgggatttgtggttttctccatcattatataactgtaaacttctggaggttagagattggataatttctttcagctggacctggcctccagcgcacttggatgctagggatgagcctcaagtggttgccaggagtcgccagccgggcttgggaacaagacaggtccccggcgtgcacatccaaagtttgagtgtgtgagacttttcctcatttattttccttcagacattttttttttacctctgctatgaattaaaagaattgctaggaattcttttcacaggctgcatctatgctagccaatgaaaacaacacagaaacaaagattcagtctctttaaggtttttgggcttgatccttttgagcagtttttttctgtgctgagctctctggaaccatatgttcagcaacgttatggagggcgctggccttcggcgcagacccagctgaaaccgtaaaatgctcggtaaaaccagtcgctctgagggtgcagcgcgtgtgtccatgggtaaaatatctccccagaccttcccaccctatgcgtgatttctgagttgattaacatttcatctctagtgttatgttattatcgcctttatgttttaatccattttttacaccgtgggaaaagaaaaatatcaccgttctagtaatcaagttattcctgtaaaatcctaaataaaatgagaattttattaaagatatttatcttatacaacaagaataaaatcaatttgcaaggccggtccggcatccagttacaataacattaaaatatattgtttatttgcgggtggggtcatttctcctttcagattggtcaatgaggggaacaccagagtgcactgccttcagaatattggcttggtggctggacatgcagggaacatttttattgttaatcaatgccaatcaattctgagccttgatgttaaatagggatcaataccgctgggctgcagatgagatctgatttcaattggtgagcaaacctgcagaagtttttaatcataaggtaaatcaagacctggaacataagtcagatgaattaatataggcggtgtaggacctctcttgccactgatccagcagaaggaaatttctgtcatatttcattatcactcttagggtaggctgaaggcagcgtttggggagcattttcttagtggaagctggagcgcccctcacaccacacggtgaatccttgctgcaactgagcctgctggtccaccgagtatagttatacgtatgccccatgaatctcattttatgcgattaagatccataaaaattcaatagcttttcttctgcaattcacattttacctggtgaaatatcataagaatttcattatctttgcagctgttgcctaggatcaagcaaaggttattatcctcttcgaaaacactatagaatatgtacgaaaatgtcaggagaactgggcatttaaagcttgattttttaaaagaaaaacactgtctgaagtttagaataaactgtacttgacatttatgtaccatgatgcatttcttggtaaactgattttgcaaggaaattctttgaattcgactctgtgaccagattgtaaaaggaaaagggaagatgggcggggaggggaggggaggggaggggaagagaggagaagggaggggaggggaaggggggggaggtgaagggaggggcagggaggggaggggaggggagaagaggggaggggagaggagtgaagaggaggggagggaggcctggggggatctggaggcagaagcgagaaaggaagcagagggagggagggggagcaatggcaaagcactccaaaaccaaagctctccccacatcagtctgtataggatttcctaacctttcagataaccatccctcgaagataactcgggagaaccctaaccgattgcgatggtctaatcctatggatcattcaggcccgtttaaagcatttgaagaaaaatggccagtgcaaagaaggtgattgatcagagggctctgtaaatcacacggattccgtacagtcctccggcctccactgctagggttccatctatgatgataaattagcattagatggaacctaatgagtttactaaacatttgggatttgtgctaataaactggctggctgtgaactagcagaagcggtgcaggatcccggagctctctcttatctctgtaacatgacagttaaaccatgcgtccaatctgcgatcaattcatcatccgacaccattgtacattcttcacaaaaagataattactgcttccctggatcagaacactcatatttccttggaattgcaggtatgatagcagcccctgtcaccgctcccttcgagcctcaccatacagctctatttatgatcattattttcgcctaaacaagcctttttcctcaacttgataacaaaacctgctacaaggagaagggaacagttaagacattgtttctctgtggagtgcttttacgtttagtggaggccgctgacaaatattttattcagggcattagtaaaagtttccactcgttagaagatatcgctactatttccttccaaaaaaaaaaaaaaatcctgttcctggctctgatttgttaaacacagacagggagtaagagcagagcaagtaacgtcacagggaataaatcaaaacatgattaaaaagaccgtagccgttttaaaatcacatgcccgcggattccctgcttctcactgctgggccctcggtcctggcctcgcgcggacccgccctggcgactggtcaactctgtttgacccccagcacacgcaataaattaccataacacacaactctgaaacaatgtaaattagttactgctcacagtctaataaatgggaacaaatgtgtttggggctggaatggggttctggatgctgtaattgctgaaaataattagaatggggtctgaggaaacatgagcggcagttacttgtcatgacaaatgtcccgaacccggtaaatatgctgctgaccgcaggactcggagcagccaaataacatttttccttaaagttaaatgtctcataagcctcgctttattcacaatcacgtatgaaagaagtatttttaaaactctaaggcacatctatgtgtcataatattctgaaccaagacaagtttatttttgtttctgagctttctcttggattgttgttggcgtgccacactgcagacgaggccatgcgtcccaggcaagagctccggtgaccaacagaagagggagaggatcagtgcccccacattgtggggagcaggaaagggcagagtctatttttgagccacacaaaggtgcacctctggatggggaacctcaccatttattaacttgcataactcatttatttgttcaaggtaatgatctttggggaaagggctgttatatttagaacctgcttgtcaaatttaataaatgatagtgatcgctggcctccccctctgcaagcactttcccaggtccttccacctttccctggggcctcgctggccggggacctggcagcccatgtcttggtaactgatggcggctgcccagtggctggatcgggccgatgacctcggacagtggggaccagcagcacgtccaatccaatcccccacttgtttcctgacccaatcttcctcgtgtcaggggacgagccgcttcattgagaaaatggaaatggacagggagctccctttggcagcatttccaataaccaaatatcaaggaagaggggccgccgggggaccaccccatcccggcacactgatctgatttacaaacctttcctaatgggaaacaaatgctgtgggtgtgaattcatacttaaccataaaaacccttgcattactctgtctcgtattaaataccacatataactctcagcaggttttatgttgtgttttactgtcagcaatggctaaagctggcctaacattttgtttggcaattaggaaaatttgtactttaatttattaaaccaaaaaagccaacaactgcactgaatgctgaattcattctgttcttatgccacggtgcagtatatttgccttcccaataatttaatcattttccttttatggcctatactatttacatattccaaaatagtattattgaggaaataaaccccttataataagtgaaattgagcaatgccacttaaattctgaatataaagttaaaatgttttcatttctttctttgcaaaggaaccaaatgctttgaaaaaaaaaaaaaaagaagggcaggacgggcaaacttctgaaagcctggtgaaccccactgatgacatccaaacaccgaaacatgacctgctaccttgacaagctcaggagtgaaggatttcacttctaaaacaccaagacactgaaaggaaggaagcagagtgcccagtaacctttaagaagaaaaaaaaaattatattcaaagagagtattatcggtgagctaaaaagtcacaagaagacatgcaggaaacttaaatgcctactgctcagtgaaagaagccagtctgggtgaggcacggtggctcacatctgtaatcctagcactttgggaggccgaggcaggtggatgacctgaggtcaggagttcgagaccagcctgaccaacatggtgaaaccccgtctctactacaaatacaaaaaattagccaggtgtggtggcgcatgcctgtaatcacagctacttgggaaactgaggcagaagaatcacttgaacctgggagaaggaggttgcagtgagccaagattgcaccattgcactccagcctgggcaacaagagcaaaaactccgtctcaaaaaaaaaaaaaaaaaaaaaaaaaagcagcagcagctagcctggaaagactacataatgtatgctaccaactctacaacattctgaaaaagcaaaactagagacacagtaaaaggatccaggggtgccaggggttcaggaaagggggaggggtggctaggtggagcacatgtgaaactattctgcacggcactgcgatggcaggtacgtgccacgatgcgtttgccaaaacccaccagatgtgccacaccaagagtgaacccaatgtcaactgcagactttagttcatattcgtgtatcagcattggctcaggtgtaatgaggataccacaccaaagcaagacgttaacactgggggaaactggggggtggggggaggtggggggatatgggaactcagtactctctggtcatttttctgtaaacctaacactgctctaaaaaatagtctattcagtgtttttaaagcgttatgagaacacctttaaatctgcatcagatgcagaggaagacaaggccaggttaggggtgcctgttgctggtgtggcttcaatgtccctgcttcatgccctgccccccaggctgtttgcatctcccagtccttcctcctgactatgggatgtcattctgcagagccggacgtgtggttcttgacaatgaaaacttggaaaggacacctgcattaatctgtcagaagagcatttaggcccctgccagccatatcccctggtgctgaagttcttacaaaacttaagaggcactcgtgcagtggctcatgcctgtaatcccagcactttgggaggccaaggcccgaggatcacctgaggtcgggagttcaagaccagcctgaccaacatggagaaaccctgtctctactaaaaaaaatacaaaattagctgggcatggtggcacatgcctgtaatcccagctactcggtaggctgaggcaggagaatcacttgaacccgggaagcggaggttgcggtgagccgagatcgtgccattgtactccagcttggggcaacaagagcaaaactccgtctcaaaaacacacacagaaaagaaaagaaaagagaaaaagaaaacttagggggcactcagggaggagcccctccctaaaccagtgagcagcatcccaggctccagtgccaagaagactaagccggctttcctgggtgttacctcaaataaaagggacactcccccatggggcctaaatgaccctgttccaagtgatgggactcgtgggggaacgtgacctttgatgcaggccccatcactgcccagagttggggtgaccctgctagggatccccacatgcacgcctggggaaggcgcacgctgcctgcccatgcccataatcaaatcccgggcttgtactgcacatatgtcaccctcggatggccccagcccaggcacaggcctccagacctgttcttcagcagctccctaacatccagattggccatctctgtgcaagctttctgattcaatgaaaacttagagaaagcgggagggggtgcagttccttaccaaaccattgtggaaacctggactcagctggcaggcctcaatggtcagggttggtctttctccctttgtaaattcatcatcacaagggcaaatgcttttagggccttaaacactgccaaagttttgtctccttctgtgctttaacatggcaccctgcccccaactgctttctgctgagagggacagaggaaaatataggcaggagggtggagggtggagggaggagggaggagggaggagggaggggaggggggcggaggcaggggcggcggctggagctgcctgtctgggcaaatgcacggcctcctctccagatgtgcaggcagctccgtcttccagcagagacacgctggagccgactccttccgttcgcggggcctgggctccatgtcctacaacaacacaaccgcgagccccttcctttccgcacatgttaaactcatttcctagtgaattactgggaaggcgcggctgctgcccccaccaccgtttgcagaggatgcgccccatccactcgggcaccacagccctgcatgaattttgagtattttctagctgagcaacttccagcgaaggaattggagagggatcgttttcatttgtgttgtttttaaggggaaggggaaatgagtgattcaaaaacaactaaaataagagtttccctatacccctccctgcagtgctctctatcgaattgttggcaaatttatagcatttactcttttgacagatatgtctgacctttttctgaaaacatcgttttgaaaacagttttctcaagcttctacaatttaatgaacgctggttaccccaaagtctaagaagcttataaaattcaacaagaacaacaacaaaaaaaaaccccttaacccatgaaattactgcactaatttttctaaatgatagccatatttttattaaagcatgaataatgccagcataatgtctcattatatagagtttggaccacaaacatttttgggagatttgctattaagataaacaaacaagaggagcttgtgttctggcaagctgacggagggaatggttttcattttctccaagtgtaggctgcagaagctttgccaactgcaggttaagctccttgagttttcacttcctgtacccccacttgtcaatcacttcctgtctgcaatgacaatttccatcattagagcttggaatttttatcttcttcaacgtgtctccctttgccactgtttgaattctgataaattattcaccatctttaaaaagtaaccaacaattacagcatcacagtgagccacctatgcctagcaaagatcaccgtcctcctggtctgtctcctaaaggctttgacgaggccagcttctcctgctttcttcggcatcacgagaaggcctctggccagccccaattatcttctggtgcacagagtaattatttgcttcctgtaagcatgcgtaacagaacctcgagtttggacggctttccataaagtaatccaattcacccatgccatcctaacacaattacaggcactgcaatatcttcgctcctcacctgataaggctgccgcagcggtgcaggatgctttccgtcaacatgcctcccagagtatagcttctgacagccctgcttccagcccttgcctccacccctgcacgttcatacccggctgcatgctgctgcagggcctggggaaggcaacaccacgaggttttcacccttgcacaggcagacgggaatccgagttggtggagagtgatgcggaagtcattgtgggtgtgtagcttgttttcaaacccagcccttgactggcctggcggtggagtctttacccagctcaggcagccataaatctcgcaggcctcctaggcctaggccagagatgcaggcctgggcctggtggtggccctgacccaccgcggcaggcgaccacgcaagctgtgacacacagcggaggctaaccgtgcagccggcgtggtgcacacccgcatctcaagcttatgggcagggcaaacctacaaagtgggcactgttcctggcgcctccctctttaaatgaaagcatgccattgtgcctccataatgcagctcttccttttctgtttattttcagaagtttagggggaaaaattgaaaggatgaatgaatgcagtgaactttttgcctctccctactggcgctgccagggaataaaacagccattcacacctgagcccggcgaagccaaatggggccggtgccagccagaatcagattctttgtagccacatccattcatccaaaaggtgttttaatattgccaaatttctagccaatactttcccttcactgaaggcccaatgtattaaaacagaccctgaaccaaagagcatctccaatgcacagcctccgccaagagaggatctccaggaccccaaggcctatccaatgataattatattcacatctttaagaaaactgagaaggaaaaattaacaccaaactatactgttttcattgcattatgcagatgaaatgacaagttgtcatttaagaagttaataaacagtctccgttttgcaggttatccaaatgctactgaatagaaaaccttggatccctaaatgatgtgtaattaatattatttttaaaatcctccttgacaggccggggcttagccaaaatgtaaatgacattaaagaagacaatgaatttaattttatttaatgtccctttttgcagatcctcatttacatagcatttttaacaaaagcgttgaccttataaatgctggcatttgtacagcttcagcagagttggatttaatcacgctcgtgcaaagccatgagggaggaagctttaagttctctgcttggagatggagtaggaataaaaacattgggactggtcaaatgtttatcctccccgcttctgaaaacaacctgacaagaagatgtaaagggctagggaataacccggtgctgtttgtaaggcttggtaataatcatacataatcgtttggaaatatagctaataaaaaatataatgagtgttcagcaaaatcggcattaggcccaaattacacgatattaatacttgaacaggtgcagaaaggcgctttaaatgaggtaaatgaataaaatgtcccagagcacaactgtgtgtgctgacaaaaagtcaatcccatgaataattcagtgagcaggactgccagcaaaggtcggctctctttgacctttgtgacaggaagtgaaaggaaacactgttgactaaaaaaaaaaaaaaagaagaagaagaagaaagaaagaaaagaaagaagaaagacagaaaaaaaaatctccaatcgttgggctaccgttccacagtcactttaaaggtgtaaacttaaaacgcacatatgaatcaaagtatggctgtgcagggtagggggggcgcagagctgaaatgggggtagtcaggtcatctgactaaagacaatgtgaaatcacagacaatggaaggttaagcaaataatatttccctatgacacaacgtcaattacgcataaaaatctgaggtcagctgaaaagtattttcagagcccacaggattgaaattttataacagctgttaaatatgacaaaacttcatcctcccccctcttcaacccccaccaaaactaaagcaattccaaactctgtatgaaagaaaatgggataaacagatgtctggcttccagacaggaaagtaggacagacttggaatgataagtctcccaactctatagactaatgccagattgattggggagggggcaccgcctgccgcagagatgccagcgagtgggacgccggagacggtgccatctggaaccgccccgccgagcccgctcccagcgctgcatggagcccctgcgtgtgcccggcctgcctgggcagccacagcccctgctcccaccacccctacagttggcctccccactttgcaacagttggaccttgcaccttccatccacccagcccaagcaaggagggggagaaaaggagtatacaccttcctgggcatttccagagctccttgggaaacagaccgggatggcacgagcaagtgatgggagccagagtgtggtgttggcttagcagctacaccgacatcctggaatcatttgcagcccttggaatgcacgggtgaaacaggagagatttatctgttcatagttgggatatgtggacaatgggtgttcctaatgaagaccatctgcttttgtgttttcccagaaaacattattccacgaggaaaatgatactcccatccttttcagcaataccattaaaaatcatttgtgtgtgtatgtacagaaggtgtacatgtgtgtttgtgtgtgtgcactcttcctttacttgcatttggttctctgcaggtcacacaatctaccatagatacttttttcctgtagtatctctttattgaccatgctttttactttacaatgttatgtttcttctttgctccgtaagttgttatattattttaaatatactgcatatagttataaccatggtgctattaaaaacttgttcctctagcaatgttttatgagaaagaaaacagttaacataagtgaaacctttgcagtgcatgaaatggttttgtaatgggaaacagcctcacttcccccccccctttttttttctctgaagggtcttcatgccattcataagtatttaatgcttctgaaagataactgaactaaattgtgtaattaattgatttaaggcatcagagtctatagaatgtgattaccctgccagagcgaggagcttacttctctgttctcataacacagaaaggcagtctcaacgtgccgggagaggctcggtgtgggttggaacaaatgtgggcccattgatctcaattcaggttggaattattggtttatatcctcaggacaaatatgccttatctggtcagaacctgctaaatgtatccaaaggccacaaggagccggcaaagcacgttgtatataattcttttttaagccaactaaccaaatgagacactgctgatggggacctggaaactgactccccagtctggtgggacattttattctgcaatactcaagagaaaagacaggctagaaactcaacataagcaactaattttcagaggcaacatacaccccacagaaatgattatcattatgaaactgaaacgcatctcagttgcaaaagacggtgtcagtctaaagagattgccctcctataggtattcctctttctctgattaatctaacttgccctagtgaacactaaattcttcatttttttcacgtagaaatatgccgtaagctggagacagtgccaatactgcaatcatttcacagggatttacaacagacaacacaatgctaatagtactttgccattctaagtgacagctttcttaagaatgctaaaaatgtacattgtatttgtcatttcataaaactaccctcaccttaaaatccctaaaatagacggtgattaaaatttctataaaattgtcatatctttgaatttaggagcagagcagatttttcatcaataattaagacctccaaagcatttatgccaggcgtaaatggagcttcaatcctccttattcaaataaacatggtaaacccattaaccaaatgtttttacgtttttcccctcctctcatgcttctagaatatcaaataatcacacacttctcttaggttataaaaatatgagtaatcttagcacatattttaattaaccaaatataagacaacattcagacgagaattaaggaatatatttctgcatatctggggaaaatatttcccaccatatgatgaacactgagtattaaaagttattcagcatcaatagtcaataaaggattgaatgttgcacaaatccaaagtgattttgaagggaaaacacagcatccaaaatgtgagccaaatcaacatggctacttcatcattgtggcatgctagaagtctcacactttataaacaagtcctcttttaaaatttaaagtatcacacaaaagatgaaacactttcgcaatccttcatttaaagccaacatgcactgccttttcaagcaacttagacaagactccaatagttcaaacacttctagccaatcaagaaaataaaataaattcagttacaagacaataatctaaggctatatgatttccatggccacaacactaaagacagatataattatattgattttcatagttcgagttctataaagtgttgaacttgttctcaattgcctgagtgacagccacaactggtcaaccctatttgattactaataagagagctgtcccttctgtcagataccgaacattctccactaagcaaacagctattccagctagttaaacattagcattgctctccactggtggcgcatatttctttaggcttaactcatggagttttccgggtttaatttttcagacactggacagcaaagttcatgatcaaaagataactttgtaatgaaagctgcggaaattcaacccctcttcaaaaccgtctaaacctctgcttcgcaaaactggtgtcatatgtacacgtctaacatttattcaatttgggtaccaatttcaaaatctgcagtcaatcacacgctgggccttttgctgctacccattgttggaaagaaagaaatcctcctctcctgcacggcaccgaaacccagcgagttgggagagggctgggcgaggagggtggtggtgtttttgttgcttcaactaaagctatgccaaatgcacattagcaccattagggctactgattggtatcttaaaaggatgcagcattgcccaaggaatatgagaaacagcaagatgaagagcagcaaatgtaaagaatgcatacagctaatcgagttatgaaaattaatgttggaacatgtaaccagcatgtgtaattagtttcaattataacaagtttggtttgttagttacatatttgctacttgacataaaacgacagctacaattggaaaaaaattaggacacattttgcaactaattgagagcagattaaattcattctaacgctgggcaacaattacaacagtaacatcacccaagtctcaacttcaactatcatcagagataaaaataatgtaaaaatgaaatacttgttaacaaattagcaaaaagcattttatgacacatctctaggtttaaagccagaaactctctaggcataaagtgctcctcacagcgagagcagtggcagatgaaactgcttcccttgacaactcacaagcaattactgaatccccacagagcgagccaccaggtttccaagtcaacccacctgtgcatgataacacacgcggacaacaaatggtgcaatgcacaagatgggctcgacaccagcctcaaaaatatggagcaactggaaaccaagcaaggcaaaacgttttgttgctgctgcggttttgttttgaaaaataaagaagtcatccttacctgtcaatgattacagggtctgagggcgtttcgtttctattgccacaacttttcttgtcacagcaccggctgtggagcaattgtaaacagtggttttaatatgcatttcccccttttatgcccgacttgtatttttttttttttctgacgtctgacaatgaagcggtaggagtcaactaccaaggcagtttggagaatttaaacccagtgagttcacgtgttctgcggctaaacttacgatgtaactttctaccggaaggagcaaagttgaacctatctgttaataccaggagggtaaccagagtactatatagattgtgatgctaaaatatggaaaacatgttgtcggtgtttgtctttgcaatgaactgaggagaagggaaggcaggaggcttgggaataacttttcacagcttcggcttttgtttacctctaattgtcaagctgttatttctggaaaagatgcaagatgccaccttcaaccaatatttctttggggcatttattaattataaccacaaaagcatgcatccatctatcacaaacttctattgttccttctttaagcctaccttaactctgttattgaaactttaattaaagcagaaatgaaacaaaaatgttatgcttcttgcattttaaaaaagcatacttgtataatggttacatgtctaaattagctaaattaacaccatatggtaggcaaagtatataaagccttttaaagctgacagctaaagtgattaaagaaagtctacagtcttccacttagagcttaaatcacatctgtgcgctttctatgttaattgcagtacatgcagaagtggataataaagaaattccactttattggttgtaatttatatttattacctgatatgagaaaaagtcagcttttgtatattagtgctgtaacaatatgtctgctcagaaatggcatttaggcaaccggcatcatagccaggcggagtatgcccctcagagtatgcggcctgctactgtagcctggaagcctgcaacgctttccttgctattccttgcaactatatttcacatgccacacatacaaagtcaatgatgcatttttatttgccatgtaggggtgaaactcttgtggtagttagaaaaaacaggtgggaaattgctcttctgacagagatctcaagtaacgggcacgctatctaacaacgacacgaacgctgcatcgctgctctagggaagaggttaactgacagaatcacaatccaattctcacatacacgcgcgctatagtaagtacaaaagagtttcctttttatcaataacagacaattgtatatctcaggatgcgagcgcctgagaaggaagtagtaaaatgattccgagtgatccctgactcctccggcaccgcggacggatgcatcacccagacctgttttcatttttgactacactgcaacgacacggcccacatattaatccgctctgctgagcagcgggtcgcgttgatcgtcagcgctggggggaaggagcgcgggctcctccgcggcccggcgcgcggcctcgggccgattacatttcaatcgatgcccttcccggagctgggcggggtggcggcgcctggacgcggcgtcctttgtagacgcagctggcgccgaggcagcccgcgcccccgccgcccgccgcccgccgctcacctgcacatgatctcgtgggtcagcagcacacggcacatctccgggttcttgtcctggccctcgtagacgatggcctgcgcgagggacaagcagaggctggggttacgcggcgcccgcggctttggcgccaaatcgccccgggcgctgcaggcctggctggcagcaggtgcaccacgctcgaggggaggcgatgcgcccccctccctcggccaccctcccgatggggtcaccctcggagctgggctaggccgcgatggcttctccctcccctgcctcccagcctcctcccccgggcgcccgccaggcctgcgaggggccttcggctgcagggaaggcgccgactgggctcgggccgcggggagggcagggcgagggaggccggggccggggcgcaaggagcgagagcccgctggcaccgaccccggaacccggggctcccgggccccttcggcattccgcgccgccgccaggccgcgtcctcaggccattgtctacaacgagttccaatctgcatgttgggagaggccgatcagaacgccccgaggctaaagaagcagggaaggatggtcgcggcgcaggagcagtttgccaagggccgagggccgcgcccgccctgccctgcgcgctcccccggctctagcaagtctggcgccccgcggcttcccgcggcttcccgcgttccaaacccaggcgcccgcggggagcaggccgccctggaccggccgccgtcccgagctcccggggcctccctgagtggtgggcagcgacctggcctctgcacgctgcgggcggcctgggagcccaggcgggaggcccaggagcagcaaccgcacgtgggccgcggcgtcgccagcgccccgcaggagtgccggggccccagggcgcccgagcccgcgcggccacgtgctcctcgccggatgatatttggaaagaaagtgctaatggccaatctggtgtttattttgaaactgctaacagtgatttttctcgggtaaaaaggcagtctctgcgcgcacgctcgggtgggttttgagcagaggctccgccagatggtgcgaagccctaggtgcgctcacggccgcgctcagcccggctccgccgctgggaacccgagctggggatcgggagccgcccgcccgggctgggcctccaccactggcctcgcgaaaaaacagaaaagaaaaaaaaaaaaagtctactgggggaggggcgggaggctggggccgggagctccaagttccctgcataaaattccacggaagggggagggatgtcctcttctccggttcccgcccccacccctgaaaattatctggaaattccttccaacctccccgggcacttctgacactttcctctacttccaggcggacaaagccctttctggtgaaagcccggggctgccctcctgggaagagggaaggttccccgcgaaccccgctcacccagcctcctgcctggacccggctcagaaccacagaagtgatgggtgtcaccgcaggccaacgagtcgcctggcgctgcagggcgcgtggccgcggcgggcaccagcgcttctgagagagtggcttgtcctccgatggatcgccgtatttatatttgatttattttttattttgtagcacaaacagaaatccataaactgtcggttcagcgccattgactctttgatcagttactgggctatttctttcctttttttttttttttttttgcccctccatgcccgtcagtgagaggagattaaatgcctttattttcagccctgtttatactgcaaaggtacaaggctaaatgaacaataaaagtgtacttaaaacgaagcctcctcctcctctgtgcaacaacagagaaacttagggctgcctacataaacctcttaattagactatagcgatttccgaaaacatttagccattatatacaaaggaaataaaatcaccctgtcaaccagcagccggagttccagaggcttctctgaatcgagtgaaataattacagaagggcacaccgcctctgtctttgtcagaaagaccttagtttacctgtcagatctgttttactctaagagaaaagcacactggtttaccactgcaggcattaaaatctaacacccttgctacctaggtaaggacaaactttttaaaggggaaataaaatgtgcaaactaattgcatgcagagagtgggaggcatatgtgctgggctgcaggaagccccaacgagctctcctttacttggctcacaattcttaaagttagcatcaaaaccgaagaagccactttcatttctaagtgtgaagtccagcttggaagtatattttaaaacaatctgtgccgagtggatttaatctacaaactggacctgcccccctccccaccacaacactctattttaagaaaatgggggcggggggaaatctttaaaacaaccaaatcaacaacaacacaccacccagcacaaaaccagcagccagagactgcacaatgtcaaaaagcagtgacgcacttttctccacttaatcacattactgatagccaatagttatcatcggaaaagttgaccaagacaggttaaataatttaataaggaactgcttgtaattatgttatttacaaggtatgacagagggtgggagagggggcagagcagtggacgggttggagtgacccctggagcttggagtttgaattatggagctggggggctgcgaggtgaagatggactagaggagaacaaggtgacttttcaccccaacacatttaacttttaaatccaaataaacgtctcgtgttactagaccatcacactggaaaggagaaaaaaaatgaactaatcaagtccaactcgatgggcttaggagttagctgcctttgttataggaaaaaaaatccaaatgaactgattcctagcagagagagaagcatttaaaaataaacaagaggggggacatcttgaaatttttgtcaaatattaattaccataattaattaagacagaatatgattccaatcacaagacatttaataaagcatatatgtcctgttctaatgacaacataaactattttaccaatcgcttcattcattccaataaatatggaattctcattagcatgtcaaggaaactcaatggaaaacaaatacacgagatccatttgtcagtgcccttgcctctgaagcccaggacaacccaggcccagcagtgaaaactcgtgcagaggcataaactttctcacctgtttggtcattgaatctatgaggcgaacatacagatcttgctctgttctgactcctgcaaaaaaacagagacaaattctcatcaggatttgagtgctgcacctcggggagggcacacggagcacaggaagtctgtaactcaggactgctgccacggtgatgcagcagaacttaggcaatccctttgaaagggagaaagagaaccccaccacttctcgcttaattttttttttcttttcttaactaagaaccttaaggctcttagggcttgcatttcaaggtgcaaggaacttgcctggtggagagcaggcctggtagctgtgtgcggtgggcccatgtggtcgtttatttttagaaaagaaaaagcaccaaatggaaactgagtgagaggctgaactctttctaatgtctctcgaggatttaaaaaaaaaaaactcgttcacaggaagtaagttatgctccgtttatggagttacccccatcctaataattaacattaatttgcaaaattgaaaaaagtcacttaaaagtgatgttctgctggagcccgtatcgatctttttcttactttctacttcaagccccaccggttaatcatgtgaagtgccatcgacttattgatcgtttatgttttgttttccttctatgccatgagaagatttcgtgtttacatccatgtcattttaatctcaaatctttatgtcctttcaccagcgcagaaaaggagagccagccgctgcaggggcggcgagcacgcagcaggcacttaccgttgctgtacaataactggagtttatagtggatgccgttgttggttttctcgttgtttggctcctgaaagtaacgataaataattgcatttagtgcgatcggtgtcaggcgcggccaccacgctcggtccccctccgcgaccgaggctctcggcctcacacatggcaggattcctagctcgaagcagcgcggtgatgtcactttcctgctggaagcccagcgttctcctcgccccgagtaagtccgagggcgcagagaagttgcccagccctcggcggtcccgggcggccgcacgtggcggcggcggggtggcctggcggagccgagcccgccgcctaggggggcactcgaacccccgcgcaccggcaccgcctgcctcccgcttctagaaagagagagggtgtgatcgtgtgtttgcacttactttctctttctccacaaagtccacaaaagcggtcctttcaatctccaccggctgcccctgcctatcgtagagcgccagcacgaagtggaagaaattggatttccggaggttggaaggcggctgcttctcgaagtgcgcccgcgccagccccacgccgctgcgggaggaaagagacagcggcccggtgaggagcgcggcgccggccggcggagggggccgggccgggccggggccggggccagggcgcgcgggggcggccggtacgtacctctgggcggccgtgttggcgtccaccacgcccgccgtgtgcatccacgagcgcaccgggttcatgccgctgcccagcggctcctccttcatggtcgtccccccgcgcggaatattctcctgaatcccaaacatgaaaactgctggcggcggccgcagctcccggccgaaagcgtttcctcgagcagcggcgc

SEQ ID NO: 782 - DNA, 36408 bp, Homo sapiens
agaaaattccaaatatttatttccctggctaaatcaagtaagtaaagttcgtaaacacagacagaaggcagttcactttggggtagagttctgtattagtcaaggtaaatatactgtcttgaggatggggatgcaaacagtgctctgtagtgttgtagaaatcggattttgaaattatcagtacaaaaataacagcttgattaaaattaatttgtatctgataattgtttacaagttatgaaattcagtgatgatttacaaaatccaaacagacaatggatacctaatgccactgaactgtaaaacaaaagttatgctgacatctagtggtaacatgcaaaaaatctatgctttacccaattttgatgatatcatttctcttcacaaatttcactcctttgttgatatactttcctgaactcttcaccaagcagatcaatatcatcctcttttttaaatactccctacgagaaaaatactttgtgggttacttttgaataccagaatatttcactaaatgcttttaagactgacagacataagattagtaaagttatctccaaggtaatgaaatctattcaacagattaatgaaactttaaaaaaatcaatacttttcaaaaaataagactttacatatatattgaatattcctagactgacccaattttctgatttatcagctctagtgtaggagcttttcataggaatctgagctcttctacaagttctactgcttggattacctagataggaaggcacttcatctatactgtaccctacccttttctttaaatagctctataatatgatataatggtgagcttcagtagattcatgcatgggattagttcttcatgcctcagttctatggctaatcagcaaacagtcaatcttgcagaaaagaatccaggtttggagttaagccatttaagcaaaccctttggaattcttcactgttctatttttcttttcccctacagtatactgcaaaaggctctttaaaacaaaattaaatatttacttaaattgcaatctaaagaataaagaattttagggataactgaagtcatttggcaccattaggacctaaaggataaaggtcatttttggatatcaagtttattaatccctcctgctgcctccacaattatttcctctacaaaaatatcaaatcccaaagaaagacattcctacaatttataatttagtttatgaaatgtattaattacatatggattttatcattaatacatcattttgtattccttaatcctttctaaccaattagactatcaagtcctgtggccaggcagtaattacctatatatctttttccttccttagcaccagagtgaatataataaaataaatatgcacttgattctactgaataaaatatgaaatggcatttctatagctgaaagatggcgatcttatttatatgagtctagatgtttatgtggcctatgaaactgttattacttttttaagacaagacggggtctcactctgttgcccaggctggagtgcagtggcaagatcatgggtcactgcagcttcaactttccaggctcaagcaatcttccaacctcagcctccagagtatctgggactacaggcgtgcatcaccacatccagttaactttttattttttgtagcaatggcatctccccatgtttcccaggctggtcttgaactcctgggctcaggtgatcctcctgcctcagcctcccaaagtgctgggattataggcatgagttgccatgcccagccagttactattttatttgaagtcacagtgtgtctcaggtatacattaaaattcactatcttctggaattttaaaaatcaagtttaactagttataacttcctactgtagagcagatctgtctcaagctcagttcaaccatgtgcctattactggtgttaccagtgacaatgttttcatacacattctcatctttggcatgtaagtactacagttctagggtagtctcaagctcagttcaaccatgtgcctattactggtgttaccagtgacaatgttttcatacacattctcatctttggcatgtaagtactacagttgttctagggtagctttagatttcctacactaaaaggggagaaaagaaactctaaaatacaaactcaggccaggtgtggtggcccacccagcacttggggaggctgaggcagatggatcacctgaggccaagagttcaagaccagcctggccaacatagcaaaatcctgtccttaccaaaaatacaaaaattagctgggtgtggtggcaaacgcctgtaatcccagctactcaggaggctgaagcaggagaatcaccgggaggcagaggttgcagtaagctgacatcttgccactgcactccagcctgggcgataaataaggtacaaattcagtaaatcaagctcatacatctaataatgtgctaagaccaatcattttagatatactgaaatgggcccagagaggttcagtgcctggacaggaggatcccattgctgcttcataaccgagcaagaagtgagcaaaaccaaggcactctaaaatccaaataccatgtttttttcactattacaggtcatgaagattacaacttgagataaatctcacttactttagggagatagcctagtaagtttgtagcatgctctttaagaagttttagcctttcttcttcaataattgcattaataaatccttgccgcctttgctgcaactgccactcttctagttcacgttgctggaaatgcagatcaaattttgttatcacaaagtacattaatcttatacgaagttttcaaataaaactactcatgcaatgaattagataaaattgatgaactatttatgacactaagttcaaaagattctagataatatatatttttaaaatatatattttatgtctgtacacatatctatgtattttttactgtcattattcctttaaaattacaaggaggcaaacaaatattttcaggaaagtgtcttcattaccaagggaaaaaatattcaaaggagtgactgcctaatacagtaaatatttactgaatgcttaccatataccagatgctgaagagtttacagtgtaaaacaaaaaatagtgaataaagaagatcagaaatatctaaaggatattttcatatatatatatataaagatgatatgaagcatgagaattccactagtatttcttaggaaagtgctcactcttaaataatcacatcaaaattctgggccatatagaaaagatgacttgaactacgtgaaagaacagtaatctactaagccactgttaatttgagactgtacttgcattcaaacctaattctatcttaattcatccattccttataaagaggagatacaggaaagttctgtaatgttacaggggaaagcaaacttgatacatttttgtccaatggtagagtctactttgggctaatgcagattttcctaagaaggatctggcaggccacattcaatgtttatcctaaaaagaaaaatttatagtaaattaaattgtttaggcagttacgaaatcaacttatccatttaggacaaattctgaatagctttggtgtaggaaactacctcctgggaagtttcagattttgtctgaccgtatgattttcgtagaggtagacagaattacagatacctatttaggaatgtctctgaaatccaaaaaacatggttagaccttataggattgtataatgagtttcatcacgaagatctgtccttgacttggggccagaacaaaaatgttgcccaatcaaacggacaaaactaagccgacagcttcatattgggaacatttataagtctttaaaaattaagacaaaaattatttgtataagtatctatgcattaggtggctttatctgatttccatttagtttttagtctgatttctagttagttgtcttgctaacttttccaggagctttctcctatccaagtactaaccaggcctgatcctgcttagcttctgagaacagatgagctccaatctgaaatataacagcacttgtattcccatgagtttctcatatttgaaacatctgcattattttgactcctactttgtatagttttaaaagaagtcatgtaagtctcacttagtcttcctctaaattcttctcttcctaccgattttcaaaacacctacatattatccatttggttcttaaaccacaaaatctagtgagacaatataagtatttagttttacggatgagacataaataagtcaatgtatccaaagccaaaaacttcattccctctccaacacttaaatctacatttccaactagtaatcttcccctgggccaccaaatcattttgggtggacaaaatagaattatttgcaccctcaaaatctatttcttttcctctatactctttccttaggatgtcacccagtcacccattaaagatggaagtgacacatggacacagggagaggaacatcatcacacaccagggcctgtcggggggtgggggggacaaggggaagggagagcattaggacaaatacctaatgcatgcagggcttaaaacctagatgacgggttgataggtgcagcaaaccaccatggcacatgtatacctgtgtaacaaacctgcatgttctgcacatgcatcctggaacttaaaaatattaaaaaaataattaaaaagatggaatgacagtattatttattaggggtagccttaagtcttctctcaccctagatctcactggtcaccaagccccatcaattccgtatccttaacatctctcgggtggatcccttatctatttgcatgggtttcaccacttgtcactgggattattataataacttacttactgatctccctatctccgagcttactcatctcttatctaccttcaatgctctcacttgaatcgtctttcaaagtacagatcttaatatacagcttttcaatcttcagtggcttcccttagaaaagcccaccttcttaaaatagcatgcagggtgttcatgatctgtttctctctctgccataccaaaacatccatagctctataacctattatcacatgtacatgacatatttataattactttttatatatttttcttaaccaagaccataaattcataagtgacatggacttagttttatttaccttttatgttctcaataccaaccagtgtttagcacatagaaagcatcaataaatattttctagaagcaaaaatggtcagaaaatttatatatatattagtaaacatactaacattgtctggcatataaagcttctcagtaaatgtttagtggatgatagatgagctattgctgtttaatgataatgaccaaaaaaaccccacaactttttcttactttgtctgcaaggaattgttggcgacgctcttcaataagtttttccacagccctcctgtgttccagctgcttcattctttgtttctgagcattcattaattctattcgatcatcctcagcaaatttagctagcatagtttttctaaagttctcctcttcctcttttgcagcctgtagcactaattccttcaaggccatttgttcttcaaaatcttgcttcatctctttttgctttctcaatttcttttctgcttcttcctaaacaatacagctgaaagttaatttagtaactatttccttacaccagatttataaggaaagagtgatagagtttggttaaatttagtattacaatatgaaatcatacaaactgaaaaagtaaggcttttcatgataactttgtccatccctttaaaactagctggataaagaatatgcttacatttggattgttttctgttactcatgaacaaattttaatttatatttaccatcttgtttctctactcagaattaacacgtaactgctttggaaagagctgttacaaaagccttttttgcacacctgagtttattcatctaaagtctatggtaactatgaatcattctagaatcttgcttacaaaagctgtccaaaccacccataagtatttttcagtttccaacctcctcctcaaaatcaaagctgcacttacccatctctagtcttctaatattcccttcattctccaaaattctctaaaatttaaaaacaattatctagcaatgacaatcagtacttctttagggaaattcaaatatagttggaacagttaagtcctttcctataagcttttattttctgaacattttattatgaaaaatttcatacatactaaaaaatataattttacaatggtcactcacttctaaataattcatgggccaaagagggaatgccaaggaaaataaatacattgtagttaataaaagtgagacagcaaaatttgtgagatgctgctaaagcagttctgagaaacatttatagcactaaatggatacatttaggaaaatgtatatatatagcactaaatgcatgtatgtaggaaaagtctcaaatcgataatctaagcccccacttcaagaacctataaaaagaactgtaaagtaaacccaaaatatgcagaaggaaaaacataataaaactgtagaaatcaatggaattaaaaatagaaaatagacaattattggtgaaacaaaaggctggttcttaaaaattatcagtgaaatggacagacctttaacaaggctgacctagaaaaaaaaaatgaatgaataaacaaataactaatatcaggaataaaacataggatatcactagagaccctacagacatcaaaaggataatacaggaatactacaaattattatacacacataaatttggcaacttagatgaaatggatcacttccttgagaaacacaagctaccaaaactcaccaaatatgaaataaggtaatctgaatagtcctatcactattaaggagacggaattaataacttaaaattcctccaaaataaaaccccaagtcaggatggtttcactagaaaattctatcaaatatttaaaaaattaacacgaattctacacaatctcttccagaaaacagaagaggaggaaacatatccccattcattttatgaagatagtattaccccgctaccaatataaaaaattacagaccaatattcctcgtgaatatggatgcacaaatccttaacccaatattagaaaaatagatcatacattaaaagaattattcaccatgaccaagtagtgtttattacagggatgcaagactggttcaatactcaaaaatcaatgtaatatacttggctaaagaagaaaaagtcataatcatatcagtagaaaaaagtgtttaaccaaggatatccaggaattgaactcagttctgcaccaagcagacctaatagacatctacagaactctccagcccaaatcaacagaatatacattcttctcagcaccacaccgcacttattccaaagttgaccacatagttggaagtaaagcactcctcagcaaatgtaaaagaacagaaattataacaaactgtctctcagaccacagtgcaatcaaactagaactcaggattaagaaactcactcaaaaccgctcagctacatggaaagtgaacaacctgctcctgaatgactactggatgcataacgaaatgaaggcagaaataaagatgttctttgaaaccaatgagaacaaagacacaacataccagaatctctgggacacatttaaagcagtgtgtagagggaaatttatagcactaaatgcccacaagaaaaatcaggaaagatctaaaattgacaccctaacatcacaattaaaagaactagagaaccaagagcaaacacattcaaaagctagcagaaggcaagaaataactaagatcagagcagaactgaaggagatagagacacaaaaaacccttcaaaaaatcagtgaatccaggagctggttttctgagaagatcaacaaaattgatagaccgctagcaagactcataacaaagaaaagagagaagaatcaaatagacgcaataaaaaatgataaaggggatatcaccacagatccaacggaaatactaccatcagagaatactataaacacctctacgcaaataaactagaaaatctagaagaaatggataaattcctggacacatacaccctcccaagactaagctgggaagaagttgaatccctgaatagaccaataacaggctctgaaattgaggcaataattaatagcctaccaaccaaaaaaagtccaggaccagatggattcacagccgaattctaccagaggtacaaggaggagctggtatcattccttctgaaactattccaatcaatagaaaaagagggaatcctccctaactcattttatgaggccagcagcatcctgatactttggtcgtctgtcatcctgacagagacaccacaaaaaaaagagaatttaagaccaatatccctgatgaacattgatgcaaaactccgcaataaaatactggcaaaccaaatccagcagcacatcaaaaagcttatccaccatgatcaagtgggcttcatccctggaaggcaaggctatttcaacatacacaaatcaataaatgtaatccagcatataaacagaaccaatgacaaaaaacacatgattatctcaatagatgcaaaaaaggcccttgacaaaattcaacagcccttcttgctaaaaactctcaataaattaggtgttgatgggacatatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcagtcaggcaggagaaagaaagaaagggtattcaattaggaaaagaggaagtcaaattgtccttgtttgcagatgacatgattgtatatttagaaaaccccattgtctcagccccaaatctccttaagctgataagcaacttcagcaaagtctcaggatacaaaatcaatgtacaaaaatcacaagcattcttatacaccaataacagacagacagagagccaaatcatgagtgaactcgattcacaattgcttcaaagagaataaaatacctaggaatccaacttacaagggatgtgaaggacctcttcaaggagaactgcaaaccactgctcaacgaaataaaagacgacacaaacaaatggaagaacattccatgctcatggataggaagaatcaatatcgtgaaaatggccatactgcccaaggtaatttacagattcaatgccatccacatcaagctaccaatgactttcttcacagaattggaaaaaactactttaaaattcatatggaaccaaaaaaggggccacattgccaagacaatcctaagccaaaagaacaaagctggaggcatcatgctacctgaattcaaactatactacaaggctacagtaaccaaaacagcatggtactgctaccaaaacagagatatagaccaatggaacagaacagagccctcagaaatagtaccacacatctacaaccatctgctctttttttttgttacaaaaaagacaggtttgttacaaacctgacaaaaacaagcaatagggaaaggagtccctgtttaataaatggtgctggaaaaactggctagccataggtagaaagctgaaactggatcccttccttacaccttatacaaaaattaattcaggatggattaaagacttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttccgcacagcaaaagaaactaccatcagagtgaacagccaacctacagaatgggagaaaatttttgcaatctacccatctgaccaaggggtaatatccagaatctaaaaagaactcaaatttacaagaaaaaatcaaacaaccccatcaaaaagtgggcgaaggatatgaatagacacttctcaaaagaagacatttatgcagccaacagacaagaacaggaaaggtgatgtctactctcatcactcttcttcaacatagcactagccagtggtgctggaaattttagccagcatgtaaggcaaggaaaggaagtaaaaagtatacagatcagaaaggaagaaacagcctgtagctctgggcagaagacatgcctgactatgtagggaaaaaaaatcctacagctaacaagtgaattcagcaaggttgtgagatacaagataaacacaaaaatatcaattcactagcaacgagtacacggacaccaaaataaaagctaacattccatttacgattgctcaaaaaatgaaacacttagatgtaacaaaacacgtacaggatttgtatgctgaaactagagaatcctgatgaaaaaattcaaagatctaaataaagggagagccaaattgtgttcatgaacttaatatagtgaatttatcaattctccccaaactgatattcaaatttaattcaatacctatcaaaatcccagcaaaaaatatttatagagacaagattcttcaaaaattcatatggaaaggcaaaggaactagaatagctaaaaaaaaaattttaagacttgccatatagctgcagtattcaaaactgtgtagtattggtggagggatggatacatagaccaacagaacaaaatagagaccacaggaatagacccatacaaacatgccaactgtgttttaagaaaggtgcaaaagcaattcaatgttggagaaacagccatttcaacaaatggtgtggaacaactgaactaaatccaatggcaaaaactgtatttaagtctcatcgtttgtaccaaaaattaactcaaaacagatcacagattgaaatgtaaaatggaaaagcataaaaaaaaaaaacccaaaaaaacaaaacacacacacacacacaaacctttaggaaaaaaaaaaggagaaattcttcaataactaggcgaagagtttctagagttgacacagaaagcatgatccataaaaagaaaaactgataaactgaacttcatagaaatggagaacatttgctctaagaaaaatcgtgctctaagatcatgttaaaaggatgagaagataaagctacagactagaagaaactatttgctaaccacccacctgacaaaggactagtatctagaatatatgaagaactctcaaaacccaacaataaatgaacaaacaacccaattagagaatcagcaaaagacatgaagaactatttcatcaaagaggatcttacaccaaagaggacagcaaataagcacatgaaaagatgttcagcatcattagtcatcaggaaaatgcaaaataaaactacaaggtatcactacatggatatttaaaagtggctaaaataaaaaattgttgagcttctgaggacagaggagaaaaaaattaaaaaataaactgtgttaacaccaaatgctggtgagaatgcagacagactgcgtaactcatatatttctgatgggaatgttaaatgctacagctgttctggaaatcactttggcagtctgttacacagctaacatgcagttaccacaaaacccagctaatacaatcttgagcatttattgcagagaaatgaaaattgatgtttatacaaaaacctttacctgaatgtttacatcagatttactcatcagagctaaatattggaagcattccaaatgccctttaatgggcaaatggtcaaataaaatggtatatacatgccaatggaatgttactcagcaaaaaaagggaacaaatgatcaatacaagcaacttggatgaatttccaggaaattatgctgaataaaaaaaagccaacttgaaaaagttacatattgtttgatatcatttatataacattcctgaggcacatacttttaaatttataattaaaggtttatccatgttttagcatgatcagtctgtcattcttttaatagctgaataacattttattacatggatatactatattttgtttatccattagacatttgggttatttctacttttgggttatttctacttttagactattgtgaataatgctgcataaacatttgtgtatgggtttgggtagacacaggctcattaatttttaaccattcttttttctaatatatgcatttaaagatataaactttcctctaagcactgcattaactgcacgtcacatattttggaatgctgttttttgaatcatttagtttgaaatatttttctaatttccaatattatttattccccttttctcattgcttatttagaaatatattgtttaattataatatatttaaggagtctgcaggtatattttcattactgatttttaatttaattccactgtagtcagaaaacatatctggtattatttaaaaccttgaaaatttattgagacttcctttatgtcctagaatatgatctatctcggtgaaggttccatgtttgaatggaatttgtgttctgctgttgttgggtggagtattctctaaatgtcaggtcaagtttattgatattgctttcaatacgatatcctgcggttctgactacctagtctatagattaatgagaactgtgcattgaaataccattctggacataggacctggcaaagatttcatgatgaagactcaaaaagcaattgtaacaaaaacaaaaattgacaagtgggacctagttaaactaaagagtttcttcacaggaaatgaagttatcaacagaataaacagacaacctacagaatgggagaaaatatttgcaaactatgcatctgacaaaggtctaatatccataatatctaaggaacgtaaacaaattaacaaccctatttaaaaaatagactggccaggcacggtggctcacacctctaatcccagcactttgggaggccaaggcaggtggatcatgaggtcaggagatcgagaccatcctggctaacacggtgaaaccccatctctactaaaaatacaaaagaaaaaaattagccgggcatggtggcgggtgcctgtagtcccagctacttgggaggctgaggcaggagaatggcgtgaacccgggaggcatagcttgcagtgagccgagatcacgccactgcactccaacctgggcgacagagcgagactcccatctcaaaaaataataataaaataaaataaataaataaaaagaaaaaataggctaagtacatgaacagatacctctcaaaaaatgatatatatgtagccaacaagcacatgaaaaagtgctcaatatcactaatcattagagaaatgcaaaccaaaaccacaatgagatactatctcacatcagtcagaatggctattaaagtcacaaaagaatggatgctgacaaggttgtggagaaaaaggaatgcttatacactgttggtgggaatgtaaactagttcaaccactgtgaaaagcactgtggcgactccccaaaaaatgaaaacagaattaccatttgattgctgggtttatacccaatgggattgctgggtatatacccaaaggaatataaatcattttaccataatgacacatgcatgtgtgtatttatagcagcactattcacaatggcaaagatatggaatccacctagatatccatcaatggtggactggataaataaaatgtggtacatgtacaccacggaatactacacagccataaaaaagaacaaaatcatatcctttgcgtcaacatggatggagctggaggccattagcctatgctaattaatgcagggatagaaaaccaaatactacatgtcttcacatacaagtaacagctaaatattgagtacacgtggacacaaagaaggaaaacagacactggggcctacttgagggtagacataggaggagggtgaggatcaataaactacctatcgagtactatgctcattacttgggtgacaaaataatgttacaccaaatccccatgacccacaaatttacccctgtaacaaaccagcacatgtacctcctgaacctaaagtaaaagttggaaagagaaaaagaaaaaaaaaaaaatcttgaactctgattgtggatttgcctctttctcctttcagtttttgtcagttttgcttcatgtattgtgaagctttattatttaggttcacacgcctttaggactatgacatcttctagatgaatttactgtattatcatgaattgcttgtcctgaagttgactttgtctcatattaacgtagcaactccaacctacttttgactagtgtctgtatgttacgtatctttcaccatccttttgcttttaaagtatgtatcttcatttttaaattgtgattacagacaacatagttgcatcatgctttttatggtaagtttataaattgatgcctgagtctatctttttagccagcttgaaaatttctgtcttttaactgtagtataccatttacatataatgtaattaccagtatggttggatttaaatgtactatctcttttctgcttcatctcaaaattatattcttctctacattaatcattctttccatttctgaaacttacttttagcttgctcttatatatttcagcttgttcttcctggtataattcttgtcgcacttgttccaaatcttcacgttgccgcagcatttcttctaatttctgtgtcaactattaaattttttaaaaaacataaatatttataggatccaaattctgtaactaatatttcagaattttactagtgttaaagaagtggttattttaataccgcattctgaagctgtagccttttctcctcattttcttgaacttttgccatccgatcttcttctctttgctgctgcatgttagcaaactctatgatttttctgttttcttcttccatctcctcacgtttcttttttctccagagagcctgctctttctgaaactcttctatataccttcgcattgcattcattttttctaacttttgttgtttttccctgaaaagcaataacaagtacagatttatagtaaacaataaaatataaaaaagtaatttcattttgttcataataatgtacagaaaaacactatagttttttcattcgtgcatgcaacaaacattttgaatgcttactgtgtgctaaatataatgtcaggtatgaatttttctttgggtagaatactgtgatagtctcctctaacctattaatgaagttttatgcatcttatttcataaaggctacaatctgttaacattagctttgcagcactctatacttaagctgtctaccaaaaaaatttatcagaatacctgtcctctgacatatgatatgggcatatataagaaaaacaaaggtttaggtcattcaatcacttcagcatttattaatcatcagataattcatttattaattatgctaacggagatgagaaggagttggtcccaatttatgttttcatagctagtatttattgagcacttactatgtattaggcactgttctaggtgcttcagttcctcacaacaaacctgtgatatatctaaagtaaacatttagacatgtaagaaagttaggataaacttacaactgatcttcttcatagatcttcctaacaatttcatcaatcatgagtttctcttttagcagctgctcataagcttcctgcttttttttttcttgttcttcaagttgtttctctaagtcaagatagtactgtgctttcgctttgtttcgtttgtcttctgcagcattctcttcctttattattctcttgtgttcttccatcatggttttggctatttcagcatcacgtttctgttattaaaacaaaattgatctttccgttttcaaatttgaacatagtacgatagtatattttacaccaatgttattgaatattataaagtcttttacataaaataaattttttcatctgtctaggttaaaaagcaaaagtaagttattattacctgaagggtgtgaacaataagtcagaccctaaagcagctttcctatcccttcaagtagctctctcaggacaatacctgataaggattattaataactccacattcaaaaaacaatgaatacaattgtaagtagtttcttaataactatttagctgctaaagcagtcattatcttattattctatttataaactgagctaggcaattttcatcgtttttagcttcattgtttatcagctgctatttaaagatggtactgcctctttcttacaggtctgctattaaatggctttgagcagctcttaagtttctcctagcctaaactttctttcctgccattggcccttgacgtttcccctttctgatttattaaaggccctttatctgaaaagaatcacagatgctactgtgcctattttctacagcttttaattcactcaagaccattcccattgtcaagagacaatctttcttcttggatgggttaaaccccttatttcttttgagcatttttcaaatcatttaataaaataagttttaaatgaaatatactgaggcaattttttaaactacgctttacttttatgatcacatcccgaatgatggaatggtcagcagcatcaaacataaagagtaaacagattaaaatatgaatactgaatgtcattcctgacgtcactgaagcctttaacatatactctgataatatgacttgaccaaaaatgtttctgattatcttctttgtacatgctatactaaattctttattaaaaaatgagatgacaataacatttatgtgtagattaccacacacttaccgaaaacaatgttctcattttacagataagaaaactaaggctcagagaaaaagccaaaactagtacttgcatgacacctagtcaagtcctagtagtattcgactttcattttgtggatcaatttttatttggaaaatagcagcaattctcgtaggagtcagattaaaacgtctacaactaccttgaataacttcaactatcaggataattaaaactgcaaaccactggacaaacaggacattgtttgtgctactttctttttcaaaggacagcgctatatggcttagcaaatgaagtctctccaccttttcttatcacctgccacacctaaaggtattcctgttaacagcatgctgtgtacccgctagacattttctatactaacacaattgtacacacgcaacacacacatatatgtgtcatttatggtatctattcttaattgatacccatattgcactgcactggttaagtattttgatatcaccccataagagtgtgtgtgtgtgtacatatgtttatgtggacatacacaatagatatgtatgtgtatataaacattcatatataattggcccttctgtttgataatgagagctcaagggatgatgtgcacccttttaattaactgttaattcagtaaaccctattatatattcatacagcaaagcactcctagtgagtatgcctgagattcctttgcccaagagtaactcttatcttcaacttggtaccatatcaggagttagaaaaggggataaaagcagagagaaacatgagaaaaagagatggcttttataaaactggaaagtttcctacataaaattatcaagtagtttactcttaaaaacatttaaataattaaaaatttcataacattctaaaatacacttatcatggtaacaatttgtactgtactactttgtcagtgaataatcagttagagactataaagaatgctgggagttactgaatatagctggtcattctaagcagcaatgtgtttctgaaaggctctaatattaaaaatgaaatcacgcaggattttctacatcttaaggatctgaaaatttacaaatatttaagaaatctagcagtgtaaattctttatacaatatgacaattttttaagaaacaagtctaatttttattttctaaatgaagctaaaaacataatgaccagaaacatgattaccatttgttcatatttaatggcatccttttcagcaatctgagctgccctttctttattcatgtaagctgcttttaatttcttctccaattctctaagctcaatgctgtttaaaaaaacaaaaacaaatttaaatgttaggaccataagagaatgaaaacctcacagaaaactgagtaactgtatttttaatttactcaaagagggaatacagcgggtattattttagatccataggagaaataattcattatatttaatggatgcctttagggcattagggcttacattttctggttgaaaagtactgctctgttctattacattcatctgtttgcttatcctgtgtcaataccacactatctcaactgctgtaaattataatacgtctacatatcatggataagtctccaattttggtcatcttcttagagactgtcttagccattcttgatactttcatttccatatacattttagaatcagcttgtcagacttcacaataaacaaaactggctgtgatagtactgaattcataaatcaatttggaaagtactaatatctttacattactgagtcttcaataaacatagtatatccttctaattatttggttttttaaaagtctatcgatgtttatatctgtgttttattttggtagttttatacttttcattaggtatttttcatatccttctgtagattatttttcaaatctcactttctaattgttgataatttacagaaatacaattaatgtttatatactaaatttatacccaacaatatcactgaatatattttttagttttcagttttactgatctacaatattcaataaactgaacatgtttaaaggatacagtttgataagtttttacatatgtatgcacctgtgaaaccatcaccacaatcaagatcatgaacacgtcccaatcacttccttataaacctgtggtacctctcttctacccctttatgttcgcacttatcctgaggcaagctaatttgctgtcaccttaggcagtataaattttctagaattcatataaatggaatcatagtgcaggtaccatttttctctggcttctttcactcaatattttcaaatacatccatttattgcatatagtaattgcttactcctttttattgcaggatattattttaagattatagatatccactcgcattgcttatctattcacatgctgatagacatttgagttgtttcaggtatgtggatattgcaaataaagctgctatggaaatttgagtaccagttatttgtggtcacaggctttcatttctcttggataaatacctaaggtggaatgatcaggtcatacagtagatgcacgttcagcgttttaagaagctgccaaactgtctactaaagtggttttaagtttttatttcaacttttagatactgggggtacatgtgcagatttgttacatgggaatattgtgtgatactgaggtttggagtacagctcctgtcacccaggcagtgagcacagaatcaaatgggttgttttttaacccactcctcctccaccctctcatagttcacagtgtctgttgttcccatatatgtctatgtgtactcaatgtttagctcccacctataagtgagaatatgcagtatttggttttctgttactgcgttaatttgcttaggataacggcctccagctccatccatgtttctgcaaaggacataatttcattgtttttatgtctgtagagtattccgtggtatatatgtaccacattttctttacccaatttcccactggtgggcacctggattaattccatgtctttgctattatgaatagcacagcaataaacatataaatgcatatgctttttttggtagaatgatttgctaattcttatttttagattctttttttttttttttttttggagacggagtctcgctctgtcattcaggctggagtgcagtggtgtgatctcagctcactgcaagctccgccacccaggttcacgcgattctcctgtctcagcctcccaggtagctgggactacaggtgtgtgccaccatgcccggttaattttttgtattttgagtacagatggagttacaccatgttggctaggctggtttcaaactcctgacctcaggtgatccacctgccttggccttgcaaagtgctgggattagaggcatgagccaccacacccggctatttgtagatgcttttggatgttctacacatacaatcatatcatctgtgaataattaaatttttattcctttaatgccaatcctagcacctgtctttgctttttcttgccctattgcactgattagtatgtataatacaaagatgactaaaagctgtcagagcaggcatccctgtcttcttctcagtgtcagaggggaagtgtttaacattttgctattaaggataatgttgctgtaaattcccttttatccctagcttgctacactctttttattaaatcatagagtgatgattcatatcaatgggctttttctaatcatataattgttaataggatgaattacatttactgatttttaaaatgttaaaccacctttgcattcctggaataaattaaatttggtcaggatgatttatctttcttatacagcactggatttcgtattgactaatatttcagattacaggagctaaattcatgagagagattagtctacaggtttctcatatcgtattcaggtaatgatctgattaaaacaaattgggaagggcttcctctttttctgttttacagaactacataagattggtgttactttgtcctgaatgtttggtaaaattcacctagccctgtaggtttatttgtggacaaggttaaattacagatgcaatatctttaaaagttataggaacatttagctatttcttcttgtgccaatcagtttggtaaaatgtgctaagaatttatctatttcatttacattttcaaatttattttcataaaattgtttgcaatatcctgctatggtccattaagtgtttgtatgctctacagtgatatcacattatccattccaaaaactggttatttgtgcattctcttttactctgtcatccctaccaaggggtcgtcaattttattcacctttttatggcacagttcttggctttatttgttctactttatgtttatattctaacttactcatttctgctcttatctttattattgccttcctcctaccttctttttgtaatcattccagaagagaatttgcagtttgttttctagtaattccagatggagttttcctttctaatacagttatttcagattaagacctacccttgaggaacagccttaactatatgccacaagttggtttcttttttttcagtcctataacattttttatcatgtgaaaatatatgtaacaaaaatttgccatcctaaccatttttaaatgtacaactcagtggtgttaattacattcacagtgttctgcaaccatcaacactatttccaaaactttttcattccccccaaagagaaatgctgcacctcttaaacgataactccccattcttccctctccctaacccctggaattcctaatctgcattttgtctatttgcctattctagatagttcacaaaagtggaattatacaaggaattgtccttttgtgtctcgcttacttaacataatgttttcaaggttcactaatattttagcatgtatcagtgcttcattttttttttataactgaaggatattgtataatgtatatatactacacttcatttatccacccatctgatggacattcaggttgtttcaacattttggttattggaaataatgctgcaccaaaagtttgtatacaagtatccatttaagtctcactattgaattttttgtatatttatgcctaggagtggaattgctggctcatatggtaatcctttgtttaactttttcccatagcacctgcatcattttacatttctaccagcaatttctgagggttccaattttcccactttcttggcaatacctattattttccactacttttattaaaattgcctattagatgtgaaacagtttcttcttatggttttgatttgcatttccctaatgacaaataatgttgagtatattttcatgtacttatcattcactcaacatcttctttagagaaacgtctaagttctttgttcatttttgaactgggtttttaaaattattgaattgtaagagttctttatatatttcagatattaaatccttatcagagatacaatttgttcttctggcctaaatgagttctgagtgaggtaaaacagataagtgccttgtgttagtttttcacgtagtcccaaggtaggttagaacagatatacccaacaatttgtgaataagatctgctctgctcctcctgaaccagggaccagggtcctgcattgggaacaagggctacctgcctctgagctaggagggaatgaggaaagggcaagtgaagataccacagaactttactaccatttttaggctttttcttgtttcagcatttgcttgattgcaataaacctttgaatgctacccaaatttcttataaaattggttctgagagtttctgcttgttttctgatgtttgtagtcgggggatgggctgggaggagagacaggagctgggagctgcctactctgctattttgctaatatcagtccaatcctgcaacttttagtatgtggtattttcattattattcagttaaaaatactttctaatttcaattttgattatagacagtctctgattaatgatggtttgactttacaatggtgagaaaaccatatgcattcacagtaggttcctcaattcatgatgggatgcatcccaataaacctgtcgtaaattgaaaatgtagtttattgggacatgaacccatcgtacatcaaggagcatctgtactttttgaccaaagggtaatgtgaagcacatttttaaatacctaagcatataaagattgcctagatttttttttattacttacgtctagtttaattccactatggacagagaaaatactatgtataaattgattcctctgaaaatctgttgatatttttattctgatacaacatttcatcaattttggcaaatggttcaaatatgtttactataactactaatataattgggtttccatttacaagcttatatcttctttctacttgtcttccctgtcctatgttctctcttctctcctgtttgcttctgtgttgggggttcccaagaccaccatcaggttagatgattcactaggaggatacaggactcagcatatagttatactcacggctatgacttactataaagaaacgaaacacagcaaaattggcaaaggaaaaaggcacatgggtgaaattcagagaaaactaggtgcaaaaggcctctacctgtggaaacacacaggacacgcttaattccccgagcaatgagttgtgacgtgtgaaatgcctggcagacaacattagagctcatcagaactcagtgctctgggttcttattgggggtggtaacttaggcaccctctacttagaacgtaccaatattccagactcccagaaagaaaatgggtattcagtataatccatattgttttgttttctttttttcttttttttttttttgagacagagtctctctctgtcgcccaggctggagtgcagtggcgcgatcttggctcactgcaagctccgcctcccaggttcaagcgattatcctgcctcagcctcccaagtagctgggactacaggcgtgtgccaccaggcccggctaattttttgtatttttagtagagacgcggtttcaccgtgttagccaggatggtctcgatctcctgaccctgcgatccactcacctcggcctcccaaagtgctgggattacaggcatgagccaccgcacccggcctaatccatattgttttcacattttagccacagtgaatcatcctcagcagttaaggtggtaagaaccttctcaaaagcctagtttccagaaaccagccaaagaccaaacttgcaaggaggactttctaagatagcctcaagcctgctatgttaactcttttttacatgagttttttggaataatcaattcctattatcgtattttattctctattagtcagttatattttcttttccaaatttttattacagatattacagcatgtttctttgtttccaggtgaataaatttattcattattatttgacaatgcaagattcttgactttaacttcatttacttcctatctcattttgtcatatttttaactctttacatattttaattcccaaaagacataataaatattttatacattcaaatatcaactaaatttactatacatgtacctcttgcagttctgaaattaagcttgggatcatttttcttcttctattaatacctaatgaagaactgctagtattccctttaatgcaggattattggtgatcaatcttctgtttttgtttctcagaaaatgttattttgtgctcttttaatctatctcatctattttatgaattaacagcttgattatcagtccagaacataattatactggtataagctaggtaatggtaatagtattaagaaggaaaaactgtctctgtcttttctttgaaatggtttttgctgaacttaaatataaatgagatatgaggtacttgcttttgctttcataacagtatgtgttaactgtgtaataaatacatttagttaattgggcaattaattataactactaattgtttagtgccataatttaaaataggatttctaaaaataaacagtgagtttcccaactccagttaaaaacagcagcaaagttaaattatcttttaagtactttcttggattacaaaaccatgtgttccaaaatcaattaacaggagtcatgatttctgagctcaaagaaatattttcaaaataaacttcaatgattttttaaatgtgccgtgcatttaaaaaattaatttcttttacattaaaaaagctaaatcttaatataggtgattttaaataaattaggacacattttaagcaccagagcagttccctgaatttagacatgccaatttgaaatacagtccatttctgcatgacagtgaaaattttaatatggcttgtgcacaaaataaaaacactcttagcaattctgacactgctgagaggaggcatactctgtgaaagagtactcaactgaatgacttttagtttgaaaaaatttttcacaaggtataaaattctggttgagttgtaaatttttttgtatatactcaagcactttcttccttttagtttttgtgggtacacagtatatatttgtatatatttatggggtacatgagacattttgatataggcatgcaatgcatactaatcatatcatggaaaatggggtatccatcccctcaagcatttatcatttgtgttacaaacaatccaattatactctttatttttaaatgtccagtgaaattattattgactatagtcaccctgctgtgctatgaaatactaggtcctactcattcattctattttttttgtacccaggtaaatctgttatcttttaatttctactgtttctattcaggattaagtcatacttcttactgttgtctctttggagataatcatcttttttgttctggctgcttttttatgattttctattactgttggattttaaaagttttattaggatgagtgaaagtactgttttcattacttgcaatgttctgaaaattccaggccagcatctcctcacataatgcttctgtattatcctctttcacctctctaccaggactaaaattatattaatacatctgctagaactttgtaccatagcccgtatctcttttaaattctcatctgtatttttctatccttttgtctctccatgctttattctgaatattttccagaaccttttcacagattatcccttaatctgtgtctaataaaatctaattctgtattattgaagtaaaacacacactaaagtgcacaaatcttaagtgtacagcttgtagaacgctgttgaacatactgccatatgcttattggccaagctctgcttcacttaactctcagccattgtttggaatcagcagaaacctctagaggaaatgccactacaaatgccaagcttgcattctggtttccttcctttcacagatcttaattttatgcttttcctagactttttctcaggaggaacatttatctgaataacctaatctgcaattgctagaagtgaaaatctcttctatttaattcttgttttcagggaattagagataagaaatagttcatcgtcaggtgaaaaaaaaaaaaaaaaaaaaaaaaccatgagtaacagctaatgatggttggagaattagggcccaaaaagatagtttgagactagaacaataagcagattttaacagtaattctaaatttctaaggatcggtaatctcttagagaatctgattagagttgtggagccagaaaaatacacatggatacatttgccaaacatattaatataatttaacaaggttcaaaatccatgaagctcatccatgtttcctgtaatattctacagacgtcctgctcaattaagataaaatgtaacaactatcgaagtaaatttccaatatattcaattacataagtatatgattagcatttacttggccctgagttttgattaacactgtgacaaggctgttcctaaaaagtaattcgatcttaggcaggatcaagaaacattctagaatagtgtcctgtcatctggagtatctggcagtctttcttggagtattatacggaagtatgggggcaattaaggaatactaataatttaaactgtaatcagagaagaaaccaggatgatgaataaacttaaagccaggttatgtaagaaacaactgaaggaacaagggatagctaacttacagaagaaaacatttagtgcgttcatatatgtgaaaggacatctaaagaagacagatgcatgaagtcacagagaaattaattttaaaacaatgggggggaagataatttaacattaagactaaagttcctactgcagttactagaggtactgaaacacaggctccacagtcattccagaaatactgtaggaaatttatgtagaggtataaaattaaactagttattacctaaggtttctcttaagattaggaattcattttttataagaggtcattttaaaatttatgtgtaaaggaaagagcagggggactgatatttatttttcactgtaaatattcagacttccatgaatacaacttcttttctcaaataaatatttatagaacttaaagcaataagtatttccaggtaaaatattaactaagtgaaatgacataaacaaagaaatttcactttcaggtgctaaggattacataagagtttaaagataaagactaaataaatgaaatttagagaaaccaagatacctgttttctcttacttgttgcctcatcttttcgtcctttagactttcatgtttcagttttgccaattccatagccagtttttcttcttgtttgagctggagttctttcaatctcttgttttcttctgcctgaacgaaaaatttaacttcgttgtttgtcctctagaatcagatttttttcatcaaggttgaatttgttttataacagaaaactaaatgccttaaggccaacaattgatgatgttttattttaaaatacaaaatgttgtttcaataaatactttttcaaaatattttatcatggaaaatttcaagtattgccaatagtaagaagaatatttaaatacactctcaggtacccatcacacatgttttcaaaaattgtcgacattctgctaatcttttttctctaccttccatttcactcttttttcccttattctttttctgctagggtgttttaaaacaatcctagacatcatgtcacttaccatgtaaataattcagtatgaatatctacctgatcagaatttttaaaaatataacaatcatgtcatcaacacgtctaattaacaataattccttaatgtctaataccatgttcatattcaagctttcccaattgtctcaacatacttttctagttggtttgcttaaatcaaaatccaaacaagatccacatattgcatctaattattatttttcttaagtctcttatatattctgtaacaatcacctctacacacatttttcccccaagccactgacttgttatagaaattaggacatacatcccgtagaatgttccacattttgcatttgactgattgcttccccaggatatatcactgaactttttttctcttttatatttcctgtaaaaatggcagaaagatctagaggcttgattaaattcagtatctaataaaaacacatgaaaagatattcaacatcattagccatcaggaaatgcaaattagaattgcaaggagatattactacgtacctattggaatggctaaaacaaaaaacagtgccaacaccagatgctggcaagaaactatcactcatatattgctgtgtgggaatgtaaaatggtacaggcattctgaaaatcagttttatagtttgatataaaactaacatgcagctgagcgctgtggcttacacgtgtaatcccagcactttgggaggctaaggtgggaggatccttaaggccaggagtttgagaccagcctgggcaacatagagaggtgctgtccttacagaaaattagccaggtgtggtggcacaaatctgtagttctagctgtatcaggaggttgaggtaggaggaccgccggagaccaggagttcaaggctgcagtaagtcatgatcatgccactgcactccagctgggcaacagagcaagaccctgtctcttaaaaaaaaaaaagcctccatgcaattatcacacaactcaacaattttacctcttaagcatttatcccagggaaatgaaaactttttatttaaaaacctgtatacaaatgtttacagcagatttattcataatagccaataccaaaaatactccagacatccttcatcatgtgagtggtcaaataaactgtggtacatccatactatgggatactactcagcaataaaaagaaaaagaatgcaagcaaaacttggatgaatctccatgaattatgctaagtgaaaaaagctaattccaaaagattacatacagtttgatgccatttatgtaacattcttggtacatgttattttttaataattgagatataattcatatagcataaaattcaccttttacaattcacaattcagtgatgttgtatattcacaatgttgtgtatctatcaccactatctagttccagagccttaaaaaaaatagactttgaagttttgggttcacaacaaaattgagcagaaagtacacagagttcccatatattccctgtccctacacatgctcagcttccccttctatcagcctcctccattagactggtacatttgttacactcagtaaacctgtatttacattacttaaacctatgcatcattatcacgcaaagtccatagtttacattaaggttcattcttggtggtacacattctatgggttttggcaatgcataatcatatgtatctaccgtacacaatcatttcactaccctaaaaatcctctgtgatctgtctattcaacccttcctccctaaaatcctaaaaacaacttacatttttactgtttccatagttttgcctttcccagaatgtcacatagtcggaattatacagaatggagcctttttggactggcttctttcacttagtaatatgcatttaaagttcctccacatcttttcatggcttcatagctcatttcattttggcactgaataatattccattgtctggatgtatcacagtttatccattatctactgaaggacatcttggttgcttctaaattttgacatttataaataatgctgctatatattataaacatttgtgctatggcagctataaagctgccatgttatatttttataaatgctatagatatatataggtgattgtatgtacacactatatatagcacatctgtgtgtacatttgtgtgtggcataaaatgtcaacactccagaatgtttacatcaccccaaaagaaacctgtaacctattagcagtcacttactattcctctcaccttttcccccaacccctggcacctacttatctattttttgtctccatggatttgcatattctggatatttcatataaatgaattcacacaatatgtggccttttgtatctggtttatttcacttagcaaaatgttttcaaggttcatccgtgttgtagcatgtatcagtaattcattcctttttatggctgtgtaatattccattgtatagatgtaacacattttgtttatccatttatcagctgactggcatctgggtttctactttctgggtgtcatgaataatgctgttatagacactcgtgtatgagtttttatgtagatatatgccttcaattatctcttgggaatatatttagtacccagctacaccacacctagatttctgacttgcagaaactgagataataaatgggtgttgttttaagcagctaagtttgtggtaattcgttacttagcaattgaaaactactacagcaactaacgtgtactcttcaaaattgtcaaggtcatgaaagacagcaaaaagtgaagaattcttacaaactagaggagacaaagattggagaagaaacaatgactggctgggcacggtggctcatgcctgtaatccactttgggagcactttgggaggccgaagaggacagatcatcttaggttgggagttggagacgagcctgaccaacgtggagaaaccccatccctactaaaaatacagaattagctgggtgtggtggtgcatgcctataatcccagctacttggaaggcctcggcaggagaatcacttgaacccgggaggcagaggttgtggtgagccaaaattgcgccattgcactccagcctgggcaacaagagcgaaattctgtctcaaaaaaaaaaaaaaaaaaaatacatatatatatatatatatatatgtgactatagtttattcaaatgcaaagcttgaggacagccactcaggaaacacaaactccaaaataatgggtcattgttccaacgtggggaagttaaggtttcacttatataggcagagacagagaagcttaacagggttgcaacattttccatataaggtcagtatacatattatagcaatttaattagttgcattccaaggaacattccatgagaaagggtaatgatcttgaggggtcttatctctggtgtctttcctaatcatttacagaacaagaataaggaagatttaatctgtaattggaaaagcagaagttgtagcagcatgctatgtgactcaggacacatagccacattcctctcaaggctaaaaactaaggatacatgacaactaaatgcaatctatggtcctcaagtagcaaaaacacattagtggacaaactgatgaaatctgaataaatctcacagttaacagtattccatgaaagctaaattctccattttgataacttttccatgattttcatctgtgtaagatgttaagaagtagtcaggtgaagggtatatgtgaattctctacactgtttttgcaactctcctataaatctaaacttatctcaaaataataagttaaaaatatgcatatttccaagatttgttcactgaaaaaacctggaagcaatgataacccaagaattatgagtaaacctagcacccaagttttcttgaaatattatttccactaaatgataacagcgcttcctggcacaatggctgattccaggtgtaggacaaaaaatataagagagaaattttgtatttgtcagggttctccagagtaagtgattatgaaggcaggcaagttctaagatctgcaaggtgagctggcaagctgaggaactaatggttttgttctagtttgagtcctaaagcctgagaaccagcaggctcaagacccagaaagagccaatgttttagtttgagttcaatgactagaaaaaaaggaaatgtcccagctgaaaggcaatcaggcatgaagaattctgtcttattcaaaagaaggtcagtctttttgttctattcaggccttcaactgatcggatgaggcccacctatattagggagggcaatgtgctttatactcagtctatggatttaaatgctaatctcatccaaaacaacctcacagaaacaccgagaatgatgttttatcaaatacctagaaaccccaaggcccagtcaagttgacacataaaattatcacaagcctagaacagtttgttttgacaaaaagcaaggaaggtatcaaagattaaggaaatattgtcaaaaggacacagagggccaggtgcagtggctgacacatgtaatcccagcactttgggaggccgaggcaggcagatcacttgaagtcaggagttcaagaccagcctggccaacatcgtgaaaccccatctctactaaaaatacaaaaattagcctagcatggtggtgcaggcctgtaatctcagctacttgggaggctgagggagaagaatctcttgaacccagaaggcggaggttgcagtgagccgagatggtgcggctgcactccagcctgggagacagatgaagactctgtctcaaaaaaaaaaaaaaaaaaaaaacgacacagaggcaatataaaagggcatccattggccaaggatgagataatttgagcatcaaaaataataataaatgcaattaagtacataaatatctatgagtccataaaggtatttttaaaaagagacaaagtcaaaaactaaataaaacaaaaatttaaaaacaaccacaacataggtagacaccaatggaagaaaataggacaccaattccttactctgaaaattaactgtctcctttttcagtaagaataaataaccctagtcaataacaaagtgtttttttgttgttgtttttttttttttttttttttttttttttttttttgtggggtgggggcaggggaacagggtatctgtcattcaggctggagtgcggtggcaagatcatagctcactgcagccttgaactcctgggctcaagagatccttccatcttggcctcccaaagtgctagaattatatgggtgagcaattgtgctggcccaaggtgaagttctttacagaggaatttcagctaattaaatgtgaaaggaataaaagaatcagaaaatcagtttttgtaaccactaatgaaagaaaaaattcttttgtgaaaccacagatgaaagtttgatgggaacctttacagtggagaaaccagactgtcttcctaaacccactgatcaatactggcatcactaaaagtggaacaaccagacctcatgtgttccctgttgtgacacaatgacaaagacagcatcacctatggagtattcttgccaaaaaaggtggaccgcaatctaattgtgtctttatggctaggttctatttagaggaaatataacagatagggaaataaattaaaggaacatgaggaagcaaacacgtatattcagaatgtgggctactggataaaacaactggcttagtttagcaagctaaaaacatgaagtcaaaaaagaaaaacacggtgaaggaggggctgttttcaattaagagggacttaaacagacataaccaccaaatacaccgtatgaatgttccttggatcttggttaaaacaaaccaactgtaaaagcagatttttgacacaatcacagaaatgtgtttatggaatgggtgagataatagtattatggtactccatgtaagaaaacatccatattttgttagatgtacacttaactatgtaggaaagagttggtgtgatacctgggatattctttcaaattaaagagaaaataataagaataggaaaaatatccaacccctaagatgtgctttctcagagttaaaaaaaaaaatcatatctaagcttttgaatttggaacacagaagggtggatatcattttttaaatttgcttttgttattctccacaaaatcctccaaaatgtttaacatacagcagctactcaaaaactactgacatatcagaataccttttatatatttatgagaattcacttctatcatgtctcaattcttattagtttcccttttctaccaccttaatcccttaaaatgttgagatatacctaagggttcattttctaccacttaataatgtatacattaatttcagtaaattttttaaaggcacccctaaatttttgtttttagaaatttatgaaaggcaacacaattgtacttacatgaacaaaactggtagtaattacagagttcatatttatgttaaaaaaaaatctgagtgcttattctgtaccaggcactattccaagagtcttgcatgtattaactcattattaaaacaatcctaagtaggaggtactattcttattccccattttatagaaaaagcataaaaaataaaagcaggctgggcgcggtggctcacccctataatcccagcactttgggaggccgaggcgggcggatcacgaggttaggagttcgagatcagcctggtcaatatggtgaaaccccgtctctactaaaaattaaaaaattagccaggcgtggtgttgcgcgcctatagtcccagctattcaggaggctgaggcagaagaatcgcttgaaccccggaggcagaggttgcagtgagccaagatcgtgccactgcactgcaacctgggcgacagagcaagactccatccaaaaaaaaaaaaaagtaaaagcaacttactcaagggtccgtagctaaggtatagcagtagtaggattcaaagacaggccggctccagaaacccaggtctttacgattacaccgagctgaggcacaatcaggcatcacttacctgctgctgttgtttatctactcatttccagcattaacagctgactttcatcgtttccaaggtgcaaaatgaaaaaaaaagtaacaatgaatagtaaaacttaccttttgaatggcctcttccatatccaactcaaattgttcattttgtaataatctgagaaattgcttgcgctgaacacggttatcattttcattctgcaccatttgattcctgatttgactgttgacgttttttagagcttggacatgtaattttttgcagtagttttcatctactaatttctgatgcctttcactacagctcaaatttctccttttggaaccctacgatggaagaaaaaaaaagatgcatattttgatattccaaaatctaattttaaaaaatgtattgatataaaccttagtaagaaaggatacgaagagcctggcttccttcctaaattcaaaggagtataccgaataaaaagtaaacgtggtaaatatgttcacatatcgattaaataggtactgttattattacctattttatagatgaaacatgaaaagtaactttacccaaggttctgcagctaataaatagctgtgctaggattaatcgcaccctacagacccagatctttactaccaccagggaatttctcctcccctcattccacccaccaccaccaccaccacgactaccaccacagggccataaagtgctgttcagaagctggtcagattttcctaacataaatgtaataggtcaattcgccgctatttatcaattcgctttctcctacacttttatatctacttatttcttcagaggttctattgggcagatttaaagatgtatttaatacactatgcgaaaagtgccaaaaaagctggaaaccaccgcgagcgtcccttctaatagcacctgaagcctccgaaagcaaatacaagttccccaattaatgaccagattaagcacttaaaatccttttttagaagcagatgagcgccaaactagaattaaatcaacaataaacaagtagtttcaagtcccccaactggctcaccatcttggctgacgaaaaataccccctctcgtgggaccgcggccaccacctcccgccgcaaacgcagcagccagcagccccaaggagcgcacctggctgcgcgcgctcgggtgtttacgcggcgtcttggcaacggtggagctgcgcgccctccgctcgaccaaaagt

SEQ ID NO: 783 - DNA, 80430 bp, Homo sapiens
ccgaagatggcggggcgaagtctgtgtctcacggtcagttcaactccaggctcctggggagcgtctgggttccggcgactaggacgcctaacttcctttaacttcgggtctgaaagtctgtggctcttttacagagaagcagcgttccagggactccgttcccgccacccgttcagcaaccctctacacctggacccgacctcctcgccttggaggaagaatataagtaagaaattcggcggttgaacttttccttctttctttcatctgaatgaggctgcttacaagtacttttttctggagactggctggatcttcgggaccactcactctgcagcattcccttctcgtcatctcgttcacctgccgtttatcctttctttgtctttgatctgagtagttcgcctgcgtattagaagatatttgaagtgggcgaaaatttagcccaagtaagcatgttgtttaatttaaaacgtagcccaagtaaacagcaagatactgttggaagttatttgggtagcaggaattgccacgaatagttagttcacttgatagtttaggttatttcgcttaatatcaagttcatagagtttaccttgtgtaaatttcctttaggttggtttctaaattgaaaggatgcttcccactgcaatcagaattaccattctcgttcaaatattccttttcttatctgttctcagtgtaattacaactatcctgacaacggtgctttcattcttggcccattctactcctcatccccaagttttcacacagcagccagtgtaatcttttaatttgatctaccatgcctttgcttaaaattctacagtagtttcctgttgcatttcaaaagctctgatcgatgtggctcctcctgcctcctctatttgatcttattccctcttccccttttccccctaaaactctccagcttcactggccttttagttccaaaaactcttccaggttttctttctatctcaggaaagagacagtcacacacgccttcaacctgtaatgtgagtggccttccttgaccatgctaagtaggctcccttgttggtctttttcattgtctcagtgatttttctttctaattagcataatttgttacaataaattcatttgtgaatttcctttttgtctgtctccactggactgtaagttccaagggcagaggcgatgtctgttttatttgccatcatacatacccttataaaaaagtgccttttaacaactcccttccgttttaatataaaataactagattaaaatttggaaatagttggcagtttgtatcagagggttaaactagagttatcgtatgatctacatatgatctataagcatatttgaaattaaaactgaaaggtactgtgtttaggtgaactatacacagaccaatttaccacagcaagtaggaagataatcatatcttcttctctctgatgaaatgggccgattatcccagttcaaaagtgtacttaagcaaattaatctgttttctatatatagttctttatcagctatgcctcaatcaaaacggttattttcattatcattaaccatatagtattaaatacctggattaggtttatttgttcagttatttgagagtgtattttgcacctggttctggtgcatccttagggatacagtcctgcttaaaatgagaaatatacagggactattattgtattctagcacgagttactttataaaacgagatagctaaacagtattatatggtggccagttgttacttgttctgttatctgtactctgagttgtgcacatctgaagcatatgaacagagtaactccctacactacctgaatcttctagaatacttctgtgtcatgtagaagagtaaaatgtctggccatccctgtaagcaagaatatgaaattataacagtatggtatctgttttgccacctgttgtcttggcattgatcattagaatgctacttcccagggacctcaatccaaaaccttttgcagttctgcttctgttggaggaaataatcactgtccgaaaggatagactaaggaagatgctaatcgctcaagtggatagatttttcaagcttcattcctgtattataataccagatagctaaacaataagataacataataactggtagggcaagccccctcataaatcgcaattacattggatttacagattaatttgtagagaactgacttatttatgctattgaattttccacgaatatgatacttctccatttatgggtttttacctttaatagtgttttatcattttactacataaaattcttgcgtatataatttgcttcaaggtactgaatagttgctatataataagtggaattttttctattttctaattggttataaatgtagaatttttagatgttgatgctacatctgcgtttatatacacacagatcttcagtcctgctgaactctcttattcattctgtgaattcccttggatttttgatgaagacaattatatgcaaattttgatcattttgtcccttgataattctcctacattctctctttttctctgtttaggacttcccgtgtgatatggaatagaaaaagtgatggtgagcttccttgtttatgattttgagaagcccacttttaataatcactacatttgaggtttgctctagggttttggtagattctttttattatgtttaaaattcttccccttaattcctaatttgaatgagtgttaaatgtatcaaaacttattttttccctaattaattcagctgttggtatgttctttttccctcctttaatgttttaacatactgaactacaaaggcaggtttcttgttttcctttaaagactgctagatttgattgctataattttatgtaggttttttgcatctatgaacaaaagtgaaatgggtgttgtagtttttctctacttcttttcctttctgtttttgatatcagtatcattctgtctgtatgaaagaagccgaatagttttccttttttgattcttttcttggaagctttttataattagagattttctgccctttgattaaaattgtgaaactgtctgagtctagtgttcttttattcaaggggattctttttgtctatgcatttagcttctttaatgattagatgtactatttctagaatagtttttggttatttctaaaataattttttgttctagaaaagtgttcatatcatgtatgttttaaaatacattagcataaactgagtctatggtggtatgtttgaaatcttgactgtatccataaccatgtacacccctccttttggtagctttccaatattgtttatttttgtctttttctttttctatcaagcttcctgggagatttatctgttttattggtcttttcagagaaccagctttggttttcttgctaatctgtgctattttaaaatttcattaatctttacagaaataaagacaaatgatctcttctaactggggtggattaattttttgttttttagtttatttacctcatttattgtttttcttatttcttaataaatatatttagtctttaaatttctctccaactgtaggttaactatattccaggacttgttttgatgtatatttcttttatggttatttagttctaaatattatacgattttcatagtaattatttagaagtgtgttttttagtttgcaagcacatagggttgtttgtttactgttgtctagtttttatttttctgagtatgtatgtgacaaggtcttgctctgatgtccaggctggagtgcagtggtgtgattatggctcattgcagcttccacctcctgggctcaagagttctcccaccccagcctcccgaggagctgggactacaggcgcatggcaccatgccatgctaatttttttttttttttgagacagggtctcaccctgttgcccagactggagtgcaatggtgtgatctcagcccactgcaaccttcatctcccaggctcctgagtagctgggactacaggcatgtgctaacatgcctggctaatttttgtattatattttttgtagtgatggggtttcgtcatgttgcccaggctggtctttaactcctggtctcaaatgatccaccttcctcggcttcccaaagtgctggtattacaggcccagcctagtttattttaaattgcattatgattagagaattgatgtgatattaagtttttaaatgtattgagacttatttgtggccaagtgcttgttcactttttgtaaaagttctatgcgttctttgatagaaaatgtatttattatttgttggctaatctgttttatatttgttcttcatgacatcggtatcctcaccttttttcttgttgcagctttattggtttctgttagaagtgtattaaaaatcatcaattataattatagtttaaaaaaattccttataatgtggccatttttgtttgggaatatcttgtttgacttatttaaatcttcttgattcattattatgcagtgtctatctttcttcatccctttatgttcaaactttgtatgtcatttatcagtaagagcattctttttataaccagtctgataatttctgcctattaataagtgaatttaatatatttacattattacataacttgaagttgtcttagccaccttattttttatattttctattatgtcttgtctttggttcttgtctgtcttctgctggattgaatgggttttcattatgtctttatttttagtgatgtggaaagacgttagaatgctttaacttggtgtcctctgtcttttaaattagataatattttactttgttgttttgaatacacccacacccagttaatcatcaatttttttatagtctgtactaatttagatttatcatgttttcagatatcttcataattctttttttccagattcaatttcctccttcctgaagtgtagaccctttattactttttgtgaaaacctgagtcttaaactctccagtctttttgaaaattgttactttgcatttattcttcaattacagtttatctgaatgtaattctagatggccagcttttccttctcagcccattaaagatatccttatattgtctgttggtaatataaggatagaaatgttagaatgtcagaaatgttaatgagccatctgctgtcagctttttagataattatgctggtagactatttttctctgttgttttgaaataatgatttggtagtttagggagtactctctttaaaattctgtattttcactgtgatgtatacacaggtggatttgttttctttattcttcatgagatccatgtcttcagtttgggaaattctcagcattagctcttgaaatactgtcattctctcctcttgggatttctttttttctcttttggagacagagccttgctctgttgcccaggctggagtggcagtggcacgatcttggctcactgcaacctccgcctcccaggttcaagcgattctcattcctcagcctccccagtagctgagattacaggcatgcagcaccacacctggctaatttttgtatttttagtagagccggggtttcgctatgttggccaggctggtctcctggcctcaagtgatcctccctccacctcccactgtgctgggattacagatgtgagccactgcacccaggcctctctgggatttcttttataacttctgttaagtaggaacataacatctgtcttcaatggatgttaacctgtcttttgtgtttttatccccttgttttctgtatctccttgtaggtgatttatttatatctgtcttctaattcactcattccttctatgcccattatgctgttcaacatatctgtcaaatttccttgagttcttaatttcagtgactgtgtttttcatttatgtaatttatatttggatctttttcaaattcagcattcttttatgataaaatctggctcttgcctaatgtttttctaagtgcattttttttttccaaattaatgctaattttaaaatctttttttaattgttatattatctcttgttcttatagtataaattttccctttcctcacatctgctgattctctctttcagtggcttgtttctttatgcaatttgttacctttctgaagtcatctttagcagtttgctttttgagagagtcctatatattctagatgagtaaatgttcctatagggtggttttcaatttacctttactagtttcgagttttgattgattccacgtcagctttcttctattttaaagtttttccatggtgtccttgtatcacctagataagatgaatttggacttccctcttgtttgttttaattactcacaagagaatcttttctacctgtggttctagtttcatttctgctcacctaaggttgtgggtagaatttttgtagtctgtgtttcacaggtgtatcccttcatgactcacatacatcagcttctagcttttaagctattttggcttctgttcctgtttgttgctctcactttgaattgctgctttattcttagtaccagggcatttcccttgcctgagtttgagcttagcaatatttcctccattacattttatctggcatttccatggatttagagtagcatagtcttctcagtcatcttggtccactatattaattggaaacttaatccttgtgattaagtccttgttagggaaatttgaaaaatcaggtaatggcactttaaaggcacctttaagtctttcttagatatttttcttttgaccaggtaatcctaagatataaaaatatttcttaaagcttcagactgttaaaggatatggtactaatctccccccctttttttttccctgggggtggagatggtgttttgtgttacttctgaatcccatgtctaagaaaaacaagatatctaatttttaaaatccttaacatgtctccttcacaaaacctcagaagatcctaggtggtctagaaatgtgacatctcaacaggagaaaaaagttatatgcttttgaatatatttattatggtgttaacctttaaaagtgaaaaggggacttaacaatagggacagagttcagtacattatcttaattgcaatttaatcgtatagcagtttaacatgcttctaaagattacgtgaagatagatattccttttatattgctgtgggaaaacagtacaaaattgtgtgtatgctatagatgaaaattggaagggaatattaaaaataaaaatggatggtggtggtaggattatgggcagtttttcgtttaaaaacaatttttttcaataatattgtcatccttgcagtcttaatataggaccaagtaaatagtatttctattcttgctagattccaagtagaatgaaaaatcataattaaaaaaggagtgacaggtagaggtcaaaatagtcacctttatttccgaggaagcttgatattaaagtatgtatctgaggtgtgagccacgttgggtctgctcactaaacctcacatttagctccccagttatagcaataccccaaaccagagcaggtctcccccataccgtgcccacttctgcccacattagagcagggcctgtctctggagaagcaaggttagaatttgcattctttgcaggtaggctaataacgaggaggtggtgagtggaacagagttgaactcacccagcttattcttcccaaatatattagataagttacgtcacttgaaattaatagagggccacagaaaggctaatacttagtgtttgagttcctactacaaggaaggaggaatcatggggagttgaggataagttcttaatggctgtgttcattttagagtaagaatgccatatgtatattttggcatttgttgattacgtcacttgataacgtgtaattgctgaagtttattttttatttttgttaagatcttcagtatatcccaattattttctgcttttaggcgtttaaatgcagaattgcaggcaaaaacagctgacgtggttcaacaagctaaggaaataatagtaagtatatgtacaattattaataattctatataaatgctagttttttatctttttcatttgatatatgacatatatacaaaacactagccaaagcatgtgtgttcagttcaatgaattattacaaattgaacatgaatatatatgcataggtataggaatgtatatatgtatatgtttttagtaagcacacattttctaaaagccactgaaaaagtactttccatttagattctccagtcatctaaattctcattataaattctcattattaattgatagaatagagcaactctccttagaggagtagtctactttaaaacttttatcagttcttagttaattttgattcttactttctatcctccctatgccccaaaatggagttgatggaagcagggaaggaaacctaggcaatattttatcttcatgccttatacaaatccatgattatttgttagtttaggaataagaaatgtatcatatataacatttcaagtaatatattttgataatggttacagatttgtattttataatttataattagatgttttactaaaaatatttataattaaatttatacttatatgttttactaatttataattaaatgttttactacaaatatttttatttcatcttttagtttttgccagtgtctgaaaagcaggaaaatacttgtacaaaaggaccccacgttatagtagaatgacagattcattacgttttctactcagagagccctgtaaaaagaatctccccctgcaaataaaaaacagaatagaaaactgggataagctaggaaaggggttggggaatggattcctacccctgcagaagcaaacaatataaggtttctcatatttaatttttatttactcactttctctttttaaaatttttaatgtttgtggttacatagtaagtgtttatggggtaaatgagatattttgatacaggcatgcattgtgtaataatcacatcatggaaaatggggtatccatcccctcaagtatttatcctttgtgttacaaaaaatccaattatactattttagttaatttaaaatgtacaattaaatgattttgactataataaacatgttgtgctgtcaaatactaggtactattcattctttctgactatatatttttttacctattaaccatccttatctcccacccctgcatcccccattacccttcccagtctctgataaccattcttcaactctctatctccatatgttaagttgttttgattttcagatcccacaaataagtgagagcatgtgaagtttgtctttttgtgcctggcttatttcactcaatgacttccagttacatccatgttgttgcaagtgacagggcctcattattttttatggctgaatagtactccattgtgtatatgtatcacattttatttatcgattcatctgttagtggacactttggttgcttccagatcttggctattgtgaacagtgctgcaacaaacatggaagtgcagatatctctttgatatattgatttctgggtcaaatggtatttctagttctagatccctgaggaatcgccacactgacttccacagtggttgaactagtttacagtcccaccaacagtgtaaaagtgttcctatttctccacatcctctccagcagctgttgtttcctgactttttaatgattgccattctaactggtgtgagatggtatctcattgtggttttgatttgcatttctctgatagccagtgatggtgagcattttttcatgtgttttttggccgcataaatgtcttcttttgagaagtgtctgttcatttcctttgcccactttttgatggggttgtttgtttttttcttgtaaatttgtttgagttcattgtagattctggatattagccctttgtcagatgagtaggttgcgaaaattttctcccattttgtaggttgcctgttcactctgacggtagtttcttttgctgtgcagaagctctttagtttaattagatcccatttgtcaattttgtcttttgttgccattgcttttggtgttttagacatgaagtccttgcccatgcctatgtcctgaatggtaatgcctaagttttcttctagggtttttatggttttaggtgtaacgtttaagtctttaatccatcttgaattaatttttgtataaggtgtaaggaagggatccagtttcagcttatacccaaaggactataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaattgctgcatattctcactcataggtgggaattgaacgatgagaacacgtggacacaggaaggggaacatcacacactggggactcttgtggggtcgggggaggggggagggatagctttaggagatatacctaatgctaaatgacgagttaatgggtgcagcacaccagcatggcacatgtatacatatgtaactaacctgcacattgtgcacatgtaccctaaaacttaaagtataataataataaaataaaaaaaagatatattgatttcccctcttttggacctatacgcagcagtgggattgctggatcatatgataactttagttttttgaggaacctccaaactgtttcctttgtagttgtactaatttacattcccaccaacagtgtactagggttccctttctctacatccttaccagcatttgttattgcctgattgcctgtcttttggatataagccattttatcagagttgagatgatattgtagttttgatttgcatttctttgatgatcattgatgttgaacacctttttttatgcctgtttgccatgtgtgtgtttttcttgagaaatgtctattcagatcttttgctcatttttaaattggattattagattattagattttttttcctatagagttgtttgagctccctatattttctacccttgtcgatgggtagtttgaaaatattttctcccattctgtgggttgtctctttactttattgtttccttcactgtgcagaagctttttaactttatgtgatcccatttgtccatttttgctttggtgacttttgcttgtggtgtattactcaagaaatctttgtctactccaatgtcctggagagtttccccaatgttttcttatagtaatttcatagttttgagatcttagatttaagtcttcaatacattttgatttgatacttgtatatggcaagaggtaggggtctagtcttcttcttctgcatgtggatattccgttttcccagcaccatttattgaagagactgtcttttatccagtgtatgttcttggcaaccttgtcaaaaatgagttcactgtaggtatatggatttgtttctggattttctctattctgttccattggtctgtgtgtctgtttttatgccagtactcagatgttttggttactatagcaccatagtataatttgaagccaggtaatgtgatttctcaagttttgttctttttgcttagggtagctttggctattctgagtctgttgtggttccatataaattttaggattgttttttctatttctgtgaaaatgcgattggtattttgcaaggggttgccttgaatctgtagattgctttgggtagtatggacattttaacaatattgatttttctaatccatgaactggaatatctttccatttttttgtgtcctcttcaatttcttgcattgatgttttatagtttttgttgtagagatctgttactgctttggttatgttaactcctaggtattttatttgtggctactgtaaatgggattacttttttatttattttttagattgttgacatacagacacactactgatttttgtatgttgatcttgtatcctgcaactttactgagtttatcatttctaatagtttttggtggagtctttaggtttttccaaatataagagcatatcatctgtaaatgaggttaatttgacttcttccttctgatttggatgccctttatttctttatcttgtctgattgctctagttaggacattgagtactatgttgaataacagtggtgaaagtaggccagatcttaaaggaaagacggtcagtttttcccattcggtatgatactagctgtgggtctgtcatatatggcttttattatattgaggtctgttccttttatactcatgttttgaagtgtgtttaccatgaagggatgttgaactttatcaaatgcttttccaggatcagttgaaatgatcatatggtttttgtccttcattctgttgatatgatatatcacattgattgatttgtgtatgttgaaccatccttgcatccctggggtaaatcccacatggtcatgacaaatggtctttttaatattcagcaaactgaattctgtttgctagtattttttgaggatttttgcatcaatattcgttagagatattggcatgtagttttctttttttgatgtgtctttggttttggtttcagggtaatactagcctcataaaatgagtttggaagtattccctcctcctccaatttttggaatagtttgagttggtttggtattagttcttctttaaatgttcgatagaattcgcagtgcagccatcaggtcctgggcttttctttactgggaaaattttttattgtggcttcagtcttgttacttattattgttctgtttagttttggatttcttcatggttcaatcttggtgggttgtatgtatgtgtctaggaatttatctgtttcctctagattttcctatttattggcgtatagttgctcatagtagccactaatgagcctttgaatttctgcattgtcagttgtaatgcctcctttttaatttcatattttatttatttgggtcatctcccttattttgttagtctgttaattttgctcatctttaaaaaaaaccaactttttgtttcattgatcttttctttatttcaaattcatttatttttgctctgatcttcatttcttttcttctactaattttggtttggtttgttcttgcttttctggttctttaagatgcattgctggctggatgtggtggctgatagctgtaatcccagcactttgggaggccaaggcacgtgactcacttgaacccagaagtttgagaccagcctgggcaacatggtgaaactccatctctaggaaaaatacaaattagtcagatgtggtggtgcacgcctgtagtcccaactacttgaggggctgaggagggaggattgttgagcccaggaaggtctaggctgtagtgagccatgatcatgccactgcactacagcctgggcaacagagtttctctctatctcaaagaaacaaaaaaaaaaaaagaaagaaagaaaaaaaaagaaaagaaagaaagaaaaagaaaagatgcattgctaagtcatttatttgaagtttttgttcttttttgttgtaggcacttacagctgcataaatttccctctcagtactgctttcactgtatcccatagatcttggtatgttgtgttttcattatcatttgtttcaagaaatttctcagtttccttcttagtttcttcattgacccattggtaatttaggtgcatatcatctaatttctatgtctttgtatagtttccaaagttctggttattaatttctagttttattccatgtgatcagagaagatgcttgatattatttcagtttttaaaatattttacaacttgttttgtgacctaacatatggtctgtccttgagaatgatatacatgctgaggagaataatgtgtatctgtagtctttggatgaaatgttctgtaaatgtctattgggtccacttgttctgcagtgcagattaagtctgatgtttgttgagtttctttctgggagatctgtccagtgctaaaagtgggtgctgaagtctccagctattactgtattgtggtctagctctctctttagctcgaataatatttgctttatgtatctgggtgctccagtgttgcatgcatttatatgcaatcattatatcctgttgctggattgacctctttagcattatataatgaccttctttgtctcttcttacattttttgttttgaaatttattttgtctaagtataggttctcctgctttttttttttggtgtagaatatctttttctaccctttttattttcagtctatatatatatctttattaagtaaagtatgtttcttgtaagcgacagatcatggggtcttgttttatcatccattaaaccagtccgtcttttgattgaagagtttagtgcatttacattcagtgttaatactgataagggccttaatcctgtcatttcattatttgttttctggttgtcttgtggcattccttcctgtcttccttttattgaaggtgattttctcttgtggtataatttaatttcctgatttttattttttgtgtggtcattgtatgttttttggcttgaggttactgtgaggcttgcaaatactatcatataacccattgtttaaagctgatgacaacttgacgctgattgcataaacaaacatgcaaaaagaaaactaatacaaactctacactttacttttatctccctagtttttaacttgttgttactgtttctgtcttactgtactgtctatgagttaaaaagttgttgtagttattatttttaattggctcatcatttagtctttctactttagagtagtttacactcaattacagtgttataatattctgtgtttttctgtatgtttactattaccagtgacttttgtaccttctgatgatttcttcttgctcattaacatccttttcttttagattaaagaactgtctttagcatttcttgtaggacaggtctagtgttgatggaatgcctcaacttttgtttttctgggaaggtctgttattatctttcatgtttgaaggatatttttgctggatatactattctaaggttaaaatctatatttttttcttcagcactttaagtatgtcatgccactctctcctggtctgtaaggtttccacggagaagtctgctgctagatgtattggagcttctttgtatgttgtttgtttcttttctcttgctgtttttaggatcctttctttatctttgacctttgggagtttgattattaaatgccttgaggcagtcttttttgggttaaatctgcttggtgttctatagtcttcttttacttgaacattgataactttctcaaggtttgggaagttctctgatattatcccttcgaataaactttctacctctctctttctgcctcttctttaaggccaataagtcttatatttgcccttttgagcctattttctagatcttgtaggcatgcttcattcttttttcttttgtctcctctgtattttcaaatagcatgtcttcaagattactaattcttctgcttgatcagttctgctattaagagactctgatgcagccttcagtatgtcagttgcatttttaactccagaatttctcgattctttttaattatgtcaatctgttcgttaaatttatctgatagaattttgaattccttttctgttacttgggtttctttgagctttctcaaaacagctattttgaattcactgtctgaaaggtcacatgtctctgtttttccaggattggtctctggtgtcttatttagctcatttggcaaagtcatgttttcctggatgatcttgatacttgtagatgtttgtcactgtctaggcattgaagagttaagtactgtagtcttcacagtctgggtttatttgtgccagtctttcttgagaaggctttccagttatttaaaggcacttgggccccctgcccaatatcactagggtttttgcagacttgtagaggccttggtggtcttggataagatctgaaagaattctctgggttaccagacagagactcgttctcttcctttattttctcccaaacaaatggagtctctttctctctgtgctgagctgtctgaaactaggggtgtggtgatgcaagcacccctgtgcccagcaccactgggattgtgctccgtcagacctgaagccagaacagtactggatgttgcccacaacctgctataaacactacctggctaccacctatgttcactcaaggccctagagctctacaatcagcaggtgatgaggccagccaggtttgtgtccttcccttcagggtagcgagttcccccaggccctgggtgggtccagagatgctgtctggtagtcagagattgaagttagaaatcttagaaatttatctggtgttctagtgttttgtggctaagctggtactcggactacaacataaagtccttcctgctgttcactcccctttccacaggcagaggagcctctccttgtggtcaccaccaccaccagtccatagcagggttctgccaggccactgctagtgttcacttaaagcccaagggcttttcagtcaggtcgtggtgaatgttgccaggcctgggactcacccttcaagggagtgggctcccctctggccctgggcaagtctagaaatgctgtctaagagtcaaatcctggaatcaggcaccccaagagtccacgtggtgctctgccctgctgtggctgtgctagttcttaaggtgcaagacaaaggcccctttacttttccctttgctttcacaagcagaaggagtctttcactgtagccactacaactgggaatgtgctggatcacccctgaagtcagtatgtctcagagcccaaggcccatggcctgctattaataccttggtattgctgctggttatttggggcccaaggtccctttatttagcaggtgatgaatgctgtcagaactgggtccttcccttcaaggcagcagattccctcttggcccaggatgtgtctagaaatgtcatttaggagctagggcttgtaatggtggctgcgtgactctgcctggcaccctgttggctgtcttccatggccgaggtggtatccgagatgcaagataacatcctctttactttttgttctcctctccttaaacagaaggaatgagacacttttgttgctgtgaactgcactgcctggtgttggggaaggcatggcataagcaatcctttagtgccctggttggtgttttcctaggtcacaattggtgtctccctaggtgccagcctagtcctctggctctgagtcaagcccagcactaggatttgcctagaaaatggagccattgtatcctagactgcccttcaagtttacctaggaccccagagcactttggccagtagtggcaagacttgctgacaaactggagttctgacccacaggatgggtgattttcctctggctatagctggtccagatgcttcctccatgcatgggtactcaaagtctccgccccgcatgactttgctctccactctgacagggcagcactgagttcaatgcacagtcgcccagtcactgtgctgtccctcccctaagtgcacagactcttcaggctgcacagccactgcaggagtgagtcaggaaggggtggtgtcagctttttaagtctctccaaccttcttcaatgcctctttcaatgatatgaagttaaaaccaggtactgtgtttgctcacctgatttttggttcttgtgatgatgtttttgtgtgcaggtagttgttaaaatttggtgttcctgcagagggaatgaatagtgtaggcttctattccaccctcttgcctcactttcatttcttgatgtgtctttgccaaaagcttttacccctgatacttcacttttagcatcttcacagtcttctcaacattgaagtttttcctgatttgagacaaatttttctacccatttagtgaatttattttttaaatttcttgtgcctccttctaatttctgctgtatgctgtataagctggaagactctaaagggctggggaaactggagttagaaatattatgtaaaggccttgatattcttacattttccccttaggatggaattttttaacccagaacaaatgaaaggtgcaactagtgttatagaccttatcttcatactatagcatttagaattccgtgcctttatgttatggaaaccttggacaattctgaaatgatgaatgttcagagaggcacttgaatatatcttaatggtttggttttttttctatatgatatattacctatctttactcatttaagagagatcggcaagaagtacgatctaggcctgtttcaacacaaatgaaatcatgtgatgacgaagatgattacagtttaaggtaagtatcttaaattctcaagcaccttcttttaaaaggatgtacatggatcgttatgtaagatcttttttgcatgcaaacattgaaaaatctataatttgaagaataatgtatatatagggggcttataccaatcagacacagtgcaagccctttatctcatgtaattttcaaaatattattttgaaatgtatattcttgtcctcatttttaaaactttagagaggaaacaggaaaagtacataatcgatgtgaataaaactatgaaatcatattgtagcagacggaatgatgatcaccaaacattccaagtctcttacagttgtcattgggctatgaacagaagtttagttaatctcttccaagccaaaacagacaaaaattggtgtgtggacctccaaatgactttccagccatgaagatgagtaaaattccaattggtaaaatctcctagcctggtgtctgggtgaccgtgtgtggaccatgtagaaaaaaggatctttcttcgtcactactgctgcattgaatgggttaagccactggaatttttaggttactatcctgcttatctttgctaatgttgaaattggtattgggaatggaatgctgcataacaaaaattcagaagtgtggcattaccttagcagttaggtgggagccagcaaggaaactgatattggaggctggaaagataaaggattaatattatgtagtggcaatgaatttagtaaaactatcatctgtggtaaattgggaggcacaacaggtgtctaatgaacttgttctctggggaaagaggctgaaacacaatatcaacagtatgtcctgttaaagagacaagtttgggaaacatttggctgatttgtaagcagaaataaaagggaatacctgattatctaattcagagtcacaaagatttacgaccatgatttctttgaagagctttatggttttaactcttagattcaggttctttgatccattttgagttaatttttgtatgtggtataagagtcaacctccattcttttgcacatggatagccatttgtctcagcattatttgttgagaagactgttctttccccattgaatgttcttagcacttttgtcaaaaatcagttgactgcagacatatggttttatttttggactttcatatctgttccattgatctatatggttgtcattatgccaacagcacactcttgattacccttgttgtaactgtggagttgtggagtaagctggttttagacctcaagaattacaaggtaaaattgagaaaatctgtaaggaacaaaagcctatcaaaattcaaccttgagacaaatatcagactaaacatgtggacttcatgactactgatacaatttttcagtggattaaggctcctcaatgcaaggatcagattaaatggcacatagtgaaacttttcatttgggtaaaatggcccatggcaaagacctaactaaagttatagtctctccttagaagcttgacagtgttaaagtaacccatttttaaattgagaaagagaggtcaggtgaagaaataaataaataattagtcttggaaagaattgtaggtgatgtaatggcatgtagaactggctgaaattaaatagggaagaaacccactagtttgggggaaagttttatcagcaaagaaactctaacaatggactataattatttctggcttttaaaatattaaaacaactatgggtaccccgccttccagtattctaagatcaagaagtaggctataagaggtgcatagccctacagggtttagagacaaaagagaagcttattactgacatggcagtatatttggctcatgtgaaatattgggacattattcatttattcaaaaataattattgcatgcgatccagtatttcccttcctagatatttacccaagagaaatatagacatatatccacgaaaaaacctgcatgtgaatttttagatcaattttattcataattaccaaaacctggaaataattaaaatatttatcaattggtggctggataaacaaattatggtatatccatgcaatggaatactacttggcaataaaaagacatgaactactaatagaataacaacatagttgctaagtgaaagaagccaggctaaaaaacgtccataatctatgttttcacttatttgatgctctggaaaaggcagagctttagggacagaaatcaaagtggttgtctggggcttgagtaggagttaggggactaccaaggaacacaagggaactttttgagatggtggaaatactctctgtcttggtggttgtggtggttatgtgaccatatacattagctaaaacatattgacctgtatatgtaaaaagagtatattgtgtgatgtatcaattatatctcaaacctgaaaaaaataatttttgaacactgttagtgccagttctagctactggtattacagtggtgagtaaacagacctgatcttgcttccaagaagttaatatgtgttgcttttgagtattttttaagtacatcaattacacatttttatattttgatagacatatgtatgcgtacatataccatgaaaccacttatctttattatatgtaatactgtgatattctatgaaaaatagatatttaagttatcaaaattccaaactttggattatacataagattagacatgatgtttatccagtaaactaaagaactgaaatgatgctaacaacagatgatgatgttgtgatgatgacgctctgtttacctatcagtttttttttaatgcaactgtttgaacagatggcttttaccatgtaaaacatggcatttgttgatcagttgggaattcctgaatatgggagataattctataaagaaaccattcatttcaggttggaacaatgatattccacctaaataattataattaggaagaatatattttaataggtcttcaacacccaggatgactctgtcaaaaaatgtgatgggaaaccagagtttaatttcctaataacgtagtatacgtatcctccagtctgcttgaagcatggtttaccatacagttatttccatcatattacaaacagacatttcatggagttaaacaaaagtaagaataccatactatagcttacttttcatgaaaatacactagcaaagtaatatcactgtgaaatctgatggagacagataacccttaaatgtcttttggctgatatgtatgcatgtatgttggggaatggaatgaaaggtacagaaaatgtactaaaatgacaaacattaatttaaaatgaggaagattaaagaggacacttaaaatttgtataacatttggaaacattttcatgtcatttgtgagaatgatttagtttctgtaatttttaacatattttgaaagcctttttttcttcccagaggtatttctaatagttaagaggtttatttatctaagtatatctttgtatttaatatgaaaaaatttatgcatggctagctaagtgggaggcatctgatggaaaataattttagttgtatgtcttctccaatggttaggagttctcaggggatatagtggagttttttcatagcaataatggatgctaacatggtatgttttcagagatataaatacaatgcccaagacaatgggttaggcaaactttttctgtaaaggggcagatagcaaatatttttagatttgtgggctgtatagtctgttgtacctgcttaactttaaggttgtagtgtgaaaacagccatagataatacataaatgagtgagtgggtggattcagcctgtgggccatagtttgcagacctccataaacactccttgtttgaaactacaaatatattttgaaaaccttgtgtataaaaatgaattgcattttacgtgtatttattcatgcactcaacaaatacttacgccagtagtacctggcatataaacttttaaattgactaggcatagaatattgaacaaggcagacgtgatttctaccctcatagagttcacaatataatgaggaaaacaggcactaaccaggtgttttaagtggattaaaagaacagtaacattgagtgggcttacaataaaaagccctgtggtgaattatttgtaaaatgggtaattgctgtggatagcccacaattactctttatgatttccattcattaaaatttttgctacattttcctactagaatattggcattatagtgtatcttctcaaaggtgaattatttaaccaaagcatttttcttgtttatggtactcattcaaaataaattaacatgtgggtaactagaattatagcaaagtctgtttgattgttgaatattttccctttcaaatataattgttgaatttcattgtctcagctcagtgtcatctattattaatgtataatgtttatttttggcctgtagaggtctgttaccatctgaagggatagttcatcttcattcagaaactaaggtatgaaatcaaactttctgtgaatgcaattatattctgtagaactccggatattttttagacttttcttagacaaagcagagaaggggtatgactcaacagaaatagaatatgaaccttgatactcagagggatgcatttgtgaagtgtccctcataaactaaatggaatcctttgttgtctcataatttcactgaataatttggaggtatagtggaaaaaatgttaggtgaaatgactttgtaaactgaggcttatttttttttcctgacgcttaaatctagtagagagaagacttgaaaaagaatgatactcatatacaaagaaggtgatttgaaaagtttgtttgttcatttaaatagtgacagtgtagagatcactcttccaggtgtagaacatagtgggatctatgtttcccatccatggagacctaagccaagggaactgtatacctgaaggccacgggaggtctgcctggggaataattggttcatgaggagaactaaattctgtgagtcagaacgtccagatttattcatgacattccactggctagctgaataccattgaatctttaggactcattttccttatacttgaatttcttggttttggtgttatctaggtcttttccagctatacagttgtgatattcttgaaaacacatttttggtaattccatgaaaatagcaaatagcagtttttctgtgtagcaaaattctatgtgttacagaattgctttctttggcaaatgattagactctaattagtcaatactttcaattcttttcatgtagccaaagaccaaaaacattgatcctgtaaacaaggttcaaaacaaattacactctgcaaataaaggaaggaaaacaaattcaaggtatagtatagttttcaaagtatttctttttttttagttttgtaattcacaataccatcattcttaattattaagctctgtttgtttttccagatctttttacaccctaaacattaagttacaccacatatatcttatccacattcagtaatttagaacattttctactcaggaatgttttgcagcagttaacaaatattttatattgttctcttaagcaaaattgctaaatctaaaatttttataaatgttatttctagtgagttattctcttagaactgtgactacaactgggttttttttttaatctctgcctagttctcccaaataggctcaatagtgtagtttttgagtatttgacaaaatgcatatattattttgtctgttgagctacagaatgatttggcatgctctaaataggactataatataattataatttacattttgttgttttgggtgagaaagaattcaagacggttcttagtattataagcataaaaagggacccaagatgctccctaggataggatgccttctagaaaaggtggaggattgggttgcaccaaccatcttcagtaagttattaaatttatttgtctattacttacccaggctgatcattgtattgtaattctggaaaaatctttgttcacttttgtgtcttaattgtttaaataactttttttttttaataaaagggatggaaaaaatagagtgaagtgataaggaacagaaattaactatacaatagattgaagaaaagaacatacatgccacatacatgcatatataactggaaagggttatcttttcagacttcacatttttttaaaaaaagttgatttttcaaatagaattctgaagatcaagacctactatttgatagcacaatagggtgacgatagccaataataacttaattatatttttaaaataaagagtgtaattagattgtttgtaactcaaacaatgcttgaggggatggatacccccttctccataatgtgctcatttcacattgcattcctgtatcaaaacatctcatgtacctcataaatgtgtatacctactgtgtacccacaaaaaattaaaatgaattgtgaagcctttgcttatgttttaaaagtgaacttggctttcagaaccataaatttgttgatgtgtcaatgaattaggcctggactattcctcagtgcctttagaaatgagtttgattttgtctgtcttctccttttcattaaaaaaaattcacatccaactttttggttagtattgattgtggttaagaatgtgtttctttgggtggaaaaaatgttgtttgattgagctattagctcttcactctgtaattctttctcaaggggtatttttctttgctgtttgtagaattatggccaggatgatgtcagtttgtacagtttttctctagaagcgtgtaaatttaaaagtcataggctggatttgacctaggaggccaagtgcaatactcttagttttggtattgccttatttggaagcaaagtctataccatctggcctcataaagccttctctagctctgtggtcacatgattcataaaaaccaaaaatctgctaagtctcttgtaatatagtccttgaaagtatcacatgtagatttcatcataaatttaaaatgtgtaatagtagtctcttgtaatataatccttaaaaatatcaattacagatttcatcataaatttaaatttataataattttgatctgcttatttgggtaaaaggcatatatcctgtctacctttcctattttgttcatatgtacgtatatacatacatatgtatttaatttttattttttagtgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaacaggtagattttctttagttttttatttttatctttatagcacagttacttagaagaagaaatcttggggaactatttcttccatttaaaaaaatgtattgtgatgtcttggtttgtttcagaattatctagtaggatgtggtggagggaggaatgaatgggattatagattaaataaaattggccatgggtcagtcattgttaaagataggtggtgggtaaatgaggttcattgaactcgcctacttttatgtttcatattttccattataaaaagtaaaaataaaaaagactatattgtactgatttgattgaatacatttcaacttaagttaaaatacccattgcttattgttaaaatattaaaaaagtttttctgaattttttcatttactgttaatatattttatttattgcatgttaaatcaacacatgcaaaaggacaaatgaattgacattgcatcaggtaaaacaatcaaatgagtgttctaatgaatataatttttcttcttattaactcattctttgcatatcactagaataataatactaaattttgatcaactgaaaacattagtaaatttatgaggagcctcctatgctattgaaacaaaaaagtaagacaattgagtatatatgaactagttactgctgaactataatacaattaattgtgactacaggcaagccacttagcccctctgtaatagcagtttattcatttgaaaatttagtagtttgtattagatgatcattaagtttatgtattagtctgttcctgcactgctataaagaaatacctgagactgtgtaatttataaagaaatggtttaattggctcatggtactgcaggctgtataggaagcatagcagtttctgcttctggggaggcctcaggaaacttccaatcatggcggaaggcaaacagggagtgaggcatctcacacggtgggatcacgaacaagagacgggggaggtgctacatgcttttaaacaaccagatttcatgagaactcactatcatgaggacactactaaaagggatgatactaaaccattcatgagaaaccacccccatgatccattcacctcccaccaggccccacctccaacactggggattacaattcaacatgagatttgggtggggacacagatccaaaccatatcagtttatctttaaaattctctgattctgtgaaaaatcataatttatatgtataataattattgtgttactaatcacaagtagggagcagttttcttctgcacttactatatttactgatctaatcaagctttctagggctagttatggtaagggaaggtaaatggagcagtaagttgcctttaggtctctctaagatgctttagaggatgtgatgcacaggcattgattgttcctcggtagaggaacatggtcccatgtcccatggccctgttagaactttgcctccctgtgttccctttttagtatcactggcctaggtgtcttctcttttgggagaattttctcttattttagatgattgcttggaatggtttggttatgtgtgggagaaaaagaccaagaggtaatttgggagcacagattactttgtaagattaaagctagggtcgagtggggagcagagtttagtactgtgggcctccagacatgggagcactctgctccttgagttagagttgaggtagagttactaaggttagagttagggagaaaaagaaatgggaaaagtcatgctttcctattttttcttccctctttccctcagaggccaactactgtcaacttcaccctttttaatttgtcatttccctctactccctactcacctggagttacatgagaggctggtaggagagttgaggccaaagagacctaggtagggttagagccaaccataattcatcagctccatgataacactgagggcacttaaaaaagctggaagtgtgtatggagatgttttatgctctgcacgtcacatgtgtatggcttagtgagatttgtcctaatgacttctcagagcagttccaagtgtttcctcaagataaattccatgatggtaagggttgttttataatattcctactatgccattttgaacaaatcactgaatgacttatgagtgagttctaagttcagttttcactttatttactttatgggcctataaacttcaaagatttactgctgatattattgaataatgaacttttgctggcagtaaagtaccaaagatagatcctgaaggtttgtgggagaaagcttagacagtaaggtattagtgtatttctttgcttcaaagacacatatactacattttaactgctcagaaattgggatctgtgttacagtcagtggcattttgtaatcacagtggctgcactgaagctgagttttgctagagaagatttatgtttgtttctgccaaactctcagggacattactgacctgagaacactttaaataatctgatgtagtttggaccaccctggtgcgtgtgaatttagtctgcaaacttatgtgaatactacctgtgatttctttctgttgagtggatttattcgtcattgaccttttcattaggactgttgagtacctatagtgccccctaacagatatctcctatttgactccccatcttgagtattttcttctttataaagtaatggtctgtcttacaattgatgtcatcttagattcagcaaaagacagtaaatataattatttaaattcacagaagcacagatcagatttctaaaggccaaactccatgttatgcaggaggaattggataatgttgtatgtgaatgcaataaaaaggtaagttttaaaaacctcttaaaaggctctaatattcaaagatattttaggagcaatttcaattacattttttgaattactttatttagatataaatcatagttaaattttgaattcaaaaattgtatataagtactgaactttattctgagatgttgaattttcacagagctgaaatatcttaaattcttgctacaattagaattctctatattagtcttacaaatgtagtgtaagctattaaatgcaaataaaacatttgacttccatttttgaagataaaaatagactaatttgtttttcatgaaacgtgtataaatatcaaagaacatatgaaacgtctttttttctgctttgttttgataacaaatcttacatattttttcacataatctataactttataactataggaggatgaaattcagaatttaaagtctcaagtaaaaaattttgaagaagattttatgagacagcagcgaacaattaatatgcaacagtctcaagtagaaaaatacaaaactcttttcgaagaagcaaacaaaaagtatgatggattacagcaacagttgtcttcagtagaaagggtaattatttggtatttttcctaacttaatgccacagatacaagaaaattattaaggttacacatttgtatagatgccattttgacagttcagttattttattagtatttactgaaaactctttccccttacatagaatatttttaacaactttattgagatgtaattcacccttttaaagtatgcaattcaatggcttttggtgtattcatagaattgtgcaactatcaccacaaccattttcataatccctaaaagatacttcataccctttagccaccacaccctgaccctgctcccctcaatcccttacagccctaggcaaccactattctattttatgtctcaataaatttgtctattctggaaatcacatatacgtggaatcatataatatgtggtcttttgtgactgacttttacttaagatattttcaaggttcattcatgttgcagcccctatcagtattttatttctttttattggcaagtaacattctgttatatggatataacacatttaatttatctgtttatcagttcgtagctttaggttatttgggttgtttctactgtctgacaattttaaatactttgaatattcatgtacaagtttttgtgtgcacgtatgtttctatttctcttggttatatagccaggaatggaattgctgggtcatatggaaatcctatgttgaccttttgaggaattgctgactgttttccaacctgcctgtaccattttacattcctaccagtagtgcatgaagctcctaatttctacacatcctcaccaacatctgctagattatctttttgattatagccatactgcaagtgtaaaagggttacctcattgtggttttgatttgcatttccctaataactaatgatgttgaacatcttttcatgtgcttattggcatttgtatattttctttggagaaatgtctgttaaggtctttgcccattttttaaattggatttgaaaaaattactgaataataagaacttttaagttctttatgtgtttagatacaagtcccttatcaggtatattttgcaaatagttttcccctacagtgggttgtctttcactttctttatggtactctaaaggcacaaaagttttaaattttgatgaagtccagtttatctaatatttatttggtttcctgtgcttttggtgtcatatttaaggggagaatgtattttaaataaactatcctagcttatattagtgtgccattgtgaaaataaaaatatactgtttgagattgctttgtaaaatgtagtgacgataagaattatgtaatatagcatatcccgagatttagtaagaaaatgtgccccctttattagtacccttacatttctcgtttgtatggtcatatttaaaaaccctgctttttaaacattttggtcttgtataattagctttatcttgtaataaattttaatatcaaaatcacttagacaaaatttatatgcagtaaattcacactttttagtgtacaattctatgagttttgacaaatgtatgcagtaatataactatcactataattgagacatagaacagttccatcagccccccaaaattccctgtgaatttagtgaaggccttccctaattccaccaccaggcaaccactgatctgtgtttggttcttaaattttggacttttcccaaatgtcacataaatagaatcgcattggatatagacttttgaatctgttttttttttttttttttcagttagcataaaacatttgatatggtttggctgtgtccccacccaaatttcatcttgaattcccacttgttgcgggagggagccggtgggaggtaattgaatcatgggggcaagtctttcctgtgctgttcttgtgatggcgaaaaagtctcaggagatctgatggttttaaaagggagagtttcccagtgcaaactttcttgtctgctgctatgtgagacatgccttttactttccaacatgattgtgaggcctccccagccatgtggaactgtgagtccaataaacctctctcttttgtaaattgcccagtcttgggtgtgtcttaccagcagcatgacgatgaactaatccagtaaattggtactagtagagtcaggcgctactgaaaagataccaaaaagtgttgaagtgaccttggaactgggtaagaggcagaggttggaaaagtttggagggctcagaaaaatacaggaaaatatgggaaagtttggaactccctagagacttgttgaatggctttgaccaatatactgataatgatatggacaatgaaatccaggctgaggtgatctcagatggagatgaggaacttgttaggaactagagcaaatgtgactcttgttatgttttagcaaagagactggtggcattttgtccctcccctagagatctgtggaactttgaacttgagagagatgatttagggtatctggtggaacaaatttctaagcagcaaagcactcaagaggtgacttggtgctgttaaaggcatccagttttgaaagggaaacagagcacaaaaggttggaaaatttgcagcctgagaatgcagtggaaaagaaaatcccattttctgaggagaaattcaagccggctgcagaaatttgcataagtcttgaggagctgaatgttaatccccaggacaatggggaaaatgtctcccaaggtatgcagaggtcttcacggcagcgcctcccatcacaggcccagagacctaggaggcatgattggttttgaaatgtgaggacatgagatttgggagggtcttggggtagaatatggtttggctgtgtccccacccaaatttcatcttgaattcccatgtgttgtgggagggacccagtgggaggtcattgaatcacaggggcaggtctttcctgtgctgttctcatgagagtgaataagtctcaggagatttgatggttttaaaaatgggaatttccctgcacaagctctcgtctgccaccatgtgagatgtgcctttaccttccagcatgattgtgaggcctccccagccatgtgaaactgtgagtgcagtaaatctctttcttttgtaaattgcccagtcttgggtatgtctttatcagcagcatgaaaacggactaatacaacattcaatatttatccctattatagtccattcctttttattgctgagtagtgtaaactatgaatgaatgtacttcagtttgtttccccactcatctagtaataaaagttaattatagtatttaatagtctgaacttgtgtttccagtatggtagccacttaccatatgtggctaaattgcgatgtgctataactataaagtaaaaatcagattttgaagaattcatgtaaaacagaatgaagaatgtaaaatatctcaaaatctctttaatattttttgtattggttatatgttgaaataatatttgaatatattaggttaagtgaaatatgttattaaaattaattttacctgtttgttttaccttcttgcagtggctactagaaattttgtaattacatatgtattctgtattctatttctattggtctaagaaatatatataattggtctaaagggaaaaagctgtagtgtctaggggaacatccatgttttaatttgtcatgactttaccatttaccgttatgcacccaagctctgtcacatcactgttctagtctcagataatcttgaaaccttggttatatatttgattcttttcatgttcttggccatcatgtccaatcctgtgcaatttttcttccaaatgtttttcattcatcccttattttcagttcccattttgtgtccattttccatttcttatccattgtatactgtactttgtcagtagattaatgttgccaaagggtgacattgattatacttttccctttgtagggggagaatttttttttccctttgtatggggataattttttgagtgccatatgccagacaaaatgcattttatagaaacggaaactgactggccaggcatggtggttgatgcctgtaatcccagcactttgggaggccaaggcaggtggatcatgaggtcaggagatcgagaccatcctggctaacatggtgaaaccctgtctctactaaaaatacaaaacagtgcccttctaagatggccaaataggaacagctctggtctgtagctcccagtgtgatcaacgcagaagacaggtgatttctgcatttccaactgaggtacctggttcatctcactgggactgattggacagtgggtgcagcccacggagggtgaactgaagcagagtggggtgtcgccttacccgggaagtgcaaggggttgggggatttccctttgctagccaagggaagccatgacagactgtacctggaaaaatgggacacttctgcccaaatactgcgcttttcccaaggtcttagcaaccggcagacaaggagattctctcccgtgcctggcttggcgggtcacacacccacggagccttgctcactgctagtgcagcagtctgagatcgaactgcgaggtggcagcttggctgtgggaggggcatctgccattgctgaggcttgagcaggtaaacaaagcggccgggaagcttggactgggcagagcccaccacagctcagcaaggcctactgcctctatagactccacctctgtaggcagggcgtagctgagcaaaaggcagcagacaacttctgcagacttaaacgtccctgtctgacaggtctgaagggagcagtggttctcccagcatggcgtttgagctctgagaatggacagactgcctcctcaagtgggtccctgacccctgtgtatcctaactgtgacacacctcccagtaggggccaacagacacctcatgtaggtgggtacccctctgggacgaagctcccggaggaagcatcagccagcaatatctgctgttctgcaatatttgctgttctgcagcctccgtgggtgatacccaggcaaacagggtgtggagtggacctccagcaaactccaaaagaactgcagatgagggacctaactgttacagggaaagctaacaaacagaaaggaataggatcaacatcaacagaaaggacatctacaccaaaaccccatctgtagttaccaacatcaaagaccaaaggtagataaaaccacaaagatggggagaaaccagagcagaaaagctgaaaattctaaaaaccagagcacctcttcttctccaaagaattgcagctcctttccagcaacagaacaaagctgcatggagaatgaccgacgagttgacagaagtaggcttcagaaagtcagtaataaacttctctgagctaaaggatcatgatgttctaacccaacacaaggaagctaaaaaccttgaaaaaaggttagacgaatggctaactagaataaacagtgtagagaagaccttaaatgacctgatggagctgaaaaccacggcacgaaaactccgtgatgcgtggacaagcttcaatagccaatttgatcaagtgaaagaaagggtattagggattgaagatctaattaatgaaataaagtgagaagacaagtttacagaaaaaagagtaaaaagaaatcaacagagccttcaagaaaaatgggactatgtgaaaagaccaaatctacatttgattggtgtacctgaaagtgatggggagaatggaaccaagttggaaaacactcttcaggatatttcccaggagaacttccccaacctagcaagacaggacaacattcaaattcaggaaatacagacaacaccacaaagatactcctcgagaagagcaacaccaagatacataactgtcagattcaccaaggttgaaatgaaggaaaaaatgttaagggcagccagacagaaaggtcgggttacccacaaagggaagcccatcagactaacgggagatctctcagcagaaaccctacaaaccagaagagagtggggaccgatattcaacatccttaaagaattttcaatctagaatttcatatctagccaaactaagcttcataagtgaatgagaaataaaatcctttacagacaagcaaatgctgagagattttgttcaccaccaggcctgccttacaagagctcctgaagaaagcattaaacatggaaagaaacaactggtaccagccactgcaaaaacaggccaaatggtaaagaccatcaatgagaagaagaaactgcatcaattaatgggcaaaataaccagctaacatcataatgacaggatcagattcacacataacaatattaaccttaaatgtaaataggctaaatgccccaattaaaagacacagactcgcaaattggatatagagtcaagacccatcagtgtgctgtattcaggagacccatctcatgtgcagagacacacacaggctcaaaataaagggatggaggaagacctaccaagcaaattgaaagcaaaaaaaaaaaaaaaaaaaaaaaacaggggttgcaatcctagcctctgacaaaacagactttaaaccaacaaagatcaaaagagaaaaggccattacataatggtaaagggatcaattcaacaagaagagctaactatcctaaatatttatgcacccaatacaggaacacccagattcataaagcaagtccttagacacctgcaaagagacttagactaccacacaataataatgggagacttttacaccccactgtcagtattagattaatgagacagaaggttaacaaggatacccaggactagaactcagctctgcacaaagcagaccttatagacatctacagaactctccaccccaacagaatatacattcttctcagcacatcacacttattctaaaattgaccacaaaattggaagtaaagcactcctcagcaaatgtaaaagaacagaaatcacaacaaactgtctctcagaccacagtgcaatcaaattagaactcaggattaagaaactcactcaaaaccacacaactacatggaaacagaacaacctgctcctgaatgactactgggtacataatgaaatgaaggcagaaataaagattttctttgaaaccaatgagaacaaagacacaacataccagaatctctgagacacatttaaagcagtgtgtagagggaaatttatagcactaaatgcccacaagaggaagcaggaaagatctaaaattgacaccctaacatcacaattaaaagaactagagaagcaagaggaaacaaattcaaaagctagcagaaagcaagaaataactaagatcagagcagaactgaaggagatagagacatgaaaaacccttcaaaagatcaattaatccaggagctggctttttgaattttgtctatcaacaaaattgttagaccgctagcaagactaataaagaagaaaatagagaagaatcaaatagacgcaataaaaaatgataaaggggatatcgccacggatcccgcagaaatacagactatcatcagagaatactataaacacctctacacagataaactagaaaatctagaagaaatggatgaattcctggacacatacaccctcccaagactaaaccaggaagaagttgaatttctgaatagatcaataacaggctctgaaattgaggcaataattaatagcctaccaaccaaaaagaatccagaaccagatggattcacaggcgaattctaccagaggtataaggaggagctggaaccattccttctgaaactgttccaatcaatagaaaaagagggaatcctccctaactcattttatgaggccaacatcatcctgataccaaagcctggcagaaacacaacaaaaagaattttagaccaatatccctgatgaacattgatgcaaaaatcctcaataaaatactggcaaactgaatccagcagcatatcaaaaagcttatccaacaagatcaagtcggcttcatccctggttgaacaaggctggttcaacatacacaaatcaataaatgtaatccatcacataaacagaaccaacaacaaaaaccacatgattatctcaatagatgcagaaaaggcctttgacaaaattcaacagccttacatgctaaaaactttcaataaactaggtattgatggaacatatctcaaaataataagagctatttatgacaaacccacagccaatttcatactaaatgggcaaaaactggaagcattccctttgaaaactggcacaagagaaggatgccctctctcaccactccagttcaacatagtgttggaagttctggccagggccatcaggcaagagaaagcaataaagggtattcaattatgaaaagaggaagtcaaattgtccctgtttgcagatgacatgattgtatgtttagaaaaccccatcgtctcagcccaaaatctccttaagctgatgaggaacttcagcgaagtctcaggatacaaaatcaatgtgcaaaaatcacaagcattcctatacaccaataacagacacacagccaaatcatgagtgaactcccattcacaattgctacaaagagaatcaaatacctaggaatccaacttacaagggatgtgaaggacctcttcaaggagaactgcaaaccactgctcaatgaaataaaagaggacacaaacaaatggaaggacattctgtactcatggataggaagaatcaatatcgtgaaaatgggcatactgcccaaggtaatttatagattcaatgccatccccatcaagctaccaatgactttcttcacagaattggaaaaaactactttaaagttcacgtggaaccaaaaaagagccctcattgccaagacaatcctaagccaaaagaacaaagctggaggcatcacactacctgacttcaaactatactacaaggctacagtaaccaaaacagcgtggtactgctaccaaaacagagatatagaccaatggaacagaacagagccctcagaaataataccacacatctacaaccatctgatctttgacaaacctgacaaaaacaagaaatggggaaaggagtccctatttaataaatggtgttaggaaaactggctagccatatgcagacagctgaaactggatcccttccttacacgttatacgaaaattaattcaagatggattaaagacttaaatgttagacctaaaaccataaaatccctggaagaaaacctatgcagtaccattcaggacataggcatgggcaaggacacttcatgactaaaacaccaaaagcaatggcaacaaaagccaaaatagacaaatgggatctaattaaactaaagaccttctgcacatcaaaagaaactaccatcagagtgaacagccaacctacagaatgggagaaaatttttgcaatccacccatctgacaaacggctaatatatacagaatctacaaagaacttaaacaaatttacaagaagaaaatcaaccccatcaaaaagtgggcaaaggatatgaacagacgcttctcaaaagaagacatttatgcagccaaaagacacatgagaaaatgctcatcatcactggtcattagaggaatgcaaatcaaaaccgcaatgagataccatttcacaccagttagaatggcaatcattaaaaagttagcaaacaacagatggtggagaggatgtggagaaataggaactcttttacactgttggcagagtgtaaattagttcaactgtggtggaagacagtgtggcgattcctcaaggatctagaactagaaataccatttgacccagcaatcccattactgagtatatacccaaagattataaatcatgctactataaagacacatgcacacgtatgtttattgtggcactattcacaatagcaaagacttggaaccaacccaaatgtccatcaatgatagactggattaagaaaatgtggcacatatataccacggaatactctgcagccataaaaaagggtgagtttatgtcctttgcagggacatagatgaagctggaaaccatcattctcagcaaactatcacaaggacagaaaaccaaacaccgcatgttctcactcataggtgggaattgaacaatgagaccacttggacacagggcgggaacatcacacaccagggcctgtctggcgctagggagctggcagggggattgcattaggagaaatacctaatgtaaatgacgagttgatgggtgcagcaaatcaacatgatacatgtatacccatgtatcaaacctgcacgttgtgcacatgtaccctagaacttaaaagtatattaataaaaaaaattaaaatacaaaaaagccgggcgtggtggtgggcgcctgtagtctcagctacttgggaggctgaggcaggagaatggcgtggcgtgaaaccgggagggagcttgcggtaagcctagatgtcgccactgcactccagcctgggtgacagagcaagactccgtctcaaagaaaaaaaaaaaaaaaaaaggaaactgagtttgttggttaagcaaattacccaaggttatatataggtagtggcagaacaggattcaaactgtgtctgacaccaaagtctgtgttttttcaacaaatcatgtcattcccgaatcccccaaaattaaatgaacgtaagtaccatctattccaaaatcttatcactctttaagagtttaatacttgagacttctagttcacaatgaatgtactaagcagttatgatacactggctatctgaaggcttttataaaagcttccattggatctgaactttccagcttgcatccctatctaccctgccagataggtataataattctcatgggttatgtagccatgagaactcaagattgaatcattctctgctaagtctcattttatatctctatacaaacaaatctcggtgtacagttcacagaaaatgccagagcttgagtgtgatggacttgcttttataaatctgcaaaagccaaccatttttaaaattattatgtatcacttaagctgctaatgctaacagatggagttttctgaaatacaaaaacagaaagcattttacttcagcattggattttgtttttctgttagtgatttctttaaaatcaactttattgaagaataacaaatacaataaaacatacttgtttttagcttataattcaataagttttcacaaattaatattccctcataactactaccataatcaagataatgaaaatttatattacccttccagaatatcctttgtactcctgccccataaatctccaacctctaactatggcaccaggcagccactgagctatattttttcactacaaattagattttccttttctaaaatttcatacaaatgaaatcgtgaatatggacttttgtatatctggctatttttcttcagcataacatttttaaggttcatcaatgttttacatgtggtgtggttcatttccttgtattgctccatattacttatttatggatatgccatattttgtttatctgatcaccagttgatgtgacattcaatttttttctagtgtgggctattaaaaatccacagtgaatttccatgtacaagtattctgtgtgaacacgtttttatgtataccaaatacttaggagtggaatttgtgaattttatggaaagtgtatgcttaactttttaagaaactgctaaactgtgttccacagtgattgtaccattttacattcccactagcaatatatgagaattagagttactctgtatcatcaccaacacttgggattattatctttttaattttagccattctagaggagaagtagtagtatctcattgtagtttaatttgtatttcctttataactatggatattgaacatcttttcatgtgtttcttggccgttcatatatcttcttttgcgatgtatttgttcaaattttttgcccattcgaaaatactaagttgcaaattctttgtttacctatgtaattcctttattagaagaatatatattttgaatagtttctctcaatccgacttggatttattttctcaacagtgtgtttcaaaagacagcagttttaaattttgatgaattacaaaatgttattttcttgtggcttttgcttgtttacccaaaatattactttcttgtggttggtgcttttttccccattctatctaagaaatctttatccactccaaagtcatgagacttttctcctgatttcttctagaagtgttatagtgtttgtgtgtgtgtgtgtgtatctcaaaatcatatataaattgacctgtaatctatttcaagttcattttgtgtgtgacaaggatcagagttcacttttttgcatatggataatacagttctttcctcatttgcttaccatggcaccagtgaaggaaatgaattggctgtgtttatgtatgggtcttctttgaactattctgttatattgatatatgcatttgatataattcattaggaaagtcatgtgcactggagttttcttttggaaggatttcaatgaccaattcagtttatttaatggatacaagtctattctgattttctgctactatttgagtcagctttgctaatttatgtttttcgtggtatttgtccacttcatctaagtcagatttactggcataaatttgtacataatattcttgtattatgtttattatatttataatacctgtatgatgtgtaataatggcccctctttcatttctgatactgataatttgtctcttctgtcatttattcttaatcagtcctactttaaatgtatttacaaatctcaggtataatgcatttgctaccctcactttctgagaagtcaattccctctcccacttttggagatgattattaaacagttggtcttttttcctcaactttccaacaccccttccaacctccttattcttggctcatgactttgcttcctttttcattaaggaaacagaatcaaaagataactttatcatcctttcactaaatttacaacctcgctgcctctataccactccccactccagttaaagtgaattagtacctcttctgtctaaagctgacccctgcacttgtgcactggattctatatactctcttctactcaaggtctctgcactggcaattgtccttcctcttgcaaaatcaaatttactcttatcagattatactcattagtgtacagacatttcatagaatcattcatatatctattttaaaacttctttagatcttacatctacctccagtcctatatcattgctcccctttacagtgaagcttcccaaaattattgtttatactcagtgtctctatacctcatgtgccattttctcctgaaaatacttttgcttaggcttccatctctaccctgccattgaaactactcttaaaaaggtcaccaataatccacactgtagttgtggtccattgtacttggtcagttattcctcacatgaatttatatctcagcaatatttgaaatagttgattactccttccttgaaacactattaatttggcttctggagcaccacaatcatgattctccctcattttcctggccttacgtagtagagtgcccaagtctcttctctgtctatatctaatccttagattatctcattcagttccatggctttatataccatctatatatacgttgatcatcctcacatttttgtgtcttgcccttacctcttcctttctgcccacttgatatctctattgtgtgttaaacttcacatgtcctaaaggaagctcttgcttccctgccctcagcaaacctgctctcttccttctccctgtcttagtaaaaggcatcacccaattgttcagtctaaaattgaagagtcatcttgatctgttttcctatatccagatccagctcaccaacaagtcctgtcaattctgtcttcaaaatacatagaataaaccacttctcaaaacattcattacatctacccaagcccaagccactatcttttatttaaactattataataacctcctagattggcagtaccacagtggccagagtaatccttataaaatttaagtcagagccaggcgcagtggcttacacctgtaatcccagcactttgggatgccgaggcgggcggatcacaaggtcaggagattgagaccatcctgggtaacacggtgaaaccccatctctactaaaactacaaaaaattagccagcgtggtggcggttgcctgtagtcccagcttcttgggaggctgaggcaggagaatggcgtgaacccgggaggcggtgcttgcagtgagccgagattgcaccactgcactccagcctgagccacagagcgagactccgtctcaaaaaaaaaaaaaaattaagtcagatcatcacacacatacacatatgcatacacacttaaaatcctccaaaggcttcccgtgtcactcagaataaaatccaaatttctaagtaaagcttacaaggttcacctaggcttgtcctgcccacttctcttatcaaaacctaacactgtgcctatgtcactcggctgaaaccacactgaccttctaggtgatttttgaatatattaagtggattcctactacaggatctttgtcttcattgttcttattatctggaattctttccccaagatctttatttgattattttatttttttagagagaggatctcactctgttgctcaggctggagtacagtggtgcaatcatggcttactacagccttgacctccccagctcaagcaatccttctgcctcagccttccaagcagctgggaccacatacatatgccacaatgtccagctaatttttaaatttttttgtagagacaaggtctccctgtgttgcctagactggtctcgaactcctgggttcatcttcccacattggactcccgaagtgctaggactacaggcgtgagccactgtgcctggcctccctaagatttttacttaaatcattacctcacttcatttggaagacttccctgaccactttattttaaatagttttacccttccctcattgttctgtccctttaccctttttttcttgatagtccttaacactgccagatattacatatgtctatgtgtatatatgtgttcatcttctgtctcttcctctagaatgcaaatgtcatgagaggaggaactttggttaatttgtgtgcccatcatatagaatagtatcctgcatgtagtaagtgcttaataaatgtgttgaataaatgaatgaaacctattaggtatagataatattactcacaatttcagatatggaaatgagtctaccacagctggcaggttttctgattcctagtccattcttttctaccttagccacttgtttctgaaaccatatctgattatttatttatcctcatctgattatttcttatctgaatttctgtggtgcttcgtgttattcccagagcatttactacattttgtcctctgctgtggctgatgcatgcccctctcttttcttactctcccccagtgccttttatgaatgctttaataatcatgagagagtggtacatcatttcctcttgaagctcacagtatttgaattttaatgttaaatttgattttcttaggttttttttttaaaaaaaaactaatgtgcaactcaggacttcagatttttcgtgaaatttttgtctagcaacctgtaactccttaaatttttataacagtagaaatttgtttagtggatttactcatatagaaaactttacttcctactttactattcttgtggctatcatttttcccccacacctcccaagaagagggcagtattgattcagggataggggacatcatgtggtacaggatggttttcattttcctgtgaaataggttacaaagtcatcagcaggcaagaggggaaagattcatttctatattcttaagaaggaagactgaaatgaggcagcaagaaatgtggactttgtagctaatgagaatctttgccttttctatgtgaacagtgagataaatcaagctagctcttcctgtagctaccacccacaaagctgtgaagaaggctgtgatagcagatggtatccatacacagtttgatttgtttagaaacctacataaagagcagcatgtgttttgttttgtttttccccttaattactcagagccagggagaccagtttttaaataaaatgtagtgatatagccaggaaaaaattataaaagaatatagacaactgtatttttaacttcatcatttcaactctataatatttattgagtatcttctcaatttattgagtaaggctctggactaggccttactttgtaggggatataaagaagagtgggtttagtattacaaaataagttcagtttaactaacgtgtgttagtgtcttttatatcccactgaagtgctgagtatacagaaattaagacagttcttttcttcaaggagcttaaactatagtgggggaaataaagttaagggatagtttcagtaccacatagcagatatgatgataaatgtctctcaaggtgctatacaagctttgaagagggtacttaatataatctgggtggataatgaggattagaaaggaaatatgtcctgggagagctaatgccctagagtacaaatctagctgagtcagtaggtgctagctatgtgaaaatgagtgggcagagatcagggcaggaggaagagcacaggcgaagactgaggcaggaaacaccatggctgtttgggagagatccagttactgctggtattactgaaagtaacatctttggcaggagatgaggctggttgattatggtggagttaagagtttatcctctaggttcatgtttcttcaggtgttggcctgttgactctctgcaacagaatatcctaggatgtttgcagaaatataagactaaactcaccccaggatgtggaaaataatctataagatctgttgtttctacttagaattgggattttcctatagggctatatagaatgttgtgcatttaatgaatatattctgaaaagatttactttgtcaggtatacagaaaaacagtggagagtttctcttaacattggtctttttgggaggttcccaagagaagaaatacagttataatgagttgtttataaaatagaggacaggtatactgtgtcttgagtcaataaagagagagaaaattccaaacgaaaagtaatttgaaagcccggttcacaactacattttttaggatatatttctctaataccaatttgaggcaagaattccttgagacctctaacacttagtgttcagcctctacccccaagcgtgtgtgtgtgtgtgtgtgtaaagtttgagagaaagcaaggaatatggatatggaagatactgcaaaatgataaagggggaaactatgatatatttataaatgttccataatcttttttactatacaggaattagaaaataaaagaagactgcaaaaacaggctgcaagtagtcaaagtgccacagaggttcgcttgaatagagctctagaagaagcagaaaagtataaactggagttaagtaaattaaggcaaaataacaaggtatggaaaaattgaatagcttttgtagtgatcccttttggtaactacttcttttatgaacatgtcaaaaataatacttaaattataattcttgatgtcatgctgaacatttctcttttcagaagaaatatattcattagcagtatacacatttctaacatgttaggatgatatgcttgtctgtcgccattattgggtgatggcacaactctttggaagattgatttcttcaaccagttttatcaggtgcccatattatatgtcagacacttttctaagctcttagaaaaagttgtttaaaaaaagtatcttttgtatctcaagtcttttattcttctctgaacctcagttttctaatagataaagtaaggctctattttacagggcagtggttctcaaacttgagcatgtatcagaatctctgggagggcttgttaaatcacattgctgggtcccatccccagaatttctgatttaataggtctggagtgaggcctgagaaattgcacttttaacaagttcccaggtaaattattgtaaggatcaccgtaactccagtgtctagccaatgcttggcatagaattagcattcggtgccttaaatatctgttgaataaatgaaagttcaaataccaatgttcatgaaacccctttgtaccttctataaatattggttactttttggttctgtattgacctgaaagggtaataagtgatattacctatttaataatttttaaattctatttaataattaaatatttaatatttaataattaaataatttaatttatttaatacttaaataatttaatttatttaattaaataatttaataattaaataatttaataataaattatttaatttaataatttattatttaataattaaaacaatatttaataattaaaacaattctgtttaataattaaactatttaataatttaaaaattttaattgtggtaagctaacacataagatttaccttcttaaacattttaagcatatagttcagtagtgtaacatagattcacactgttatacaacctatccatgaactcttttcatcttgcaaaaactgaaactctctaccaattaagccactccccatttccacctccctctagaccctggcaaccaccattgtactttctgtctctataaatttgactgctctaggaagtaaacgtcagtagaattataccatatttgtttttctttaactggcttatttcacttaacataatgttaagtgactctcataattaaaacaatatttaataatttaatcatgacttggataatgaaattaggaaccaccttcattatatacacagataatacattttggattaagttagtaacacttaacaggaatagactgaaagtgaccttgatacatcctctaacatgtttgagaggcaaatatgtgccgtagtgattacagagttttaagatgtcgtctgtgagatagtttgttatatggtcaggtcattttcatattcaggggccatcaatgatggcataactgggatttattaatagaagttattacatgaacaagttaggaagtcatctttatagactcaccagtaattagcatgttattcgagtattatttccaatttggtgcattttacagggattttgaagaaaatgaagaataaccacctaggtatcaggatttcctaattgttgtagatttgacctctatattgtattagttcacatattaagaaaacagaaggaaaatggtttcatgaaacagatgactctccatattctagccagccattttgttttattttgttttaattttttttaggtttgtgggtacatgtgaaggttgcataggtaaacaggtgtcatgggggtttgttgcacatatatttcatcacctaggtattaggcccagtactcaatagttatctcttctgctcctctccctttttccaccttccccacttcaagtagaccccaatgtctgtttccttctttgtgttctgtaagttcttatcatttagctcccacttataagtgaaaacaagcggtattcggttttgtgttcctacattagtttgctaaggataactgcctctagctccatccatgttcccacaaaaaacatgatctcgttcttttttatggctacatagtattccatggtgtatacgtaccaaattttctttatccattctgtcattgatgggcatttagttgattccatgtccttgctattgtgactagtgctgcagtgaacatttgtgtgcatgtgtctttatggtagaatgatttatattcctctgggtataataccaataatgagattgctgggtccaatggtagttctgcttttacctctttgaggagtcaccgtactgctttgcacaatggttgaactaatttacactcccaccaagtgtataagtgttcccttttctctgcaacctcaccagatctgttattttttgactttttagtaatagccattctgactggtgtgaggtggtatttaattgtggttttgatgtgcatttctctgatgatcagtgatattgagcttttttttcatacttgttggccacatgtatgacttcttttgagacgtgtctgttcttgttctttccccaccttttaatggggttgttcttctcttgtaaatttgtttaagttccttatagaagctggatatcagacctttatcagatgcatagtttgcaaaaattttctcccattctgtaggtggtctttttactctgccgatcatttatttttctgtgcagaagctctttagtttaagtagatcccacttgtcagtttttgcttttgttgcagttgctttttctgtctttgtcgtgaaatctttgcccgttcctatgtccaaaatggtattgcctaggttgtcttccagggtttttatagttttgggttttccatttaagtttttagttcatcttgagttggtctttgtataaggtggaaggaaagggtccagcttcagtcttctgcaaatggctagccagttatcccagcaccatttattgaagagggagccctttcccattgcttttgtcaggtttgaagatcagacggttgtagatgtgcggccttatttatgggccctctactctgttccattggtctatgtgcctgtttttgtaacagtacctgtttttgtaccatgtgctgttttggttattgtagacttgtagtatagtttgaagtcacacagtgtgcctccaactttgttctttttgcttagtattgccttggctattcaggctcttttgtggttccatgtgaatttttaaatagttttttctaattctgtgaagaatgtcactggtagtttgataggaatagcattgaatctgtaaatcgctttgggcagtataggcattttaataagtgttcctatcagtgagcatgggatgttttttcccgttgtgttttctctgatttctttgagcagtgtttcgtaattctcattgtagagatcttgcacctccctggttagctgtattcctaggtattctttttgtggcaagtggggatgggattgcttttctgatttggctcttggtttggctgttgttagtatataggaatgctagtaatttttgtacattgattttgtatcctgcaactttgctgaagttgtttatctgccaaaaggagcttttgggacaagactatggggtcttctagatatagaattacgccgtctgcaaacagatagtttgacttcctatttggatgccctctctttatttctcttgcctgattcctctggttaggacttccaatactatgttgaatagtgttgagagagggcatccttgtcatgtgacagttttcaagggaatgcttccagcttttgtccattcagtataatgttggctgtgggtttgccatagatggctcttattattttgaggtctgttcctccaatatctatgttatttagagtttttaacataaagggtgttgaattttattgaaagcctgttctgcatctattgaggtaatcgtggtttttgtcttaattctgtttatgtgataaattgcatttattgatttatacatgttgaaccaaccctgtatcccaggaatgaagtctacttgatcatggtagataagctttttgatttgctcctggatttggtttgcaaatattttgttgaggatttttgtatcagtgttcatcaaggatattggcctgaagttttcttttttggttgtctgtctgccaggttttggtatcaagatgatgctggccccatagaatgagttggggaggagtccctcctcagttttttggaatagtttctgtaagaatggtaccagcttttctttgtacatctggtagaatttggctgtgaatccactgggtcccaggctttttttgattggtaggctatttattactgattcagttttggagctcattattggtctgtgtagggattcagtttcttcctggttcagtcctgggagggtgtacatgtccaggaatttgtccatctcttctaggttttctagtttgtgtgcatagaggtgttcatagtagtttctgatggttgtttttatttctgtggggtcagtagtaacattccctttgtcatttctaattgtgtttatttgaatcttcactcttctttactagtctacctagtggcctattttattaattttttcaaaaaaccagctcctggattcatttatcttttgactggtttttcatgtcttgatttccttcagttcagctctgatttttgttatttctcatcttctgctagctttggggttgatttcttcttgcttcttgaattctttcagttgtgaagttacgttgttaatttgagatctttataactttttgatgtgggcgtttagtgctatgaatttccctcttaactctcccttagctgtgttctagagattctggtatgttatatctttgttgttattttcaacttttttatttctgacataatttcattatttaccccaaagtcattgaggagcgtgttgtttaatttccatgtaactgcatggttttgagtgattttcatagtcttgactccagtttattgtgctgtggtccaagagtgtgtttggtatgatttcgttcttttacatttgttgaggattgttttttgtccaattatgtggtcagttttagagtatgtgccatatggcactaagaagaatgtatattgtgttgtttttgggtgcagagttctgtaaaggtatcatatccatttggtccagtgctgagtttaggttccagatatctttgttaattttctacctcgatgatctgtctaatactatggagagttgaagtctcccactattattgtgtgagagtctatgtctctttgtaggtttctaagaacttgccttatgaatctgggtgcttctgtgttgtgtgcatgtatatttaggctaattaggtcttactgaattcaacactttaccattctgtaatgcctttctttgtcttttttgatctttgttggtttgaaacgttttgtctgaaattagaattgcaacccctgcttttttctgttttctatttcctggtagattttcctctatccctttattttgagcctatgagagtcattaaatgtcagatgggtcttctgaagacagcataccatttgagtcttgcttttttatccagcttgtcactccatgccttttaagtggggcatttagactgtttatattcaaggttagtattaatatgtgtggatttgatcgtgctgttgtgctgttagctggttattaggttgacttgtttgtgtaattgctttacagtgacattgatctgtgtggttaaatgtgtttttgtcttagctggtagtggtctttgctttctatgtttaatgcttctttcaagagctttggtaaggcaggtctggtggtaaagagttccttcaacattcacttatctgaagaggatcttatttctccttcacttaggtagcttagtttggcttaatatgaaattcttgagggctttttttttttctttaagaatattgaaaaattagctgggcgtggtggtgggcgcctgtagtcccagctacttgggaggctgaggcaggagaatggcatgaacctgggaagtggagcttgcagtgagccaagattgcaccactgcactccagcctgggtgacagagcgagactctgtctcaaaaaaaaccaaaaaacaaaaaaacagatgtgatccttgtagctgtgcacctatcttataatgaaattgaatgtttagataatccatgaagcaacacctagataattatcgaatttagataatctatcaaagctaaggtgcaactgcaataaatgctgtggaaagtatatggtgctttgagcaagtaaccaagccaataaatgccttttttaaaaacatccaatgagcatttattataacacaactggctactatagttcttttgcatttccatgtaagtttttagaatcacatttggagttttgataggcattgtgttgaatctatagatcagttttgggaaaattgacatcttaatagcgtctttaaagtcatgaatagagaaaatctgtttatttaagccttcttcaatttttccaagcagcttttatatatatatagtttccagaatacaggttttacacacttttttttcaaacttatctcttagtgtttccgttttttgatgttataaatgttctttaaattccagtttcccattgtttgttgctataatggagaaatacaatttatgtttgcatattgagtctatatcctcaactttgctgaactcacttattctagaagccttaggattttctacagaccttttctgtaaaggaccaactagtaaatgctttggctttgtgggctacatatggtcccttgtgtattcttcactggttttcttttttaaaatttatttaacaccttcaaaataaatcatttttagttcacaagttttagaaaaactgactgcagtttcctgagagatcttaccaggaatggatgttgaattttgtcaaatgctttttcccgtatctattgaaattatatttttctttttttagtctttcaaatgttaaaacaaccttgtattcctgggatatattgcacttggtgatggtgtgtcattatctcttttatatattattggttacttttttgtgaatgtctgtatacatgggaacatagtgctagtctgtttagtctgtagtcttgatttagttttcttatacattattttcatctttaggttttttggtttgaatttgttttggttttggtttcagggtaatgctgcctttattaaatgaacttccaaatcattcttctggagaagctcaactttcagataagtttttgtagggttggtattattttttctttgaatgtctggtagagtccacaggtaaagccgtctgggcctgaggttttcttgtggaaagattttatacttcaaattcaatttctttaatagatacagaagtattccttatagaggctatattttattgtgttttgggtgcttacatctgtcaaggaatctgttcatttcgtttatgttgtcaaatttactggcatacagttttttacactagttccttattgtcctctgaatattcctcctacattcctgtgggtcattcccccctctcattcttgtattggtaatttgtgtcttttttactttttctgatcagtcttactagaggtttactaattctggttttattgattttcctctactgattttttattttttttattgatttctgctcttctatttctttccctctccttacttttgggttcaatttgttctttttctcttttctcttttttttttctcccctagacagagtcttgctctgttgcccagggtggagtgcagtggcgcaaacttggctcactgcaacctccgcctcccaggttcaagcggttctcctgcctcagcctcctgagtagctgggattacaggcccccgccaccatgctcggctaatttttgtatttttagtagagatggggtttcaccatgttggccagactggtctcgaactactaacctcgtgatctgcccgctttgacctcctaaagtgctgggattaaacagatgtgagccatcacgcctggcctctttttctaatttttaaaatggaagtggagactgttgatttgtacgctttcttctttgctaatataagcatttaaacactgtaaatgtttctctatgaatttccttagctacttcccaccaaatttgattttttgtattttcatttttattctattcagaatactttctaattttcttttttatttcctctgagccatgacaaactttacgagtttgtcatttcatttttcaaatacttagggattttccccagataccattcttactgatttttaattccattgtggacagagaatgcatttggttttatttgaatcactctaaatttatggatacttttttttggcccagaatatggtttaaattgggaaatatttcatgtgcccttgataggaatgtgcattctgtatttgttaggtggagtattctataaatgtcaattatgtcaaattgcttgatagtgttgttcaatacttctgtatcttatgtattttctgtgtccctgttctatcaatgatcaagagaggggtactaaactctgaatagaactgtgagtttgtctattttccctttcagtcttaacaatttttgcatcatgtattttgagacttggttattagctatattaatacccagtatctaagaagattgttaaatcctcttgaatgaattgacctcttattatttatttatatttatttttgttgctgcattctgatacaggttgagtatcccttatcagaaatgcttgggaccagaagtgttttagaaatgctacagtggacatttcatctttgagaatcatgtcagcactcaaaaagttttagattttagagcattttggatttcagacttttggattagggatactcaacctgtattacctttgtttgatattcatgcaactcaagctttattttagttcgtgttagcattgtcttgtctttttccattcttttatttgtaactcctttgtgtcttctcattagcagcatctagttgactttgctttttaaaaaaatccagtctccagagtgtgatgttccccttcctgtgtccatgtgttctcattattcaattcccacctatgagtgagaatatgcggtgtttggttttttgttcttgcgatagtttgctgagaatgatgatttccaatttcatccatgtccctacaaaggacatgaactcatcattttttatggctgcatagtattccgtggtgtatatgtaccacattttcttaattcagtctatcattgttggacatttgggttggttccaactctttgctattgtgagtagagccgcaataaacatacgtgtgcatgtgtctttatagcagcatgatttatagtcccttgggtatatacccagtaatgggatggctgggtcaaatggtatttctagttctagatccctgaggaatcgccacactgacttccacaatggttgaactagtttacagtcccaccaacagtgtaaaagtgttgtggggaggggggaggggggagggatagcattaggagatatacctaatgctaaatgacgagttaatgggtgcagcacaccagcatagcacatgtatacatatgtaactaacctgcacattgtgcacatgtaccctaaaacttaaagtataattaaaaaaataataaaataaaaaaataaaaaaatccaatctgacagtctctttttaattgaggtgcttacaccattatatttaaaatgattaataatatggttgggattaactctattagctagctgttgttttagttggcccgtatgttttctttcccttctttttgaattgcttttttaaagattccattttatctcctttattagatcattatctgtacttctttgtatgcatttcagcatttgttatatatatgtttatcactgtatacctccaagtaatatagcattttatgaataatttaagagccttttagcagtatacttccattaccccccaccctttctgctattgtcatatgttttatctataaactctacattgttaatttaaaaatttttaattgtggtaagctacacataagatttaccttcttaaacattttaagcatatagttcagtagtgtaacatagattcacactgttatacaacctatccatgaactcttttcatcttgcaaaaactgaaactctctaccaattaagccactccccatttccacctccctctagaccctggcaaccaccattgtactttctgtctctataaatttgactgctctaggaagtaaacgtcagtagaattataccatatttgtttttctttaactggcttatttcacttaacataatgttctcaaggttgatcaaagttgtagcatgtgtcagaatttcattcctttttaaggcttaataatcattgtatttacataccacattttgtttattcatccatcagtggacagttgagctgcttcccaaccttttggctagtatgagttgcactgctttgaacaagggtatacagatatcaatgtctcctagagaaaagtgaaatgctagttccttgatgtgtaaagtcaggttgatttgaaatcttctttcctaatgtaagcatttacaactacaaatttccctcttagcagtgcttatactctgtcctataagttttggtgtattgtagctttgttgtcatttgcctcatgatattttccaatttgctttgtgatttcttctttgaccccttggtagtttgagtgttttgttcaatccccacatatttgtggattttccagttttccgtccgctgttgatttctagtttgaatcaactgtgattggaaaatatactttgtatgacttataaaatgtggggaatgttccatgtgcacttgagaaaactgtattctcttatttttttcgttaacatcttattgagatacaattcatataccatgcaacccacttaaaatatacaaataagtttgtttttagtagtcacaaagttgtgcaaccatcaccacaatcaattttgcaattttatcaccccaaaaagaacgtctgtacccattcacagccactctatattcccccaacaccctgcaccacattctagccctaggcaaccactaatctacttcctgtctctccatatttgtctgttctggtatatgattatattttttctttattatttcaatcgttttgggggaacaggtggtgttggttacacagataagtgctttagtggtgatttctgagattttggtgcacccatcacccgagcagtctatactgaacccaatgtgtagtcttttatccctctcacccttcccccacaagtccctagagtccattatatccttcttatgcctttgtgttagaggactactctttatgtctcttaaatctaattggtctataatgttgttcaagtcccttattgctttattggtcttccatccggtgattctattgattattggaagtggggtattgaagtctacttttactatagagtagtcttttctccaagtctgtcaatgcttgcttcatatatttaggcactttaatgtttggtacatatataattgtatctatcttcttgctgaactggcccttttgtttggcccatatgttcttatataatgtccttcttggtatgttttaacagttttgacttaaagtctattttgtcagatattactgtagtcactcctgtgttcttttggttacaaaatttcagattatctttttccatctttttaccttaaacctatgcatatctctggatctaaagttagttgcatgtagacagcatatagttggattttggtttttaaaaatccattcttccattcaatttattttggttagggagttttgtccatttacatttaaagtttttgggaggtctgttgctgtttgttcacaattttatgtatgtcttgaggacttttaccctctcatttccttccttattgccttattgtttagttgattttgtgtaatgatgcaacttcaatcgtatataaagactctactccttttcagcccctgccctaccttgtgttactggtgtcacaaattacatctttaggttatgtacccattaacaaagatttatagtattttttatgcttttgtcttttaaattcgaaaagaatgaaaagtgaaagaatgaaaagtgagttgtcaaccaaaattaaaataatacaggcctttatatttgtccaaatatttacatttactggggaatttcatatttgcatatagctttgaattattgtctagtatccttttgtttcaacttgaaggattttctttaggattttgtagggaaaatacagtggtaatgaagttcctcagctcttatctaggaatgtcttaatttctttttcatttttgaaggacactttgctggatgtagtattcttctaggtttttttctttcagccctttaaatatatcatcctactgacttctggcctgtaaagtttctgctgaaaaatctgctgataatcttacagatgctcccttgcatgtgatgagccattttgtcttgttgctgtcaagattttctctttgtctgacactcgactgattaaaatgtgtcttgctgtgggtctctgggtttatcctacttggagttcatggagctttttgtatttgtgtatccatttctttccttaaatttggcaatttttcagctattcttcaaataagttacttgtctccttttctatctaagattacactgatatacatattggcccacttgatggtctcccttagctgctgttcacttttcttcattcttttacttttggctcctctgacctgctcatttcaaatgacctgtctgaaagctcactcattctttcttatacctgtacagctctgctgttgaacccttcaagtgaatttttccattcagttactgtatttttcagctttagaatttgtttggttcttttttgtaatttttgttgatagtctcattttattaatatataggtaccctgatttcatttagttgtcaatattctccttcagctcatggagcatatttatggcagttattttaaagtccttgtcaaataagtgagaagcctttgtttctttaggatacacttctggatattaattttgttcctttaatatggtccatgtttccctgtttctttgaatgtcttgtgatcttacattgaaaaacgggtgtttgaaaaaacagccacttctcccagtcttgcagactggctgcatgcaagcaaagaccttcactaatcagcatggtgtaaagtcttgaggtcctctcaaacctttctggggttgtgtctttcctgggcctgtgtgttttaattccagttttccatacacacggcttcttttaaatgtcctaattacctaaaaatctcactacttcttctcagagatttagatgctgtattttattcctctgcccataattttttgccaccaggttcctgcagttctgtggactcactacacctctcacattcagtggtaccaaccacctgtttccgcagcttccaacctgatatccaaatgatgcagctgttcccatcagtactgagtcaggcaagacagatagcagtccctcaggcaggccccagaaaagccagaatgttgcaagcaagtctactcttttccctccattccaagggaagaactgggaattgggtggcttcttcctgactgtgctgtgccagggaggatgtgggtaaagggtgagcaaaacaccatgacatttcctactgctttgaatatggccttttcttagttaggcagtctcttggttgctgctgctgactgactgattggtttctagagctctcccaaagctattttggtctgtgtatcatatagtcagtcttttaatggggaagcaaaggcctggagcttcctaatccaccattttgctgacaacactcttatcttttaaagaggtgttttttttttttttttttgaaaaggtgtatatatatatatatatatatatatatatatatatatacacacacacaaacacacacacacacacgtatgtatacataagattacacattactatttcttttttctccatcttttttatgtgtgtgtacagagattcacatttccttctggtatcattttccttttgtatgaatgacttcctttaatctttcaagtatagatcttcctaaacgtaatgatttctactgaccctttttctgctttgcccaaattgctaaagagcttatccagtccatttttaccaagattacaaacttggtctcccgcttgtcatgggaagtgggtaaattctctgcttagctaaaggccacagccatttcctttcacaggtacctaggagtctcaccctctaaatggtatttagatgtctgccaagcatttgagggaaatacgtatgcatgttttgagggctctgtttttctagaattttgtaccaccttggcagccctgctctctgactcctcagtccaataagactactactttttgcttgagttcttacctctgtgaacccacaaactggaaagtgcttttagaagaagctagttgaatgtggatctcaaccagtatttctgctctttcaaggatcatatcgcttccagtttctacttattattgattactcatctacaccttcaaatatactttttaaacgtttttaaaatgttttcaaatatattatttttgaaaattcataaatccagagtttatgttggttcaatacaagctactttgccattactggaattagaactgagttattttaaaaacattttttaaaaatgggaaatacctgagcatgactaaaagctatcaaattccagtaattcggtaatggaaagcaatttttatctacaaaaattttatatttcagtttaagaaagtactttttattactgttgtgatgatagtctataattctttccattgaggctgtatattaaaaatatatggcacttttttttccttgtgtaggacatagcaaatgaagaacacaaaaaaattgaagtgttaaaatcagaaaacaagaagctagaaaaacaaaaaggagaattaatgatagggttcaagaaacagttaaaattaattgatgttttaaaaaggcaaaaggtgagtctatcattaaagttaaatcatcatattatttgtaactttcttactaaaaaatttagcatttttcactttaggtatgtttttgacatctttacgcactgaacttcatataaaatgcatcatacatatgaaatcatatgaaatctaacatttatagtgagatatatgtgtcatctaagcaagtggatattttcacataagtaagttagtgtagaaaatgggactggaaaatacagtataggtacttctcaactacagaaagtaccaaattaaagaatgactattaggggactgtttgcctcttcaaaccttagagcgaacatcacttccaaaccactattgctgctttctctaaaaattcatagttctgacactttccttctttgcaaaggtcaggtatttaaaatattatagaattattattatcttaaaagtaagttggttcagtactactgttggacaataccatttcaaatatcatgcttattggaattaagagtatacattcctacaacagaacttatattctgacaatatattatccacacatttttacaaacttcctgttgtttggtggcctactcttaatactaaatcagacaatattgattttttttttaacagatgcatattgaagctgccaagatgctatctttcactgaggaggaatttatgaaagcacttgaatggggaaattcataagtgatctacttcagttagtctctatgacagtatgtgatggatacccattttacttattgtagtggtttgaattatttttattcttcataagtaatatatttgattatgaaagcaaaataatttcaaagaattccctttttagatttaggagattagctattagctctttttgagttgttttttaagttcttagcgtgacaattaagcacatcagataataaaattcttgactcttttcatttataattctcctcccttacagtagaccaaaaaagatgctttaaaagaaaattccaaatatttatttccctggctaaatcaagtaagtaaagttcgtaaacacagacagaaggcagttcactttggggtagagttctgtattagtcaaggtaaatatactgtcttgaggatggggatgcaaacagtgctctgtagtgttgtagaaatcggattttgaaattatcagtacaaaaataacagcttgattaaaattaatttgtatctgataattgtttacaagttatgaaattcagtgatgatttacaaaatccaaacagacaatggatacctaatgccactgaactgtaaaacaaaagttatgctgacatctagtggtaacatgcaaaaaatctatgctttacccaattttgatgatatcatttctcttcacaaatttcactcctttgttgatatactttcctgaactcttcaccaagcagatcaatatcatcctcttttttaaatactccctacgagaaaaatactttgtgggttacttttgaataccagaatatttcactaaatgcttttaagactgacagacataagattagtaaagttatctccaaggtaatgaaatctattcaacagattaatgaaactttaaaaaaatcaatacttttcaaaaaataagactttacatatatattgaatattcctagactgacccaattttctgatttatcagctctagtgtaggagcttttcataggaatctgagctcttctacaagttctactgcttggattacctagataggaaggcacttcatctatactgtaccctacccttttctttaaatagctctataatatgatataatggtgagcttcagtagattcatgcatgggattagttcttcatgcctcagttctatggctaatcagcaaacagtcaatcttgcagaaaagaatccaggtttggagttaagccatttaagcaaaccctttggaattcttcactgttctatttttcttttcccctacagtatactgcaaaaggctctttaaaacaaaattaaatatttacttaaattgcaatctaaagaataaagaattttagggataactgaagtcatttggcaccattaggacctaaaggataaaggtcatttttggatatcaagtttattaatccctcctgctgcctccacaattatttcctctacaaaaatatcaaatcccaaagaaagacattcctacaatttataatttagtttatgaaatgtattaattacatatggattttatcattaatacatcattttgtattccttaatcctttctaaccaattagactatcaagtcctgtggccaggcagtaattacctatatatctttttccttccttagcaccagagtgaatataataaaataaatatgcacttgattctactgaataaaatatgaaatggcatttctatagctgaaagatggcgatcttatttatatgagtctagatgtttatgtggcctatgaaactgttattacttttttaagacaagacggggtctcactctgttgcccaggctggagtgcagtggcaagatcatgggtcactgcagcttcaactttccaggctcaagcaatcttccaacctcagcctccagagtatctgggactacaggcgtgcatcaccacatccagttaactttttattttttgtagcaatggcatctccccatgtttcccaggctggtcttgaactcctgggctcaggtgatcctcctgcctcagcctcccaaagtgctgggattataggcatgagttgccatgcccagccagttactattttatttgaagtcacagtgtgtctcaggtatacattaaaattcactatcttctggaattttaaaaatcaagtttaactagttataacttcctactgtagagcagatctgtctcaagctcagttcaaccatgtgcctattactggtgttaccagtgacaatgttttcatacacattctcatctttggcatgtaagtactacagttctagggtagtctcaagctcagttcaaccatgtgcctattactggtgttaccagtgacaatgttttcatacacattctcatctttggcatgtaagtactacagttgttctagggtagctttagatttcctacactaaaaggggagaaaagaaactctaaaatacaaactcaggccaggtgtggtggcccacccagcacttggggaggctgaggcagatggatcacctgaggccaagagttcaagaccagcctggccaacatagcaaaatcctgtccttaccaaaaatacaaaaattagctgggtgtggtggcaaacgcctgtaatcccagctactcaggaggctgaagcaggagaatcaccgggaggcagaggttgcagtaagctgacatcttgccactgcactccagcctgggcgataaataaggtacaaattcagtaaatcaagctcatacatctaataatgtgctaagaccaatcattttagatatactgaaatgggcccagagaggttcagtgcctggacaggaggatcccattgctgcttcataaccgagcaagaagtgagcaaaaccaaggcactctaaaatccaaataccatgtttttttcactattacaggtcatgaagattacaacttgagataaatctcacttactttagggagatagcctagtaagtttgtagcatgctctttaagaagttttagcctttcttcttcaataattgcattaataaatccttgccgcctttgctgcaactgccactcttctagttcacgttgctggaaatgcagatcaaattttgttatcacaaagtacattaatcttatacgaagttttcaaataaaactactcatgcaatgaattagataaaattgatgaactatttatgacactaagttcaaaagattctagataatatatatttttaaaatatatattttatgtctgtacacatatctatgtattttttactgtcattattcctttaaaattacaaggaggcaaacaaatattttcaggaaagtgtcttcattaccaagggaaaaaatattcaaaggagtgactgcctaatacagtaaatatttactgaatgcttaccatataccagatgctgaagagtttacagtgtaaaacaaaaaatagtgaataaagaagatcagaaatatctaaaggatattttcatatatatatatataaagatgatatgaagcatgagaattccactagtatttcttaggaaagtgctcactcttaaataatcacatcaaaattctgggccatatagaaaagatgacttgaactacgtgaaagaacagtaatctactaagccactgttaatttgagactgtacttgcattcaaacctaattctatcttaattcatccattccttataaagaggagatacaggaaagttctgtaatgttacaggggaaagcaaacttgatacatttttgtccaatggtagagtctactttgggctaatgcagattttcctaagaaggatctggcaggccacattcaatgtttatcctaaaaagaaaaatttatagtaaattaaattgtttaggcagttacgaaatcaacttatccatttaggacaaattctgaatagctttggtgtaggaaactacctcctgggaagtttcagattttgtctgaccgtatgattttcgtagaggtagacagaattacagatacctatttaggaatgtctctgaaatccaaaaaacatggttagaccttataggattgtataatgagtttcatcacgaagatctgtccttgacttggggccagaacaaaaatgttgcccaatcaaacggacaaaactaagccgacagcttcatattgggaacatttataagtctttaaaaattaagacaaaaattatttgtataagtatctatgcattaggtggctttatctgatttccatttagtttttagtctgatttctagttagttgtcttgctaacttttccaggagctttctcctatccaagtactaaccaggcctgatcctgcttagcttctgagaacagatgagctccaatctgaaatataacagcacttgtattcccatgagtttctcatatttgaaacatctgcattattttgactcctactttgtatagttttaaaagaagtcatgtaagtctcacttagtcttcctctaaattcttctcttcctaccgattttcaaaacacctacatattatccatttggttcttaaaccacaaaatctagtgagacaatataagtatttagttttacggatgagacataaataagtcaatgtatccaaagccaaaaacttcattccctctccaacacttaaatctacatttccaactagtaatcttcccctgggccaccaaatcattttgggtggacaaaatagaattatttgcaccctcaaaatctatttcttttcctctatactctttccttaggatgtcacccagtcacccattaaagatggaagtgacacatggacacagggagaggaacatcatcacacaccagggcctgtcggggggtgggggggacaaggggaagggagagcattaggacaaatacctaatgcatgcagggcttaaaacctagatgacgggttgataggtgcagcaaaccaccatggcacatgtatacctgtgtaacaaacctgcatgttctgcacatgcatcctggaacttaaaaatattaaaaaaataattaaaaagatggaatgacagtattatttattaggggtagccttaagtcttctctcaccctagatctcactggtcaccaagccccatcaattccgtatccttaacatctctcgggtggatcccttatctatttgcatgggtttcaccacttgtcactgggattattataataacttacttactgatctccctatctccgagcttactcatctcttatctaccttcaatgctctcacttgaatcgtctttcaaagtacagatcttaatatacagcttttcaatcttcagtggcttcccttagaaaagcccaccttcttaaaatagcatgcagggtgttcatgatctgtttctctctctgccataccaaaacatccatagctctataacctattatcacatgtacatgacatatttataattactttttatatatttttcttaaccaagaccataaattcataagtgacatggacttagttttatttaccttttatgttctcaataccaaccagtgtttagcacatagaaagcatcaataaatattttctagaagcaaaaatggtcagaaaatttatatatatattagtaaacatactaacattgtctggcatataaagcttctcagtaaatgtttagtggatgatagatgagctattgctgtttaatgataatgaccaaaaaaaccccacaactttttcttactttgtctgcaaggaattgttggcgacgctcttcaataagtttttccacagccctcctgtgttccagctgcttcattctttgtttctgagcattcattaattctattcgatcatcctcagcaaatttagctagcatagtttttctaaagttctcctcttcctcttttgcagcctgtagcactaattccttcaaggccatttgttcttcaaaatcttgcttcatctctttttgctttctcaatttcttttctgcttcttcctaaacaatacagctgaaagttaatttagtaactatttccttacaccagatttataaggaaagagtgatagagtttggttaaatttagtattacaatatgaaatcatacaaactgaaaaagtaaggcttttcatgataactttgtccatccctttaaaactagctggataaagaatatgcttacatttggattgttttctgttactcatgaacaaattttaatttatatttaccatcttgtttctctactcagaattaacacgtaactgctttggaaagagctgttacaaaagccttttttgcacacctgagtttattcatctaaagtctatggtaactatgaatcattctagaatcttgcttacaaaagctgtccaaaccacccataagtatttttcagtttccaacctcctcctcaaaatcaaagctgcacttacccatctctagtcttctaatattcccttcattctccaaaattctctaaaatttaaaaacaattatctagcaatgacaatcagtacttctttagggaaattcaaatatagttggaacagttaagtcctttcctataagcttttattttctgaacattttattatgaaaaatttcatacatactaaaaaatataattttacaatggtcactcacttctaaataattcatgggccaaagagggaatgccaaggaaaataaatacattgtagttaataaaagtgagacagcaaaatttgtgagatgctgctaaagcagttctgagaaacatttatagcactaaatggatacatttaggaaaatgtatatatatagcactaaatgcatgtatgtaggaaaagtctcaaatcgataatctaagcccccacttcaagaacctataaaaagaactgtaaagtaaacccaaaatatgcagaaggaaaaacataataaaactgtagaaatcaatggaattaaaaatagaaaatagacaattattggtgaaacaaaaggctggttcttaaaaattatcagtgaaatggacagacctttaacaaggctgacctagaaaaaaaaaatgaatgaataaacaaataactaatatcaggaataaaacataggatatcactagagaccctacagacatcaaaaggataatacaggaatactacaaattattatacacacataaatttggcaacttagatgaaatggatcacttccttgagaaacacaagctaccaaaactcaccaaatatgaaataaggtaatctgaatagtcctatcactattaaggagacggaattaataacttaaaattcctccaaaataaaaccccaagtcaggatggtttcactagaaaattctatcaaatatttaaaaaattaacacgaattctacacaatctcttccagaaaacagaagaggaggaaacatatccccattcattttatgaagatagtattaccccgctaccaatataaaaaattacagaccaatattcctcgtgaatatggatgcacaaatccttaacccaatattagaaaaatagatcatacattaaaagaattattcaccatgaccaagtagtgtttattacagggatgcaagactggttcaatactcaaaaatcaatgtaatatacttggctaaagaagaaaaagtcataatcatatcagtagaaaaaagtgtttaaccaaggatatccaggaattgaactcagttctgcaccaagcagacctaatagacatctacagaactctccagcccaaatcaacagaatatacattcttctcagcaccacaccgcacttattccaaagttgaccacatagttggaagtaaagcactcctcagcaaatgtaaaagaacagaaattataacaaactgtctctcagaccacagtgcaatcaaactagaactcaggattaagaaactcactcaaaaccgctcagctacatggaaagtgaacaacctgctcctgaatgactactggatgcataacgaaatgaaggcagaaataaagatgttctttgaaaccaatgagaacaaagacacaacataccagaatctctgggacacatttaaagcagtgtgtagagggaaatttatagcactaaatgcccacaagaaaaatcaggaaagatctaaaattgacaccctaacatcacaattaaaagaactagagaaccaagagcaaacacattcaaaagctagcagaaggcaagaaataactaagatcagagcagaactgaaggagatagagacacaaaaaacccttcaaaaaatcagtgaatccaggagctggttttctgagaagatcaacaaaattgatagaccgctagcaagactcataacaaagaaaagagagaagaatcaaatagacgcaataaaaaatgataaaggggatatcaccacagatccaacggaaatactaccatcagagaatactataaacacctctacgcaaataaactagaaaatctagaagaaatggataaattcctggacacatacaccctcccaagactaagctgggaagaagttgaatccctgaatagaccaataacaggctctgaaattgaggcaataattaatagcctaccaaccaaaaaaagtccaggaccagatggattcacagccgaattctaccagaggtacaaggaggagctggtatcattccttctgaaactattccaatcaatagaaaaagagggaatcctccctaactcattttatgaggccagcagcatcctgatactttggtcgtctgtcatcctgacagagacaccacaaaaaaaagagaatttaagaccaatatccctgatgaacattgatgcaaaactccgcaataaaatactggcaaaccaaatccagcagcacatcaaaaagcttatccaccatgatcaagtgggcttcatccctggaaggcaaggctatttcaacatacacaaatcaataaatgtaatccagcatataaacagaaccaatgacaaaaaacacatgattatctcaatagatgcaaaaaaggcccttgacaaaattcaacagcccttcttgctaaaaactctcaataaattaggtgttgatgggacatatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcagtcaggcaggagaaagaaagaaagggtattcaattaggaaaagaggaagtcaaattgtccttgtttgcagatgacatgattgtatatttagaaaaccccattgtctcagccccaaatctccttaagctgataagcaacttcagcaaagtctcaggatacaaaatcaatgtacaaaaatcacaagcattcttatacaccaataacagacagacagagagccaaatcatgagtgaactcgattcacaattgcttcaaagagaataaaatacctaggaatccaacttacaagggatgtgaaggacctcttcaaggagaactgcaaaccactgctcaacgaaataaaagacgacacaaacaaatggaagaacattccatgctcatggataggaagaatcaatatcgtgaaaatggccatactgcccaaggtaatttacagattcaatgccatccacatcaagctaccaatgactttcttcacagaattggaaaaaactactttaaaattcatatggaaccaaaaaaggggccacattgccaagacaatcctaagccaaaagaacaaagctggaggcatcatgctacctgaattcaaactatactacaaggctacagtaaccaaaacagcatggtactgctaccaaaacagagatatagaccaatggaacagaacagagccctcagaaatagtaccacacatctacaaccatctgctctttttttttgttacaaaaaagacaggtttgttacaaacctgacaaaaacaagcaatagggaaaggagtccctgtttaataaatggtgctggaaaaactggctagccataggtagaaagctgaaactggatcccttccttacaccttatacaaaaattaattcaggatggattaaagacttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttccgcacagcaaaagaaactaccatcagagtgaacagccaacctacagaatgggagaaaatttttgcaatctacccatctgaccaaggggtaatatccagaatctaaaaagaactcaaatttacaagaaaaaatcaaacaaccccatcaaaaagtgggcgaaggatatgaatagacacttctcaaaagaagacatttatgcagccaacagacaagaacaggaaaggtgatgtctactctcatcactcttcttcaacatagcactagccagtggtgctggaaattttagccagcatgtaaggcaaggaaaggaagtaaaaagtatacagatcagaaaggaagaaacagcctgtagctctgggcagaagacatgcctgactatgtagggaaaaaaaatcctacagctaacaagtgaattcagcaaggttgtgagatacaagataaacacaaaaatatcaattcactagcaacgagtacacggacaccaaaataaaagctaacattccatttacgattgctcaaaaaatgaaacacttagatgtaacaaaacacgtacaggatttgtatgctgaaactagagaatcctgatgaaaaaattcaaagatctaaataaagggagagccaaattgtgttcatgaacttaatatagtgaatttatcaattctccccaaactgatattcaaatttaattcaatacctatcaaaatcccagcaaaaaatatttatagagacaagattcttcaaaaattcatatggaaaggcaaaggaactagaatagctaaaaaaaaaattttaagacttgccatatagctgcagtattcaaaactgtgtagtattggtggagggatggatacatagaccaacagaacaaaatagagaccacaggaatagacccatacaaacatgccaactgtgttttaagaaaggtgcaaaagcaattcaatgttggagaaacagccatttcaacaaatggtgtggaacaactgaactaaatccaatggcaaaaactgtatttaagtctcatcgtttgtaccaaaaattaactcaaaacagatcacagattgaaatgtaaaatggaaaagcataaaaaaaaaaaacccaaaaaaacaaaacacacacacacacacaaacctttaggaaaaaaaaaaggagaaattcttcaataactaggcgaagagtttctagagttgacacagaaagcatgatccataaaaagaaaaactgataaactgaacttcatagaaatggagaacatttgctctaagaaaaatcgtgctctaagatcatgttaaaaggatgagaagataaagctacagactagaagaaactatttgctaaccacccacctgacaaaggactagtatctagaatatatgaagaactctcaaaacccaacaataaatgaacaaacaacccaattagagaatcagcaaaagacatgaagaactatttcatcaaagaggatcttacaccaaagaggacagcaaataagcacatgaaaagatgttcagcatcattagtcatcaggaaaatgcaaaataaaactacaaggtatcactacatggatatttaaaagtggctaaaataaaaaattgttgagcttctgaggacagaggagaaaaaaattaaaaaataaactgtgttaacaccaaatgctggtgagaatgcagacagactgcgtaactcatatatttctgatgggaatgttaaatgctacagctgttctggaaatcactttggcagtctgttacacagctaacatgcagttaccacaaaacccagctaatacaatcttgagcatttattgcagagaaatgaaaattgatgtttatacaaaaacctttacctgaatgtttacatcagatttactcatcagagctaaatattggaagcattccaaatgccctttaatgggcaaatggtcaaataaaatggtatatacatgccaatggaatgttactcagcaaaaaaagggaacaaatgatcaatacaagcaacttggatgaatttccaggaaattatgctgaataaaaaaaagccaacttgaaaaagttacatattgtttgatatcatttatataacattcctgaggcacatacttttaaatttataattaaaggtttatccatgttttagcatgatcagtctgtcattcttttaatagctgaataacattttattacatggatatactatattttgtttatccattagacatttgggttatttctacttttgggttatttctacttttagactattgtgaataatgctgcataaacatttgtgtatgggtttgggtagacacaggctcattaatttttaaccattcttttttctaatatatgcatttaaagatataaactttcctctaagcactgcattaactgcacgtcacatattttggaatgctgttttttgaatcatttagtttgaaatatttttctaatttccaatattatttattccccttttctcattgcttatttagaaatatattgtttaattataatatatttaaggagtctgcaggtatattttcattactgatttttaatttaattccactgtagtcagaaaacatatctggtattatttaaaaccttgaaaatttattgagacttcctttatgtcctagaatatgatctatctcggtgaaggttccatgtttgaatggaatttgtgttctgctgttgttgggtggagtattctctaaatgtcaggtcaagtttattgatattgctttcaatacgatatcctgcggttctgactacctagtctatagattaatgagaactgtgcattgaaataccattctggacataggacctggcaaagatttcatgatgaagactcaaaaagcaattgtaacaaaaacaaaaattgacaagtgggacctagttaaactaaagagtttcttcacaggaaatgaagttatcaacagaataaacagacaacctacagaatgggagaaaatatttgcaaactatgcatctgacaaaggtctaatatccataatatctaaggaacgtaaacaaattaacaaccctatttaaaaaatagactggccaggcacggtggctcacacctctaatcccagcactttgggaggccaaggcaggtggatcatgaggtcaggagatcgagaccatcctggctaacacggtgaaaccccatctctactaaaaatacaaaagaaaaaaattagccgggcatggtggcgggtgcctgtagtcccagctacttgggaggctgaggcaggagaatggcgtgaacccgggaggcatagcttgcagtgagccgagatcacgccactgcactccaacctgggcgacagagcgagactcccatctcaaaaaataataataaaataaaataaataaataaaaagaaaaaataggctaagtacatgaacagatacctctcaaaaaatgatatatatgtagccaacaagcacatgaaaaagtgctcaatatcactaatcattagagaaatgcaaaccaaaaccacaatgagatactatctcacatcagtcagaatggctattaaagtcacaaaagaatggatgctgacaaggttgtggagaaaaaggaatgcttatacactgttggtgggaatgtaaactagttcaaccactgtgaaaagcactgtggcgactccccaaaaaatgaaaacagaattaccatttgattgctgggtttatacccaatgggattgctgggtatatacccaaaggaatataaatcattttaccataatgacacatgcatgtgtgtatttatagcagcactattcacaatggcaaagatatggaatccacctagatatccatcaatggtggactggataaataaaatgtggtacatgtacaccacggaatactacacagccataaaaaagaacaaaatcatatcctttgcgtcaacatggatggagctggaggccattagcctatgctaattaatgcagggatagaaaaccaaatactacatgtcttcacatacaagtaacagctaaatattgagtacacgtggacacaaagaaggaaaacagacactggggcctacttgagggtagacataggaggagggtgaggatcaataaactacctatcgagtactatgctcattacttgggtgacaaaataatgttacaccaaatccccatgacccacaaatttacccctgtaacaaaccagcacatgtacctcctgaacctaaagtaaaagttggaaagagaaaaagaaaaaaaaaaaaatcttgaactctgattgtggatttgcctctttctcctttcagtttttgtcagttttgcttcatgtattgtgaagctttattatttaggttcacacgcctttaggactatgacatcttctagatgaatttactgtattatcatgaattgcttgtcctgaagttgactttgtctcatattaacgtagcaactccaacctacttttgactagtgtctgtatgttacgtatctttcaccatccttttgcttttaaagtatgtatcttcatttttaaattgtgattacagacaacatagttgcatcatgctttttatggtaagtttataaattgatgcctgagtctatctttttagccagcttgaaaatttctgtcttttaactgtagtataccatttacatataatgtaattaccagtatggttggatttaaatgtactatctcttttctgcttcatctcaaaattatattcttctctacattaatcattctttccatttctgaaacttacttttagcttgctcttatatatttcagcttgttcttcctggtataattcttgtcgcacttgttccaaatcttcacgttgccgcagcatttcttctaatttctgtgtcaactattaaattttttaaaaaacataaatatttataggatccaaattctgtaactaatatttcagaattttactagtgttaaagaagtggttattttaataccgcattctgaagctgtagccttttctcctcattttcttgaacttttgccatccgatcttcttctctttgctgctgcatgttagcaaactctatgatttttctgttttcttcttccatctcctcacgtttcttttttctccagagagcctgctctttctgaaactcttctatataccttcgcattgcattcattttttctaacttttgttgtttttccctgaaaagcaataacaagtacagatttatagtaaacaataaaatataaaaaagtaatttcattttgttcataataatgtacagaaaaacactatagttttttcattcgtgcatgcaacaaacattttgaatgcttactgtgtgctaaatataatgtcaggtatgaatttttctttgggtagaatactgtgatagtctcctctaacctattaatgaagttttatgcatcttatttcataaaggctacaatctgttaacattagctttgcagcactctatacttaagctgtctaccaaaaaaatttatcagaatacctgtcctctgacatatgatatgggcatatataagaaaaacaaaggtttaggtcattcaatcacttcagcatttattaatcatcagataattcatttattaattatgctaacggagatgagaaggagttggtcccaatttatgttttcatagctagtatttattgagcacttactatgtattaggcactgttctaggtgcttcagttcctcacaacaaacctgtgatatatctaaagtaaacatttagacatgtaagaaagttaggataaacttacaactgatcttcttcatagatcttcctaacaatttcatcaatcatgagtttctcttttagcagctgctcataagcttcctgcttttttttttcttgttcttcaagttgtttctctaagtcaagatagtactgtgctttcgctttgtttcgtttgtcttctgcagcattctcttcctttattattctcttgtgttcttccatcatggttttggctatttcagcatcacgtttctgttattaaaacaaaattgatctttccgttttcaaatttgaacatagtacgatagtatattttacaccaatgttattgaatattataaagtcttttacataaaataaattttttcatctgtctaggttaaaaagcaaaagtaagttattattacctgaagggtgtgaacaataagtcagaccctaaagcagctttcctatcccttcaagtagctctctcaggacaatacctgataaggattattaataactccacattcaaaaaacaatgaatacaattgtaagtagtttcttaataactatttagctgctaaagcagtcattatcttattattctatttataaactgagctaggcaattttcatcgtttttagcttcattgtttatcagctgctatttaaagatggtactgcctctttcttacaggtctgctattaaatggctttgagcagctcttaagtttctcctagcctaaactttctttcctgccattggcccttgacgtttcccctttctgatttattaaaggccctttatctgaaaagaatcacagatgctactgtgcctattttctacagcttttaattcactcaagaccattcccattgtcaagagacaatctttcttcttggatgggttaaaccccttatttcttttgagcatttttcaaatcatttaataaaataagttttaaatgaaatatactgaggcaattttttaaactacgctttacttttatgatcacatcccgaatgatggaatggtcagcagcatcaaacataaagagtaaacagattaaaatatgaatactgaatgtcattcctgacgtcactgaagcctttaacatatactctgataatatgacttgaccaaaaatgtttctgattatcttctttgtacatgctatactaaattctttattaaaaaatgagatgacaataacatttatgtgtagattaccacacacttaccgaaaacaatgttctcattttacagataagaaaactaaggctcagagaaaaagccaaaactagtacttgcatgacacctagtcaagtcctagtagtattcgactttcattttgtggatcaatttttatttggaaaatagcagcaattctcgtaggagtcagattaaaacgtctacaactaccttgaataacttcaactatcaggataattaaaactgcaaaccactgga

SEQ ID NO: 784 - DNA, 93495 bp, Homo sapiens
ctggtgccggtttccgccgagctggagcgcgcgggccacggcttctctggggacgcagaagcgagaagcggggacctcggcgcgcgccccgcgtcccgctcttcctgcccgcgccccggcccccggcccgcgccccggccgccggcatggtgctgctggccgggaccgggccggagggcggcggggcgcgctgcatgaccccaccaccgccgtccccaccccggggcgcgcaggtcgaggaggaccccgctgactacgaagagtttgaggacttctcgagtctgccagacacccgcagcatcgcctcggacgactctttctaccctttcgaggacgaggaggagcacggcgtcgagagcgcggagagcgtcccggagggcgtcccggaaagcgtcccggagacggcgaccctcctgcgcgccgcctgcgccaacaacgtggggctgctgcggacgctggtgcggcgcggggtgagcgtcgaggaggcgcaggagactgaccgcaacggcagggtaagcgggcgtccccgcaggatttgagccccctcactgcccccactcccctcctccccaccacatccccgcgcctcccagctcctggctccggaccggtccctcggtcactcagccgccgcccagagcgccttttccccgctgtttgggagcgcggtgccctgggtggcttccccgtctcaggctgggggacgcggtgcggggagggagcagtcgaggtgtcagcgcggcagaaacgccagtccggcgtcctcaccgcatccccttctcgtttaccggtccccgtggacctcctgactgaattcgcgctggctgcccgtgctgcaatccaggatgggcttcttgcggcccggtcccctcctgactattacctttccccaggtccctggcaggggaccattcctcctcccctgcaggagacagcccctcctgcccagcgccccatttggcccctgggcccctcgcgccgcccttgtcctaacacgctggggcgcagatcggctcctccagccgcaatgatttggaagcaacagtttcttccctcgccgggacagcttggtcccctaccccacctccgctgagctttgtggcccgcgccgcgaccagccaacgtgatctctgactggtctgtccgcaggtcaccttcgcgagccaatgccagccggggctccccagagtcagggcatagggagagccccagagccgcgggcatccacccgggtagggcaggaggcgtggaggcaggcacaggctatcctttcgttatgaccagattcagagaaaacgagatgtttagaaaagaaaagaaaagaaaggaaaagaaaaaaagttggcttaagaagacctgagaaggactggctggtggaacaccttccaccaagcaaagcacttcaagggaaaactgcagagtgaccacggtggccaagttccccgtagtctgtgctcagtgggcaaatggcagcgttctcacctgatttttgtattgtccaaggaccgtggtatctgcagatgcagcctagcacaaatgcacatgctttttgctcaggagcctgcagctgacagaaaacatgtgctttgacttggggacccgggtgaccttgtgcctttggtttatcctgcagtgggtggggcaagtggtttgccctgactgtggtttgggctgggcttaggtggatgggaagccctccaatgtcactctccccttgtactacattgcccccgtgattcaattacctcccaccgtgtccctcccacaacacgtgggaattcaagatgagatttgggtggggacacagccaaaccatatcacacaacatttgaacttggaggaagggtctgtgcttgtcatatgttaggcagtgagacctgaggtggcgtccccgtaggtagcatcacctggagccctgtagttcctgctgccattcctcttgcaatgcctcctcccccagccctggcgacagatgccctggctggcatgtgattagggcttggagctccacccgaagtcctagggcctgtttctcaagttctacatttggtttaactgagttttcaggcccagatgtgtgtaatcagaaaccttgctttctggaagccagtatgggggcccgctttaaaggaagcctcaccaagctcataaaggaacaggtggggtgggcctctccccctgtcctgggcagcctggtggtctccagtgggctggaatgggcacaggaggggcctggctcgcccagtccccactctagggcaccactgggctcagctttatataatgtttcctttaggggcaaaacataaatgtttgaaaacagctgcattgaagaaaactgacagcaacgtaaaccatccccaggggctcgagcctaacagactgagtctccaggccacacagcagagaggcaggggagggccgtggtatgggaggctagctccagcctcccagcagctctctgcctcagtttcctcgtctgtaaaatagggataagggcagcctctcctcttaggatgtgagcataaaatggcttagtgcccacaaggctctgggaaggcctggccccaggcttgtgtttaccatcgtgtttctcattcgtctgccttctcttggcttggaagagagcaccttccagttttattttgttttgttttgttttttgtcttctgccaggcaaggctttttctctcgctgcttttcttcccctttgattacagcagaagtgaagactttgtttctctgtgtcacgtaaaataatgatgtaggcccggacatagcctgctaacttagagacccttggactctttcatctttggatcagacggagcagggcttgtgttctgtgctttgtgaggccagtggggggagcgaggcaggagcctccattcttttcattagcttctcaaggctgttgatcaaacagcctctatcttcctgaaaaacagctgaaagaatcaagtgtggcaaagccctgatgccctgctctgtggtaaatggagtgagtcattgccaaagtgtttaccgcagacctactgtgctcccgctaggtactttagcagactcaaaactgaatctggcagtccctgcctttgaagagtcctagccttttagtgaggagaagaacttgcagaggaagagcggctagctgagacctaggaaactgggagacggactgcttttcacatgacggtgtccggtctccccgacggcagtgtgggtcactccctctctgtctgcaggctcctggtttaagggcaccttccctgggaggcttttctgtctcctcttgtccaagcctacagaacctggagctgagcaagggtaatgtaggcattcacacatttagggctgaaattataaataggatggtcatttagagagcaggtgacgtttgagcagagacggcatctaggggaaagaggagttagacggagggaacagtgtgtgcaaagactgaggtgggaacctcgttggagcctggtctccaagcttatcatgattagtggcagtgaaaaccttaaagaaggcccggacagctttggtgcagtggaggggtaattgcattaatgacagaatgacagctcacagatacagcccacagccggctttctaggaggaaatgatctctaaaggcgtctaaacttttctgggacatgcttgttgagctcttcatctctgggcatttaagaagggagctttgcctgagctgacaggcattccatttggtctgggtaactaagggtcagatgtgttttgtttaagaaaatgcattctctcctgcctcctgagattggtagaatgttggatgtggctcagcacaccattttccttctaaaatatttattgctctaaaagcattgcatgatttaatatgcaacatgtaaatatttgtcagataattgcccaataacattcaaagcttgcttccaatgtcttctggatttatggttgttttgttccttctgacttgaggcagtgcaagctgccataattctttttcttaattcttctcttccacttactatcacctgaagttcacctttatggccttggcggctcttgagatgacagtgaaaacacacaaagtgtgttgttttaattgttgcagaagggcagtttaaatgtcagacagctcttggacttaattaggcccaaatacatgctcaatttaaaatactgcactcctgtcctgatgggattctgcttctgcgtgttcgtgtttgtttttgagactgagtcttgctctgtcactcaggctggagtgcagtggcgcaatctctgctcactgcaacctccgcctccggggttcaagtgaatctcctgcctcagcttcccacatacctgggattacaggcgtgcgccaccacgcccggctaatttttgtatttttagtagagacagggtttcatcatgatggccaggctggtgttgaactcctgacctcaagtgatcctcttgcttggcctctgaaagttctgggattaccggtgtgaggcaccgcgcctgccctgcttctgcgtgtttaaatttccagggtctcttggttacgttttccaaaggcccctccattggtttgttttgttaggtcagcaaagcccacatcacacccagtgtgggtgtttccctttactcttgaggtgcttaaaattaaaacttaattttcatagatttatagcgatgatcagggctttatcttgaaatgtatgtgagaaagtttttatttatttatttttttaatacttccgaaagatttataagctccagaatcacttttccccaaaaatgagaatccagttattgcaacagccctccgtctttaccaggcctcggtgctcatggcctgcgtgtgcacagcaacgggctgactagcatagaaagtgacttctctggttcttgttagttaccatagaaagtgaattctggcctcaggcctctgtatgcttgcggagggcctgcaagcacaagctttgctttttaggaatgtatgttaggctgggcgtggtggctccttcctgtaatcccagcactttgggaggccgaggcaggcagatcacttgagcctaggagtttgagaacagcctgggcaacatggtgaaagcccatctctaaaaaaataccaaaattaggcaggcatggtggtggacgcctgtagtcccagctactggggaggctgaggcaggagactcgcttgagcccaggaggtggaggttgcagtgagttgagattgcaccactgcgccccaggctgggcgacagaacaagacccgtgtttgaaaataaataaataaataaataaataaatagaggcatgtatgctagtgttttagttgcatctccaaattctgaactgtgagaaagcgggtgaggagggcaaattgagcagaatcctagaccgggagtccgaggggctggagtcagaggaggtctcagctgaaatgggcttggcgatgggtgggctggcagatgtctgcctcttcctcttctgctgaccgtggtggggagcattctgagtctagcagcagtagagaggcccatgtgttttttgtttgtttgtttttgtttttttgtttagagatggagtctcgctctgtcacccagtctagagtgcagtggtgtgatatcagctcactgcaacctccgtctcccaggttcaagcgattctcccgactcagcctcctgagtagctgggattacaggcatgtgccaccatgcccgactaatttttatgtttttagtagagacggggttgcgccatgttggccaggctggtctcgaactcctgagctcaagtgatccacccacctcggcctcccaaagtgctgggattacaggcatgagccactgcacccagcccccatgtgtttttgatataagaatgtcagtcatctgtggccacaatcatgctgcctaccaaatagctacaaaaccttacaggtgtttacaactgtaaatgttttgttgggggtggcctatctcagctgatgtaggctggatttgctcattcgtcttcattcagctggtggtcagctgcgaatggcaagaccaaaacagtcttaactgggaggactcatcgctgctccatttggtctctcatccttcagcaggctgtctcggcctgttttccatggcaggggcagggttccaggagagcaggctgagcaaatatggcctcatgatgcttcagcttggctgaagcatcacttctggctgctttgtcacgtattgcttctttattttattttatattattttgagatagagtctcactctgttgcccaggctggagtacagtggcataatcctagctcactgagccttgacctcctgggcacaaatgaacctcccacctcagccttctgagtagctgggactataggtgcacacctccacgccaggctaatttttatttattttttgtagagacaggatcttgctatgttgcccaggctggtctcaaactcctggcatcaagcagtcctcctgcctcagcctcccaaggtgctgggattataggcatgagctaccatgcctggcctcctttattcttttcagattctttaacaacatgactcaaataaccttttttttttttttttttgtcaattaggactcattaaagaagagaaaacaggcatttagtttttaaaaaaattccttggtataagtgtgtttgtgtttataacattgtaattattattattattggtcagctgccaacctgaaaacaaacaacaggtagaataatctacttcaagcctgtacttacagtgctaatttcccccatagtctgtgactttgcccctgatctacagtgtgaaatggagagagggctctgctgcgtttgggtttcttgagtacttattttaaaatcttatttgtttatttatttatttttttgagatggatctcgctctgttgcccaggctggagtgcagtggtgcgatctcggcccactgcaacctccacctcccgggttcaagcgattgtcctgcctcagcctcctgagtagctgggactacaggcatgcgtcacgatgcccagctaaattttgaattttgagtagagatggagtttcgccatgttggccaggctggtctcaaactcctgacctcaggtgattcacccacctcagcctcccaaagcgctgggattacaggcctgtgccaccgcccctggcctcttgagtatttatttgagccaacaggtgtccacactggggcttgtgcctggaacccagagtgtgcttttcatttcctagtcctgatctccagctctgatttttttagattgaggaaatatccatcacctcaaggggttaatagttttctgaaataaatttaaaaaacaaaatttggataaatttaaacaacaatgacaaagttgaaaaaaatgtgagtccagatttctgaggtgtttgcaccaggtagtctcccagagatggtggttcccagcttggactgtacattagaatcatctggaaaggtctataaaagtccaagtgcccaggccacatctcagaattaagtgagaatctgagggtaagataaggcatccgtattttcttttttctttttttttttttgagacggagttttgctcttattgcccaggccggagtgcagtggcgcaatctcggctcactgcaacctctgcctcccaggttcaagcaattctcctgcttcagcctcccaagtagccgggattacaggcacccgccaccatgtctggctaatttttgtatttttagtagagatggggttttaccatgttggccaggctggtctcgaactcctgacctcaggtgatctgcccacctcggcctcccaaagtgttgggattacaggcgtgagccaccacacccggccagggcatcagtattttctaaaactcccagagtcatttcaatgtgcagccaacactgacaatcactggtgcagactcttgaactcaaagtggggtcctgagacctggagcagggggttccctgctggggaacttgttaggagtgcagaatcccagccctccccaccaagacctgctgagtcagggcctacttttcaacaaaacctgccaggggctttggaggcaatggagcctttgagaagccttagcacagagcatctcattctaccctcggagccctgtgatgtggatgtgggtgtctgtgatgaatggatgaagttacaggttcagggaggtgccataggtgctcccgtggtggagccaggaggcagttccggtgtggtctgagtctgaaacttaccatccccacaacacatggcttcacctactgcccatgccgcagcgttagtgtcaggcagccccgtctgggcctgttccccaagtggacactggaatgtgacttctgtctttccttgtctcagaaaaagtgtgccactatgaatgcacttaacacccttcactgggcacctctgctgagcacaggctgacgtggttacacctgcttcttcctgggcctccctgtccatgcctctcccagctggaatgtcccttgccagaagtgtgggtcctaattcaagggccaggtaagcatcccagaaacagaggccagagagaaatgcttcattcttcattcccatctgatcagatgcctacttctgatctgagtttcatcagacctgacataaatatgcctctggaagcatacgtcgttatttctctgtttctttgaaattgctctcaaatcccaccactccaatccaatcagttgccactgagccagctgtgacatgggatttcacttctacctcaatttctgtatctctgacttagtagaaataagtaaaatccaccttcaactgtcctttaaattcagggacatcatttaaaaataatctcttccagctgggcgcggtggctcacacctgtaatcccagcactttgggaggccgaggtgggcagataacgaggtcaggaaatggagaccatcctggctaacacggtgaaaccccgtctttactaaaaatacaaaaaattagctcggtgtagtggcacacacctgtagtcccaactactcgggaagctgaggcaggagaatcacttaaacctcggaggcgggggttgcagtgagctgagatcacgccactgcactccagcctgggcaacagagcgagactccgtctcaaaaaaaaaaaaaaaaaaacctcttccaattcttttatggacatacatactgtattagtctgttttcatactgctgtaaagaaataaagaactgcctgggactgggtaatttataagaaaagaggtttaattgactcacagttccacatggctggggaggccccaggaaacttacaatcatggcaaaaggcaaaggggaagcaaggcatgtcttactacatggcggcatgagagagtgagagtgaggggggaagtgccacattaaaaccatcagatcttgtgagaactcactatcatgagaacagcaagggggaatctgcccccatgatccagtcacctcccaccaggcccctcctctgacatgtgggaattacaatttgagatgcgatttgtgtggggacacagggaaaccatatcacatacttaatgacatcaaggactcctgacaccctactttatcttaaactctgacatcatcagatctacaaacaggtaacaccatcatacccctccactccccatcacaaataaaaggggcctcctctcagtcatgctcttcacgtctgtgtggctgccatcaaccccttccttgccccgggctcttttacacacgcacaaacatgcgtgagcaggcgtgtacacacacacatacacacatatcattccaccggctgtgtagaagatatccaccttttgtgaatgaaacatattttctattttctttgttcacatattttagtaacttttctacatatttctttcaattaaaaggatttatgtattcttttacatatggaattatcttgacttaatttggagaaaaatttcacatggttatgatttagaattattagcccagtaggctgtaaagccaagctcaagaaaattcaaaaaaatggtgtcataaacaccatgttctctgaatttggttaattttttttttctagatctaacacaattctaaataactcctagataaaatgggaaaccataatgtaaattgagctgaaaagtaataaaaatattacatatcaaaatttgtggggaaaagcaaaagtggtatcttgaaggaaaattacaggtagcataaaactaaaggaaagaaataatcaaatgaaaagcagaaattgatgaaatcatgaagattatagatccaggacaaaagctgattctctgaaagtaataataaaatagatatttttgacagtagctgtcatcaaaaagagaaatagcacacatttgaaaatacaggataacaggttatagcacagttaaaacaaagattaaaaagagatcctgtaagaatgtcatcctattaaactttaaaactggccagctgcagtggctcacacctgtaatcccagcactttgggaggctgaagcgggagagctgcttaaggccaggtgctcaagaccagcgtgggcaacatagcaagactttgtctctacaaaaaaaaaaaaaattaaaacttagtcgggtgtggtggcacatgcctgttgtcttagctactgggaaggctgaggtgggaggatcacttgagcccaggaattcaaggctgcaggatgagctaggatggtgccactgcactcagcctggatgacacaatgaaaccctgtttccaagaaacaaacaaacaaacaaacaaacaattctcacttaagagtcttgctggcaggctgggcgcggtggctcacacctgtaatgccagcactttgggaggccgaggtgggcggatcatgaggtcaaaagatcaagaccgtcctggccaacatggtgaaaccccatctctactgaaaatacaaaaattagctgggcgtggtggtgcacgcttggaatcccagctactcgggaggctgaggcaggggcagaattgcttgaaccagggaggcggaggttgcagtgagccgagatcgcaccactccactcgagcctggcaacagagcgagactgtctcaaaaaaaaaaaaaaaagagtcttaattctatgccattgttgggccttacctttatgaataagtaaacagggcctggcaaacggaaccagttttctgtcctttagagctagagctaagggtaaatatgacgggcagagtcccctatttaagttggagagctttctgtaggttcccagagcatggctaacaccatctccagagaccttctgctgcacattcaagcacttctaggccactctgcttcccttcacagggacaccgacttacccttgctgatttaaaaataaaggaaggccagggaattacagggagtgaaaagagttggtctcagaaggttatatgctgtatgcttccattgacgtcacagtcttgaaataatgccgttgtggagatggagaactgatcagaggctgctggggccgagcgtggggaggggagaagtgttaccataaaggggtagctggagggggcctttcagtgctggaacctttttgtgccttgatggtggtggttacaggaagctacgtgggggttaaaattgtatagatggacgtatacacacacacacacacacacgattgtgtgcatacaggtgcaatctgaataagctgcatggattccagcaatgtcaagttcgtggcattgttattgtacagtaattgtggaagatgctacctttggggaggacaggtgaagggtacaagttcttgtggggctgtaactatttcaaaataaaaagttgaatgagcgtgaaaagctgcacgcatgacctttttcctgtagccttgtttccatgaatcgattgaattttggacatgaaagcagggtcagacctagttattaataggtgggaagaggactcactggaaatattgggcaacagaacctggctgccttcactgtggttcatgggccagcagcgttggcatcgcctgggagcttctaccaaatgcaggatctcaggcccctgagaatctgcatttcaaggtcctgagatgatttgcacatacatttaagtttcaggagttctagaacttttcttagagtagaaatccagtttgttggttgcatgatcctggacaagtcccatgatcttttgatctttagtttcctttagatacccatctagaaactgggaggcttactatgaagataataacacctcctagaggttctaggcagaactaacgagtaagttacagagaatgtgcttgtgctgtaatagacactcagtaaacagagctgttgtttctatgggcgaatgaatctccagatggttttccagtactgctagttccattttagccaaggggaaaagtggaagcaaattgaatgtttaaccaaaagaagagtagttaagaaaatagcacatccacatggtgaggcctcttttgtaactgttaaaagtggcagccagtgccatggggagaagcccagaagagagcagaggagggtgctggggcttctggtgcatcctgtgggcacctcggatgacgcgagggtggagcctgaaacgctggcccaggaaatggaacagaagcctgttgtgggtgggaggagaatcggaagcggcataaggagagtttttcaagaagggggaggaagctggtgccggggatggtcacaagcctttcctctttcttttcccttccctttcccctttccctttcccttccccttcccctttcccttccccttccccttccccttttcttttcttctttgagatggagtttcactcttgttgcccagtctggagtgcaatggcacaatctcagctcactgcaacctttgcctcccgggctcaagcagttctcctgcctcagcctcccaagtagctgggattacaggcacccaccaccatgcctggctaattttggtattttcagtagagacagggtttcaccatgttggtcaggcatgtctcgaactcctgacctcaagtgatccaccagcctcagcctcccgtagattacaggcgtgagccaccgcgcccggccgcctttctcttttcttcagcaccagttactgcaaagacccctggagtcggggcccatcctgggtcttgcagggactgattctgtccggtgtcgggctatgcacaggcagctgtggtggattcctgggttctccccacatctgcttccctttaacatgtcaaggcagccatccaaagggcatgaccctttccatgtgtagcgggagggtcagtctgtatcgcttccttctagaccttgcagcttttgtattttaaaactcgagagacaatagtcatctcctaaaaatagcagcagtgacatagctccgcagtcagttttgctggcactgggaattcagcttttgtctctggtgttagataacgggcaggtttctaggaaatgaattccatgtacagtagagccaggttcagttgacctcactggagaccttgaacccagcttgctgcaccgtggggtcctttaatcatctccctgctgacctccatgctttggagggtccaggtcttagggggacctgtttccttgggagtacaaaggccctagacacttaagagtcgcgtttcaggaagctggcacagcctgtgaggggccttcaggagtggggaaaggggcagtgccttgtcacctatatgtcctctgttgaagagtgaactgcaccaggccatctctgaggctctttcacacactgtgatgggtggaaggccactttcagctgcaagtacagaccctgtagatgatcagctcattctagtttgcctgggactttccggttttttgtttttagcactgaaaatcctgtatcctgggaaacccctctgtccccaggaaactgggatggttagtcaacctgcctatgtacaaggccacccttaggttgaggctgcacacagagtgctgcctaagagaagctgaaggacccaccaacagcagaatttctcctttagcactatctggcccctgactttggaggaaagcagcatgttaagttacattatctggaaggaagcactggactaaacttagtcccttatactggattcttttatcacacaagaaagccatcacccagccaagggcaggacccgcatggggacacaggacagatagatcttcttggggggattttgggagataggacagcccttgatcagagagggcccatggggtggagggtggggctggattggagttggggaaatgtagattaaatacatttcttgaaaaaaattcagttaagatatgctagagaagctacggtcaatttctttttaatagaaataatcatttttaaattttatcaagtgtaaacaaatctgaaccgttgggtttgtttatgaggcacaagtatattgagttaattttgaaaaaccccaaacctatctcattttttagagatagtgacttacagtgactctactaataattttattgggtctaagaatacttaagatactcttggctgggcgcagtggctcatgcctataatcccccagcgcttggaggggctgaggtgggtggattgcctgagcccaggagttcaataccagcctgggcaacatggcgaaaccccatctctacaaaaaatacaaaagttttctggtcatggtggcatgcacctgtaatcccaaccacacaggaggctgaggttggagaatcatctgagcccaggaagtcaaggctgcagtgagccgtgatcgcgccactgcactctagtctgggcaagggaagtgatactgtgtctcaaaaaaaaaaaaaaaaagatactctctccttttttttttaattccccagttttaatctggtagagggaccttgaaaatacttaaatactcatatcattcttatggattggtttgggtgtgtgagttctaacatagacaggaaggctatttttcctatcaataacatccaagaagcctgctaagtaatggtttttttttttttggaaaaaccatttggaaaagaatagattttcctgaactttattaaaacacaaatcaggtgctgaagggataattttgaaattctgtattttgaatgtctttccacttgcagaagaggtatgtagtttttaaaatttctgaatagaactacttgtgcatgactttgaaaaagtcactttcactcaaaaaataccaggttctttacctggaaaattaatcagtgcacatatagatgatctctagctctaaaaattgatgggattctatcttatgatttaaaaaattaaatgagtagtattaaatgattaaaataagtagtcacgggatgactaggaacagaattttttttttttaaagaaacctagtgagaaaggtcaaagtaatgggaaatccccaaaaagcatagtaaaaggaagcaatttgaaagtgaagaaaaaggaaccttttaaataacagctgtattgatacagaattcacataccatacaatttaaccgtttaatgtctaccgtggtttttatcatgttcacagatttgtacaattatccccacagttaatttcagaacattttcatcaattcagaaagaaccacataccttttagcttttaccctctattccccaccccctccagccctaagcaaccattaatctactctgtctgcctgtttacatgatttatgggaggatttttatgaaagaaccagatccctgtaattttatgtccccctatcttgacattttcctcagtaagagagtaggacaatcactccaccaccaggagtggctgccacatgcaagacatatgtgggttctacctgcaagggtctcaccataaattacctgtcaattacagtggaggatgaggggctgagtcttttaaagtatgcagagccctaagtctgactcattctgtgttgagcgttgggccacactgtctgctcattcatctctagttggtttgctgacctgtcgctgcagaggtcctccgagtgtggtccccacccagcctcacttgggacctcaccctagaccccttgctggggcagcagggtcagcactcagtattgagcaaaccctccagcggattatgttgcctgctcgagtttgagcaccatggatgtttcttgtcccccacccccagccccaccctgccacccttcaggttttctctaccctgctttcttttctgaagagaaggttgcagttggtttctctggatcttgtctgttctctctcactcttttctttcttttcttggtcctgcctccggtttggggtgggggcagctctgtggagagtaggccagttggctttgcctttggtggggtgtcgggggtgaggcttgggagggactcgggagtggagagatgttgacagaaatctgcttttgccagtggctttggtccggacttgcccctggaccaggtcttttcagtggcctcctcccactgcctcttccatccttccctctcttctggttctttccctccttttcatgaacatatttagatccctcctgtcattaaaaacaaaaccaacccaacactccaaactcacttggcagtgggttgggctctggcaggtcctctaagtcttctgcttcccaaggccaaagggctgccagtcggtgggtcccatgtcctcgtcctgcctccagccttggggtgggctggttctgcccttgccagcccagggcttctgccttctcaggctgcttctctgcagtgtgtattggctttattggtgggtgtcatgaaagcatctgtgcctggggcctggtcccaccccttaagtcctgatttcttccccatcccagccactgagacttctcatgaccttggcagggctgcctcctcctcccccagtgttttgggcactattgtcagaattggaacatgatgacaaacctgctttggggactgggatgccagggcagagtctcagattcccttggccccctgcctttcagccaggtgtcctaggggagagcagcctgtttgaggtgcacggtggcctggccctctgggctcgccaacaccgtggctcctaggaactgctctgcgtctgggatcctctaccctggatccgggagcctctttttgctttttgcttctttacactgctcatttttggtctcccctggatggtctggtttcccttcctttgttccatgaggcacttttcataggctggcctctttactccctgtcatggttagttttatgagtcagctgggctaggccacagtacccaggtattcagtcaaacactggtctaggtgttcctgtgcaggtattttgtagctgtggttaacatctacaattagttgactttaagtcaaggagattaccctctataatttgggtggacctcatccaatcagttgaacaaaaactgaggtttcctggaggagaagaaattctgcctcaaagctgcagcctcaactcctgcctgagtttccagcctgcctgcctgccctgtagattttggacttgccagcccccacaatctcatgagccagtttcttaaaataaatctctttatgtctgtatctcctcttggttctgtctctctggagagccctgacttatgcattcccataggaacattgtctgctggcagagcctcctcaggctcacgcagctggtgccagctctcagccctggaccactttcctaagagtcatgtgtgcattcagcctcatgtgcagagttcctcttgccagtcttcccccagcatctccttcttaacgtattccttttgcctccagggccagcttcctgggtatacagcctgtccagttcacaggcctgtgcttaaaagggccctatgtctgatgtaacactctgctgttactgttttgaaattcttaatggttttgaaccagggcctgcattttcattttgtactggggctgcaaagtacggagctggtcctagctgtccctgcgtttctggctgcccgtgtttacaatcctagagtcagcccagccttcctcatctcctgtatccagtcatttcccaagcgggggggatgtccaccatgatggtctcccacatttcactggggtctcacttaagcaagtgctataaccccccgccctggagtctctcaccagtctgttctgctgccacttctagatttatcttcatgtatgtggcttttttattttctttttaacaacagcattgtctttggaaactctccctgcagggctcctcccaacagttctccagatgcttccctctgtgtcacagaagccaggtgacttgctgtcccccagctgtgcgctgtgctgcctgctccctgttccgccatggtggatccttgttccccatggaccacacacctgtccctcctttgactgcaaggccactcagagttcccctcccatggacttcccgtgggctcctttgccgcatggcttccccgactttggaccctcatcgcagttcgcaacttggtatagatgcctttcattctgcgttgttttatattgattggtggatattttctcttgaagcttggtcagctccatgagggagatgctcaacctcattcagtttctgccctgtgcagtccggcagtttgtcgcacatggttggtggatgattgtccctgcttttttttttttttttcttgtttttgagatggaatcttgctctgtcgcccaggctggagtgcagtggggcaatctcggctaactgcaacctccacctccagggttcaagtaactctcctgcctcagcctcccgagtagctgggactacaggtgtatgctaccacgcctgggtaatttttttgtattgttagtagagacaggttttccccatgttggccaggctggtcttgaactcctgacctcaggtgatcctccctccccgggcctcccaaagtgctgggattacaggcgcgagccaccgcgcccgacctgtccctgctttttgaacatgattcaagtatcgtgccctgttgccagttacatatactattttgaaaattcttaaaaataggataggtctcagcactgtggacattttggttctaataatcctttgctgtgggaacccgtcctgtgcatggcaaggtgctgagtagcatccctggcccctgcccactggatgccagcaccagtgccttcccctctgtgacaatgaaagtctccagacattgccagtttctcctgttgaagtcactggaatagggatagagactgaagggagtaagattgttggagttgtgaacctgagtgccttcttacctggaaggatctgtggtatttggcacgcctcgctgctctctcctgcctcttcctcaccaagagttttgtcaggtgttttttacagttaaagaatttatgtactttggtaggaaaattgtgtttaccagcccttccaacaggcggtcctattctgtaagatggaaaatacctataattagaattcctggctctgtaaatgcttctctctttgtgatttggagtgtttgttgttgtttgaatcttaacatttgactgtatttttctcttggagttgtaataagacaagggagcttttaaaagtgtaatctgaggagattaaccccaggaggcatgaaatatccctccgaagatcacagtcggtctttcgaggacatcctgccacgtttacccagtgcccggcgtgagcagcctagaagacgagtggtggcagctgccacctgcccggtgaaaatgtaattgacaggaaattaatgaggggccagagatgactgttttatgcctaacagaaccacatgacacgtgttttaccaagaaatcatacatttggctttgattttcaaagtgatttttatgaactaataacacttcaagcaggcactttctctgttggaattctccctttaaaaagaactgtcagctgggggcggtggcttatgcgtgtaatcccagaacttcgggaggctgaagtgggctgatcacttgagcttgggagttcaagaccagtctgggcaacatagtaagaccctgtctctacaaaaaatgcaaaaattagccagatgtgggggtacatgcctatagtcctagctactttggaggctgaggcaggaggatcacttgagctggaaagttgaagctgcagtgagccatgatcatgccactgcattccagcctgggagacagagcaagaccctgtctcaaaaaaataataaaaaaaaaagaaatgtcacaaaacaatttgcattaaataagcctcttgattcagcatgaagttgcctctttttcagtttaatgtatttatttatttagcaaatatttattggacaggggtacctgtgccaggcgctgttctaggggacagaatgccagacagaaatggagattgctgctgaagtggagcttacgtgattttgggggtgagaaacaataacaagctcaaatacatgcacctcttctcaggagggagcaagtgctcaggagatgggataaggtaggcagggaaagggttttgcagcactgggctggtgctgaaaatttccgtcctcgttgaggaaggaacctttgagtaaagacctggaaggaagtgaaagtcttgctgtttggaggtctaggaaagagccttccaggctggtggagcaggtggtagagctggaatgttctagaagagccagaggtcagagggactacagcagagcaccatggggagagggcaggagatgaggtcagaagtgaccagtgctttactcacaaagggaaggacagacttgggtaaggagagctggaggggaaggaagaagacccaactccagtggtaagtgagagctctgctggcgtcgtgttgaagtttggtcctctttgaagtggacacagtcttccagggcagatcttcttaggctctggttgtggtgagctcgtctcttacattgtgcttacttagatcaatgccttttcagtgtttgtttaaatcaacaagtgttttcctggatgcctacagagctggaacctgaggtcccctaaacattgtccttgatggacaaatccatatttgggatgctgatctgtggtccttaacttagacgtcttaggtctgacttcgagtctccacagtcatttccatttgacaaagggagtttaagcatgtgattagatggggtctgtggagcatgtggctttgcttgttctagggaaaagaaacgcactgagaaacacctggaattagaaagcacttcctgggtgtttgtggcttcctctgtcagccctggagatgtggctgcccaaaggcctgtgtggctaacaggtgtgctggagatgtctggattgtagccttgctgggagccctcatgaaagacaatgcccgggcccaggtgtttgatgggttaccatgctgggtgagggcgctgtgccaatggcataaagcatggggtcatggggtcatggcctcatggccatggggtcatgcgtaaagcagagctgtgggtccagggtctgacagatgggactcactgcagggcccctcctctctgtcctcacctgaagcagttgcatccatcagtccttcgcccatcccagagttttggtgatggcttccctgtgccaggctttccgcaggagactggaggccaagacaagtacaagccacggggctctatcatcaaggacccaacaggcagcaacataggctgtggtgaagaccctgaattctatgttcttgtgggtcttgggagtttctctgttgtctctgctccatgctaattgcatagcatttctttcttccattatgtaacaccgagaaatacagtcatccttcaggacacgtgaggaatttgttccaggactcccccacctatacccaaatctgcatatactcaagtcccacaatccgctttgtggagcccctgtatacagagtcagccctctgtaggtggatttcacttcccacgatttggttgaaaaaaatctacctataagtgtactctgacagttcaagagttgtttaaggttcaactgtaacacagccctatatgaagaagaaagaaaaggctggtgttggtgccacagccagtggctctctacttgattggaagttcttgtttagacctgatacactgtgagaatacgatgtgcgttgggttcttgtaactgtgtgtgtgtgtgtgtgtgtgtgtgtgtgtgtgtgtgtgtgtgtgtgtatactgctttcttctctttattttccatacagtttataagaggacattcagaccaacaaacagttctcatcttcagtcttttagtgctgaataagttttgctgtgtggcatcttaatgcgcaatttaggaaattgctcttggtatcttgcagtcacagccagattcaattggtgagggatctttccagtgcaaacatggccttttccaatacatttacatattctgggacattactcatttgtttcctggcttttaacagcactgcaaatatgggccttttctgaaacatttacatagaccaggacattattattcatgtgttgcctggcttttaaatcaacagcagtatttacttagctaagaaattgggagactctttagcctactgaatttaaaaaagcagtgaagtgttgggggtatgtgaagttttcattgtgggagagtgtttccaattttagtgattttatttattatttatttatttatttatttattttgagatggagtctcgctctgtcgcccaagctggaatgcagttgtgcgatcttggctcactgcaacctctgtctcctgggttcaagcaattctcccacctcagcctcccaagtagctgggattacagacgcccgccaccatgcccggctgatttttgtatttttagtagagatggggtttcaccatgttggccaggttgatctcgaactcctgacctgaagtgatctgcctggctaatttttgtatttttagtaatgacggggtttcaccatgttggccagacatgtcttgaactcctgacctcaagtgatccgcctgcttcagcttcccaaagtgctgggattacagatgtgaaccaccacacccggccagattttagtgatgttaaagatctttctgagtagagttactttattttcactgtgaatgatcacattcacaacatgatccttattcttttactcggacaacattgaatagtaatatttattaggtattttattattcttctgatacaatttttttttttttggtgtggaaaatgaaaaaaaaaagagaagtacaaagaaaaaaacaaaaaccagtcacctgtattcccagtacctggagctaatgatagtgaatttttcggtgttcttttctgacttgtgctgtgaaatatatatgctctgccagattagctatctgtaaagttatctatctataaataaagttttgagtcctggtttattcacttgtaggggtatttctatattagaaatacttcagaatcttgattttaaaaatccaacttctgcatatatcatagtttattcagtaattttgggtcttttttgtttctgaaattttttgtgatataaataatgctctgatgtatgaatgtctaaatacgtctcttattggctctctgggcagttctgtttagatcaattccaagaaggtatattattggtatgttattattgtacccagttttccttccaccaacagggtatgaaattgcctgtttcactatatcctcatgacactgaatgttaattatcaaaaatgttgaaacggctttgctgatcttcaaaatattaagtcatgcatacttattgtaaaatattcagataacataaaaaggtaaaatgccaaagatgataaaaaagtgactgcgaattcatgatctaggcatacttatgtatttgaggtataactttagcgacatttaatataatacggtacttataatcttttttccttagcaccttcatgagggcacctttctttgccagcaaatacatgtcgtttttaatgaccacaatgtactctttctggatatgttcgtttctttaacctgtggcttcctagtggacattgaggttatttctggtttgcagattagtaacaacacagagatttgcacatctttgtacagaaacctactgactctcttaggaaattgttagattttgtttcgatctgtggagtaagttctcttatttttgaaagtaaatgtgcctttccctaaggtaggattagactttcctccccataacatcacacttggccatgtcacttgctctggccaattcagtgagaagtgacttgtgtaacttttggccagaagttttaaaatccagcgtatgatttgccatatcctttttcccctcttccgggcaacccacaattttccaggtagagttttctccatcagcctgagtcttgcaagggaaaacaatgtggaaaaaagctgcatgccaaccatgtggcatgagcaggaagcagacgtttgtcgtatgccattgggatgtggagattgcttgttctgctgcacagtctaactcagcctgagtgcatattagctagtggctccctagagagagtgaacttgcttattgtcatcacttatgcatatgaatactgcctcagcgtccatctgcttgtcctgttcccagcttgtcatgcttgactaacatattttgaggcagtcttcacgcagctcctgttttcatgttctgggtagataagaccccataccctgagctgcttgaccacattacttctgctttaagcctcgggaacctgataaggtaacccccgagttcctgtgctgagtctcgtgcttccttcaaatgaactaatccaaccgtgctgtgggaaacccacctaggtaaccccataaaggatccaacccacaggcccctccgtttctcgttccccacctgctggtcgaaggagcaggtcctggatggctcctcccctcttctctttggtcttgccaggggtgctgtcctcttccttccagacctgtgagtagtaaacttgattcattttgcagtctgagtgtccctcactgtgctgcacctgactacaccaagcctcaccatctcacttaacattacaacactgaagctttctagcaaggtaagggagtacatttccttctacactttgccaacaccaattaatttgactctgtttactcttttccaacttgtcaaaaaatgacacctcacttttatttgtgcatttttgttgattagtgaggctgagacatatttcatatcacatgtttactagccctttgtatttctttctttgaactaatttaccaattcctttgtcaattttttgattagtctgtcttatcttcttgaggtctaaggatttttttacatatgctaaagttattatattctgccttctttttctaatttgtcatttaaaaaatcttgtttggggtttatagagtttcctgaatatgcggcttgatatctcttgtcagttttggaaaattctctgccattatcttgtcaaatattgtttttgttccaatccctttttcttcctatcctgtgacaccaaattcacacacattagaccttttataccatgctgcctgtgtatgttatgcttttcttcctatcttttaaatcttttttttttttaattttctgggcatttttgattaaacttatcttttgattcactaatcatatctttaccctaatctactatttaattgctttttacattcttaatttcaattatgctgtatttctaaaatttttgattctttattgattctagttctgtaataaagttcctcatttgtcattatttgcttttacatattagttattttaaagcttgatcgttctaatttctggatcttctggggatgttttctattttctgtttttctcttggccctgtctcctgatacatctggtaatttttggaatgctagacattgtgtatgaaaattgaagtagcactagattgtgttatcttgtccagggaggatttagtttgcttctggcagacagagtgggacagaagattgcagtctaggttgtagtttttataagatctggcctctttctggcctgtcttgtaggatatagcccttttggcttcctatagaaatatggcctgggcagatcatgaataccacttttgtctccttaacccaagcttatccaacccctggcctgcgggccacatgaggcccaggatgactttgaatgcagcccaacacaaatttgtagactttcttaaaatattttgagatgcgcgcgcgcgcgcgcgcgtgtgtgtgtgtgtgtgtgttttcagccagtgttagtgttagtatattttatgtgtggcccaagacaattcttcttccattgaggtccagggaagccaaaagattggatacccctccctgcaaaccctcgagagtatgaccaactctgcttagctcctcctacccttcactactgctctctgcttggtttctcagcacccagccttactcagcaaatgcccttagggaaagccatgagaatggaagcttatctcaggatttccgccttctttctggaatacaatcaggcctgcaagtcctggtcgtcttggaaactggatgcctccaaatggatatttagggaaaaaaagtattcagttgttctcaggggaaaagtgcctctgattgaagccagtttctcagagctgaaagtgagagtccctgtcatttgcctttttactttctttacactgttttgctgagaaggtttaaatttttatacagtcagatgtatctatttctttatggtttccggccttgctctattgcttcaaaatgctgtttctaagccaggtttatagaaatagtcatctacattttttttagtggtttttttttttttttgagatggagtctcattcggttgcccaggctggagtgcagtggcaccatgtgggctccctgcaacctccccctcccagtttcaagcaattctcctgcctcagcctcctgagtagctgggacaacaggtgcgtgccaccatgcctggctaattttttttgtacttttggtagagacaggatttcaccatattggccaggctagtctcgaacgcctgacctcttgatctgccacccttggcctcccagagtgctgtcccgcaccgagcctttttagtgtttttatgattgaatatttaatgattcatttcagcctgagatgtgagataaagatccaaccttattttttttccgtatgactgggacttttgtccagaactattaatgaattcatcttttgtgaagatctgaaatgtaatatttattgttaagcatatggtgtctcattaatattttaatttacattattttgcttactagtaagattatgtatattttacatgtatttactggctttttgctattttttggtttttctactcattcctttacccttgaaaaattgtactcttggtgtatttatgctgatattcaatataatatttctgtttaaatcattctgtgaatgtcactaatcttgattgctttttcatttttctttcaattttacttataattttgatataagggaatattgtatttatatagtaacttacattgtatatttattgttatcttattatttttagcttttgaatctcttttctccatcagtaaactattttaggatataagtatgtatgtatgtatgtatatatattatacccttgactttttagtccttttgtattatcttttgattttatggtgtgtgtgtgtgtgtgtgtgtgtgtttactgctcagtaatcaacttttccagcaatgttggttgagtcatccatcactgcccagattgctcctttaacacatgttcccctttaaagacagggtcttattttgggccatctgctttattttcttctcaccaatttgtgggaaaactttattcttgttagtattctactttccttgtctcttatttttgttaaacagagcatatatgtgatagaaaatagaatcctggctgggcgcggtggcgcccatgcctgtaatcccagcactttgggaggccagggcgggcggatcacctgaggtcaggagtttaagactagcctggccaacatggtgaaaccccatctctactaaaaaaaaaaaaaaaaaaaaaaaaaaattaggtggacgtggtggcggctgtaatcccagctacttggaaggctgagcatgagaatcgcttgaacccgggaggtggaggttgcaatgagctgagctgagattgcaccactgcactccagcctgggcaacagagtgagactctgtcaaaaaaaaaaaaagaagaagaaaaagaaaagaaaatagaatcctgcagatgagcttgcagtgagagaccccaggcttcttggccacctgtctgctcctcagagctgtctcttgccactgttcccactttcatttcatctggcagtcccctccctgccagttgcaacctgctcatcatagctactcttggtttgtccatttgaggcagtggagatgattgtgtgcaatggtagtggagttttttgctgacttgcccttttcacccctctgatcagacccatccacccatcctttttcatatgtattcttttagtttcttatatatgttatttcaaccccagttccttctccatcaattctagctggtatttcctgacttctcctctgttaggtaaggaccttcctaaccttttcccaccaccccgtatccacccctcatattgtcttcgctagctttccacttacgagactagtaacattttcttggatcttaattatgcttattatttcaactttatctatagtttgattctaaaagtagaaaacaactaacccttatattataacactacagctattattagttgagtcaactggcataataggactctctttttttctgtgcagtaacatattttaaattattatcgcagataatatattttgctctgtttacttttttttaaagcattagctattaactcttttaagaaaaaacaaaataaagcaaaaacctgtaccatcaatgaatgtacgaccccatctgcaatgacagaatactttcctcccctttagacactggatatttgagtggggagcttctcaaaggggtcatctacacatttgttgtatgacatttactttttagtgccttaacttgccttgtactgtacctcacctctgtctcagtcgacaccctaccctgctcatcccaaccccaccctgggtcaacctcctgttcaccatgactccagcccaactcctccaaccctagctcacctccagagctctgagtcttcacctctccagcctctctccaacctcttctcctcccgggcaggggggctaacatcagaccccgactcaatgacccactcactccccaacccctcaccctggctcaacttccctgaccctggctcacctggatccccattccagcacaacccccacccctctcaactcacttaccctcaccccctcatgaaccctctgccatttaaggatagttcatctccttttctgctgcaagactactcttggctgttgagctacagttttttcagacccaaggcctgtgctgtctctgagccgaattctggtcccgtggcaaggcagaacctgtcccagagtctctgcagtgagcaaagcctagagactcaacagcgaggagtaaccacatgtgggagctgtcagctcacggggattttctctcctctccaagggcaggaattctcttcattgtcacagacctattccttatttaaagctttttttcactcttattcagggagggatgtttaaagagatcatgtatttattgattgattgatctccaatactgcagaaaatatgcattttaaaaacacacatccttctttttttttttttttttttttttgagacagggtttcttgctcttgttgcccaggctggagtgcaatgcccaccacaacctccgcttgccgggttcaagcgattctcctgcctcaggctcctgaggagctgggattacaggcatgcgccaccacgcccggctaatttttgtatttttagtagagacagggtttctccatgttggtgagactggttttgaactcccaacctcagctgatctgccctcctcggcctcccaaagtgctgggattacaggtgtgaaccaccacgcccagccaaaaacacattcttctttctacttgttattcccttcgtgcatgcactcatccccatgcatgccgagggcacatgttctggaaggcccctgggagccacatggggttcacgacctcaaaactgaagccctcagagggtatttgattcattaggtggggtaagacatgaacctaagaagaacgactccttgaaagaaaatgaggtaacaggaaaggaattcactgatacatgtcaggaacccagagctgcctgcgatgtgggtgggattcggcactgggaaaccttgtgtgtgggtccttcggggaaagtgggagttgactgccgttgagcgggtaggaaagtgccttccaggtacaggcagcaggagtggtgattgtcttggtagaggatgggtgaactgcaaatagagttgaaggagctgggctgagtagttgggatttcactccccgggtgattggtgggacccagcagggccagtcctgggcttttcctatggcaagtaactcaagagctgcaggagcagatgttgttaagcagagaggaaacaccaaacatggatccctatctctagcgagtgtgccctgtgactgtggagggtggaggggagtcacgccagagggaggtgctgtgttggggccagaccggagggttacatcctgagcaggagaggagggaggaggccaggtggaggagcggcctgggggacataggtggttgtggtgctagattggcagtggatttttttctgaaggctgccgtaacaaatgaccacaaagtaggtggcttaaacatcagaaattgattctctcacaattctggggggcagatgtctgaagtccaggtgacagcagggccacgctccctctggcagagctgggaattctgcggtctgtgacagcatcgctccaatctctctctgtcctcatctgtcctctgcacatctgtgtctcaaatctccaggatgatctcatcttaggatccttaattatgatctataaagatgctatttcccaacagagtctcattcacagcgaccggggttaggatgtggacatgtcttttctgggcgatacatttcaacctactacaggcagttacctgaaggagtaactgaaggagaggggttcagaatcctccagtggggcctgatgggcagaggagagacttggacacccttaagagacgaaatgaatcttcagaggttcagccattgcttgcaatgtcatcttctgggctcatccctgcactccaaccctggacattttctctggtcttttctagtggccaccatctggatgattacgactctggaaatctctgtccatcatccatttttttgcctcctctgtgaacgagcaggtgtgatggcctgaaaacagagagggagaaggctgagtgtaccagggcaggggaagcgcttcctggaattacgtgtcccaggacaaaagtgaaactgccttcgctgactcataggaaagtttgaaaatatcatgtttcgcctatgcctgggggatctttgtttttggcataagccgaacagattgttccaggccagaaaaaaactaagccaaaccaaaacaacagaatgacttaattatgtaccagcaccctttaaaattaattatgcttgctttctttttgtccccctcaacttttagtttaagttctgaggcacatgtgcaggatgtgcaggtttgttacacaggcagtgtgccatgcccattgtggtttgctgcacagatcaacccatcagctaggtattaagtgcagaattctttagctattcttcctgatgctctcctgcctcacaccccctgataagcccctgtgtgcattgatccccaactgtgtgtccatgtgttctcatcgttcagctcccacttataagtgagaacatgcagtgtttgtttttctgtttctgcattagtttgccaaggataatgccttccagcaccatccatgttcctgcaaaggacatggtcttgttcctttttatggctgcatagtattccatggtatataagattatgtaaagagatcgaacctacaactgattggcgtacctgaaagacatggggagaatggaaccaatttggaaaacataattcaggatatcatttgtgagaacttccccaacctagtaagacaggccaacatttaaattcaggaaatgcagagaaacccagtaagatgctccatgagaccatcaaccccaagacacatcatcatcagattctccaaggttgaaatgaaagaaaaaatgttaagggcagccagagagaaaggccaggttacccacaaagagaatcccgtcagactaacagtggacctctcagcagaaaccccacaagccagaagagattgggggacaatattcaacattcttaaagaaaaaaaaattccaactcagtttcatatccagccaatctaagtattcataagtgaaggagaaataagatccttttcagaaaagcaaatgctgagggaatttgtcaccatcaggcctggcttgcaagagctcctgaaggtagcactaaatatggaaaggaaaaaaacactcccagccacaacacactgaagtacacagacaagtgacactatgaggcaacaacataaacaactctgcaaataaccagctagcatcgtgatgacaggatcagactcacacatagcaatattatccttaaatgtaaattggctgaatgtcccaattaaaagacacagaatagcaagctgggtaaagagttaagacccatcagtgtgctttcttcaagagactcatctcacatgcaaagacacatgtaggctgaaaatgaagggatggaggaaaatttaccaagcaaggggaaaacaggaaaaagcagggagtgcaattctagtttctgacaaaacaggctttaaaccaacaaagataaaaaaagacaaagaagggcattacataatggtaaaggagtcgattcaacaagaagagctaactatcctaaatatatatgcacccaatacaggggcacccagattcatgaggcaaatttgtagagacctacaaagagacttagactcccacacaataataatgggagactttaacaccccactgacaatattagatcatcaagacagaaaattaacaaatattcaggacctgaactcagctctggatcaagcagacctcatagatatctccaggactctccaccctaaaacaacagaatatacattcctctcatcactacatggcacttactctaaagttgctcacataatcagaagtaaaacactcctcagcaaatgcagaagaactgaaatcataacaaacagtctctcagaccacagcacaaactaattatgctttctaatgtgaacctctaattcttggttatatcttgtacatacatgtgtttttttcttttagttttggatttctggaccttgacatgtttaccaggagtactagattttcttgctatgttccttttcttggcatatgactttgatccttctgaggggttggagtcagaagccaattaccactactttttcctgcctcctcccacatccagatgtctgttctccagcctccatctcttctaagtttgccttctcctctcagtacctggatgtgaccaccccattcagtggcgtcatctctacctagtgactcctaggagacttttgagtattttctgacttctagcctgccccttctagcactctcaatgccttgttgcgttttaaccatattttatattttgttttttgtttttttttgagatggagtcttgctctgttgcccaggctgcagtgcaatggcacaatctcggctcatggcaacctctgcctcctgggttcaagcgattctcctgcctcagtctcccaggtagctgggattacaggcatgcaccaccatgcctggctaatttttgtattttttgtagagatggagtttcaccatgttagccagcctggtctcgaacacctgacctcagatcatccatccgcctcggcctcccaaagtgctgggattataggcgtgagtcactgtgtctggccatgatttttgttttgttttgttttgcttttaattaaaaaaattttttttaatgtttagagacagagtcttactatgttgcacagactggtcttggaactcctgggctctagcaatcctcccatctcagcctcccaaagttctgggattgcaggcattagctactacacctggccaatcatattttatgttaataatacttggttagccaggcatggtggctcatgtccgtaatcccaacactttgggaggctgaggcaggtgaatcacttgagcccagaagtttgagaccagcctgagcaacacagagaaatcctgtcttaaagaaaaaataaaaaaatactctgttgaggtataattgacatatgataaagtacagaaattctaagtgaacagccgtatgattttgacaaatatatacacctgtgcagtcatccccctactcaagatatagagcatttccatcaccatagtaagtttcctcttgctcctttctactcagtccctgtctcatcagaggcaaagacctgttgttcagatttctgtcaccatggattagtttagccagtattgaaaattcagtggaatcacacagtgtgcgctctggtgcctggattctttcactcaacataatggttttgagatttagccatgttgtgtgtaccactaggttgcttttttttttctttccatagttaacaactttattgacaattcatccattaaagtatacaacttgatagtttggggcatattccattattaatttttaaaattgtggtgaaatatatataacataaaattgttcattttaaccattgtaaccagtgtacagttcagtggcatttgcaatgttgtgcaaacattatcactatttccaaaatgtttttatcatccctctccccccagtccctcttcctcctcctaccctcttcccctcagcccctgataacctctaacctattttctgcctttatgaatttgcctatcctacatatttgcataaatagaatcatacaatatttgtctttttgtatatgggtaatatcacttagcatgatatgctcagtgttcatctatattataaaatgtatcagaatttcctttttttaaaggttgaataatattccatcatatgtatataccacattttgcctgtccatttatctgttgatggacatttgggtattccatgttttcactactgtgaataatgctgttaggaacatgagtgtacaaatctttgtttcaacctctgctttaaactcatttgggcatatacctaggagtggaattactggatcatgtggcaattctatgtttagctttctgaggaacaaccaagctattttccacagtggctgcaccacattagactctgaccagcaatgcacaagggtttgtttcttcacatccttaccaaacaaacacttgttatttttttatataggtgtgttttaaatggtagccatcctgataggggtgaagtgatttcttattgtggtttagatgagcatttctcatgactcagtgactaatgatgttgagcattttttcacaggcttattcagcatttgtatgtctgcataggcaaagttgctttttctgctatcattacttcattgagagataatttacatacagtgaaatgcacaactcttaagggtgtagttcagtgaattttcacaaatgaatatgcacatgtaaatgtcactcagattaagatatgattccattaccccaggaagttctcttgtgccattttctaataacccccttcacaattttttattaccatatacagtattaatcttgcctgtccttggatttcattaaatagaatccagcagcgtgcactttttggtgtctggcatattttgttcaatgtaatatgcatgagatccactggcattgctgtgtgtatcaggattttgttcttcttttgttgctcagtagtattcccaagtttgattatagcagactttgcttatctagtctcttgatgaatatttgggttgtttgcaattttgggatattatggataaagctgtcctgaacattcttgtatacatcttcatgtggatatagactttaatttattttgagagagtatccgtgaatggagttgctggctcataaggtagacatgtgttaaactttaatagaaactgccagtttcccagtgtggttcttccattttacactcccacctgctgggaacatgagagttccacacccttgccaacatttggtattgtcagtctttttaattttaaccattctggtgggtgtatggcggtatctcattgtgggtttaatttgcatttccctgtgactaacgatatcgagccctttcacatttggaaaaggttataatttaaattttgtacattaaaaaaaaatcaagttagaagacattaatgaacacctgcagaacagacatcccaaagcccagaatgtcatgtggaagccaccgccctgacagctatgagtcagacagacagatgtcagtttcagttacaccttaaatcacaaatgagttgccaactcagtttaaaaagaatagggttggggggcatatatttaaagaatattttgaaaatagaagaaaatgtggcaaggctgtctcctcccacaccagctcccacctgagagccagatagttagcaggaaaatctgatcacgctgctttctaagaccctgcgtggttctccaccaactttggatgcacttcagcctcctcagccctcgtggaagcccgtcatgacccagaattccccactcgtcagctccacgcctttgcacatgcttgcctcccgcctgggacacggtccctccaccatccctggcgctgcggacctcccaccattgcttggctaacgaggctcaacctggctgggtgccaactcctcccagcctgggcaagttgccagtcatctgtgctcccaccatcctctgggccgagcctggcattctcattgtttacttctctgcctccttccccagactgaatgtcctgaggggagggagtcgcatttcagcaatctttgtattttgaacacacagccagggaccagtaagcctgctgatggtgaataaatgctcatgggtgatgacgacagccagctgaaagcggtgcagccctcctccctgcggggcatgctctccgtggatgtgctggtttagtcacacacattttaagtgtgacgacacctatatattcctaaatctgtaagacaaagtacaagccacaatatctcgagatctgcccttctcctttgaccactccaccccagcctatgacagggggctgccatttccccccatggggccagggatgactcttggtagagcacccaggagctggtgcacatgagaacaagaccagttagggggcatgtgagggagtgctgtaggcatccaggccaggactaggtaagaatttatttggatttatatatagcagagactgggcaagacaagaaggtgggtgcgttgccccactgaaagaaagccaatcaagtaaaaatgaacaagaacacaagctgagctctgtgtcctgtgtccccgaaggggtgactgagcaacctcggtgcctgggtgtagagataacaccaccactgtccatcccggggcctcacccagggcgtcagcggagcatgctcacactttaggtcctgtagacaaaagtaattgcaggctcccagccaggagcctgggctgaggcctgaggatctgcatttctaacacgctcccaggggacgctgatgccgctggtcctgggactgcactatgagtggccaaagtcaaacctgcgcctggcagaaaacagtaaataggtcgtttggctcaatcattagccaggttgttaattctgcatccattggtttgggttgtactaaattaggccacactttttgtgaggtggaccagtatttgtgcatgacaggcccaatatttgtgaaaacattgccttgaaaatagttggagaattttatttctcatgaatagaacatgctgtcgtctgagagcctgcctcagagcagctggctgggagcctccggagtgggaaccgctttggcagagtaggtaaaacattcaaaaagggtttcaagtctttgagtctgaaacgagtggacaatgtagattcctttcatgaaattgtatgcagcattttgcaaggaacttataaagctgatcatagtctatagatcctgaaggtccaatttgctttccattgattgcttgtcatttttttttttttttgagacagtgtttcagtctgtcacccaggttggagtgcagtggcatgatcacagctcactgcagacttgacctcccaaactcaagcaatcctcctgcctcagcctctagagtagctaggactacaggtgtgcaccaccacacccagctactttttgtatatttttgtagagacgcggttttgccatgttgcccaggctggtctcgagcttctgagctcaagccatcctcccgtctcagcctcccaaggatctgggtttataggtgtgagccaccgtgcccggcctgatggtctatttatattctcccaactctttctagaaaaggatgggaggcagctttctgtcttctgtacagttttctcacagcccgtgaatccacttgtgtagttaagcaggagactgggaagcttcatcagaattttttcatccttaaaaaaaattttttttttttgagacagggtctcattccctcgcccaggctggagtgcagtggagtgatctcagttcactgcaacctacgcctcccaggttcaagtgattctcctgcctcagcctcctgagtagctcagattataggtgtgcaccaccatgccaggttaattgttgtatttttagtagagacggggttttgccatgttgcccaggctggtcttgaactcctgacctcagatgatccacctgcgttggcctcccaaagtactgggattacaggggtgagccactgtgcccagccccatccttaaacattttgtattttctgattattaaataaaaatagatgttcattgtagggaaaaatgagactttttacaactttttataacctattcagaatcaattactactgaaggcttagtgcatttctctcttgttttttgtcatgcagtgttaatagatgattttatataattgttttaaatgtatatttatcttatggtaatttaagcctttcctcatgattaaaattctttatatacctcaattttactaatatttgataaatgtaagattataccatagaaaaatgtttttttttaaactttttaaaataatttcaaaaggagaactttttttttttttttgagatggagtttcactctttttgcccaggctggagtgcaatggtgcaatctcggctcactataacctctgcctcctgggttcaagcgattctcctgcctcagcctccccagtagctgcaattacaggtgcctgccaccacacccagctaattttgtatttttagtagggacggagtttcaccatgttggccaggctggtctcaaactcctgaccttgtgatccacccgccttggcctcccagagtgctgggattacaggtgtgagccaccgcgcctggctttttttttttttttttttcagacagagtctttctctgtcacccgggctggagtacagtggcgtgatctcggctcactgcaacctccgcttcctgggttcaagtgattctcccacctcagcctcccgagtagctgggaccacagatatgcgccaccgcacccggctaatttttatattttttggtagagatggggtttcgccatgtcgaccaggctggtctcgatcccctgacctcaagcaatcctcccacctcagcctcctaaagtgctgggattacaggtgtgagccactgtgcctgaccaaaaggagaacctttttgaaaaaaaaaaaaaagaaaaaaaaaagaaaaatatagcactctcctggtgtcttctgggagtatagtgaagtccagagaggagattttcttagctgagttgcagaattaattatatctaatctcgctgcacctaacatctagtagatctcaatggctaataataaaatactaatatgttttatttaattatatattgtcttatataaacatatattcaactttaatgaatgatccagttctcaagacagaaacatagaattatatgttaatatgacaggctttggaaaattgtaactggattttgtcattattctatccttatgacttgttgatgtttgtattatctaatgctacatgcatcaccccaaaacacagtggctttaaataataattatcatttattttctctcacagtgtctatggctcgggaatgtgggaacctggttgggcagttctgactgagggtttctcgtgagttgcagtgggatgctggctgtggctgtagttgtctgaaggcttgactgaggccacagggtcctcttccaaagtggctctctctcgtggctggcacattggtgctggcagttagctgggggcctcagttcctctccctgtgggtctctccatagagctgcttgagtgtccacagggcgtggcggccggcttcctcaggagcctgcaatccaggagaccagggtgaaagctgcaagatcttttaggatctggccttggaaggcacacaccattactcctgccatatggggccagccctgatgcagcatgggaggtgatcaccaaggatgtgaataccaggaggaaacgaagatcattggggccatccaggaggctggctaccacagttgtggttgtgaatattagaagtacagggtatggaatgaataagaaaagtatactcatgacagacatacatggtactaggacagggtctgtgtttttgctgttgtaattcatcccctgcatgacctctttctcattgagtttctttctttccttttcttcttcctttttttttttgaggtggagttttgttgttgttgcccaggctggagtgcagtggcaagatttcagctcacagcaacctccgcctcccgggttcaagtgattctcttgcctcagcctcccaagtagctgggattacaggcactcgccaccatgcccagctaatttttgtatgattagtagagacagggtttcaccatgttggccaggctggtctcgaacatctgacctcaggtgatccgcctgcctcaacctcccaaactgctgggattacaggcatgagccaccatgcctggctgagtgagtttctgtgttccgctcttctagccttgctagttcctttaagttctctgtcgagctttgtacatctgttgtaaaaattccaagcttaatttcagaaagattaagtgaatcaatggttggaagaacatgtaattgttactgacagtcactgccttcaggtcaacggttaacaggcttagttttctttcatcacataatgcttgtatgatcactgcgtggaaaccactcccagtgttgggaaaattagatgagcctctgagataggaatagattaggtatatacatgaagttggcagagggaatacagttgaacaaagtagtggtttcatacattactaatctaaaatcataaatcccagcgagaggtttgcagtgataataagatttacgttttatgcaaaatttagtctaaagggaaattgttttgaattactgacaaccttgaatttatcaaatcctgattacagggctacaaggtgaccccatgttggaaggaattatcttgatgtattttacatatttatttattttattaataaaatgtcatttctttatttaaaacagtttattaggcatctctttatttgaagcagaaaagcatagataaaaatacaaatattggcctggcacagtagctcacgcctgtaatcccagcactttgggaggccaaggtgggcggatcacaaggtcaagagatcgagaccatcctggccaacatggtgaagccctgtctctactaaaaatacaaaaattagctgggcgtgttggcgagtgcctgtagtcccagctactcgggaggctgaggcaggagaatcacttgaacccacgaggtggaggttgcagtgacctgagatcgtgccactgcactccagcctggcgacagagcaagactctgtcttttttttttttttttgaggtggagtcttgctctgtcgcccaggttagagggcagtggcgcaatctcagctcgctgcaagctccgcctcccaggttcatgccattctcctgcctcagcctcctgagtagttgcgattacaggtgtgcgttactacacctggctcatttttttgtatttttaatagagacaggatttcaccatgttggccaggctggtcttgaactcctgacctcaagtgatccacccacctcagcctcccaaagtgttggggttacaggcatgagccaccacgcccagcccattttataagtacattttgtgcccaatcaagtatcaaagacataatcttaaaataaaggacagttcttcccaagggaaaaagaaagtaggcaacctgacacatgaatagatgatgtatgctactgttacacgcacacacacacactcagaatagactgtgatgctgtgataacaaaccacttcaagtcccagtggcttaaaataacaaaggtttgcctctcgctcattcatgctgttgtgcgccggctagagggggcagggctctgctctctctgccctcactccggaggcccagtctgggagcagttgcatctctgagcttcaagggcagtcaagtcaagaaaagggaaggtggcacatcgtccaccgtctctcgaaacttcctcctggaagtgacacctgctatttcacttacgtttaattacccaaagcaaaccagatggtcaagtcagaactcagaaagggtggggaaatgcaattttaccaagaggcaggaagaaatagataacggaataacgccagtgagtactgcagctgaatccagtgcaactgaattgtcctggttcaaacaattaaaaaagactttgtgtgtgtactttcaccagcttcttcacagaccgtcgcccatacttgagtgaatcttcctcctgtgcatgctactgtatatgataagtggaagagaatagagagtgttgtcagggacatttttgaggaatactgaagtctacttgggacagtgaaacacactggacgatgagcttccagctgcttgttttcctgctggactgtctgtgagttcatcttcttatttaaagctccttgttactgagtgcctcctagcagcagtttcctttagccctctctaggaggagcacaaatgcctattcctggcagcctgagcatgtcgtcttaggcgtcctctcgtgacctgtggtctggtgttttgcacaatcttcatcaccactccttctagaaggactgagaactgaatttgacttttaaaacgaagcttggtaatcaagaatagcaacagcaggctgagtacgggggctcacgcctatattcctaggactttgggaggctgaggcgggtggatcacttgaggtcaggagctcgagaccagcctgatcaacatggtgaaaccctgtctccactaaaaaaatacaaaaaaaaaaaaaaaaatgggcgtggtggtgcatgactgtagtctcagctactcaggaggctggggcaggagaatcgcctgaacccatgaggcggacattgcagtgagccaagattgtgccactgcactccagcctaggcaacagagcgagactccatctaaaaaaaaaaaaaaaaaagagccgtggtagttctgaaggggaagagcaaggaaggtttcttccctgcaaaacacaaggctgcagtagcgaatcaggattgccttggggctgaggtagattgttagaccaatgggagcaactctcaggttcattcctgtgtttatggggaggtgggatgagcttgagcatgctgttactaccaatgggaaaagaatggatgtgttcatatattgtgctaggaaaacagaaaaaggtaaaattaaacttctataataaaaaccatggtggattcaagacctcactatgaaaaaaaaaaaaacttgaaactgttgaaattaaatacagaggaatatctttagggtttttgaatgggaggcattgcttaaacgcatgacaaaaagcattcctataaaggaaaagattaataatatgactgcatcgaaacgtaaaacgggatggtaaatgaaaaacaagtggtgtcgagaaaacaatcgcaacacccttgacagagcttcaggtccaggggcagcatttacagaggcacctactctctgtggtgcctgagagggagcgcctctttaaatttggtgccccagggcctcctttgccacatcttagtgccagccttgggcgccagtgccatcctgatgccagctttagtgtctagggctgtattgcccagtagtgtagctggtacctccaagtggctgtggaacacagtgcaactgaggtgtgccgtaagtgtaaaatatgtactagattcatccaaaaaaggtaaaatagctcattaaaatttttctattgattacattttgaaatggtaatattttggatatgttgagttaaatacaatatatttattaggatttcatttggcttttattaatttggccactagaaaattaaaaattatcagccaggtgcagtagctcatgcctgtaatctcagcactttgggaggcagaggtgcgcagatcacttgagcccaggagttcgagaccagcctcggtaacatggcaaaacaccatctctacaaaaatacaaaaattagctggatgtggtggtgctcacccatagtcccagctactagggaggctgaggggggaggattgtttgagcctgggaggcgaaggctgcagtgagccgtgatgcactccagcaggtaacagaccaagacctgtctccaaaaaaaattttccattacatttgtggctccccttatgtctttattggacagcactgtcctcaagtattataaagaattcaaactgggctaggtgctgtggctcacccctgtaatcccagcactttgggaggctgaggtgggcagatcatttgaggtcaggggttcgagaccagactggccgacgtggtgaaaccccatttctactaaaaatacaaaaattagccaggcatggtggcaggcacctgtaatctcagctacttgggcagctgaggtgggagaatcgcttgaacccaggagatggaggctgccgtgagctgagattgtgccattgcactatagcctgggtgacagagtgagactccatctaaaaaaaacaaaacacacaaaaaaagaattcatactgatcaatgaggaaaagacaaagaagccaatgggaaatggacaaaagacataattaaatccttcaccaaagaggaaatccagacagccaatagatgcatggaaaggtggccagtcttactggcaatcaggaatgcgaagtgaaaacacaataacaatgtttaagcatccgattggtgaaaatgcaaaggtattgggaattggtgagaatgaagaaaaactgtaactttcacccatgagtggtggagttgaagttgttgcagccgctttggagaggactttggctcatgttctacccccagcttgtccacttagagcactggttctctcctggggcaattttgcctcccagggtgcatttggcaatgtctagaggcattttgggttgtcataaatgagggtaggagatgctcctgacgtctaatgggtagagaccagggattgcatagtacaggggacagccccccccccgaataaagaattatctggccccacatgtcaatagtgccctggtcgaaaaactgacacaggcgaggatcgcaattaatttccagctcaggtgcatcaggagatacagatcaaggttttaatttcagtgctctctgtatttgtagtcacagaactttggacacagtgtctatcagtttaggggcatggatgaacatgcagagacactatagcagtcacgatgcatttgccagtgatttggctgaatcacgtccagcactgcgtgaataaaccaagtttcaggctcagatgtacatggagagcattttgtgcaaatagttgcaataggaaataatgctccctattaaatatatcgcttgggcacagtggctcacgtctgtaatcccggcactttgggaggccgaggtgggtggatcacctgaggtcaggagtttgagaccagcttggccaacgtggcgaaacccgtctctactaaaaataaaaaaattagctgggtgtggtggcgggagactgtaatcccagctacctgggaggccgaggcaggagaattgcttgaacctggggggcggaggttgcggtaagctgagattgcgccactgcacttcagcctgggcagcagagcgaaactccttctcaaaataaataaataaataaataaaaatatattgtttatggatacatgcatatgtaataaaaattcaaaagcaaaatcagagcatacacagctgcaccaaatagtgatcacctctgggagggatggagaagaaagcacaaaaaggcatttcaactttttctgtaatgttgattcctttaaaaagtttgaagccgttatgacaaaatattgacctttgttaatgttaccaatgaagacatgggtgtttatcttacttatcttactttctattttacttttctctatatttggactttttctcataataaactctgatacacacataccaaagggcacttggaacaggggctgcctgagtctaggcagctcagtgggggttgtccctgtgtctgtgtggttcgcctgcttttccccaacactgatctgtggttaagagtttggtgcatggaacgttccatgggattctttattatgagctggctttggagaagcagtgggctgaaatggtggtgtctgacctgcggtgctggggccacaccctgtagggattgacccttgggtcctgcctcccggccaggaagtcctctccccttgccacttgccacccctctgcactagacctgggcctgacctttaccctccaaacttctaacaacacatcccagaaaggatctggttcaagatactaacaatcacacttggggagtgtatttcaaggaaaatagatggcatatcgtagaaattgcagacaaacctgaactcctggggagtcccttcagaaaggaagtttgctgcctggttgagacttgattgggaagggtttgccttgtatgacacccagtgcctagtgtagtgtggaatttaaggccagcaggtggtgattgatatgcacacttggtcttctctacaggccacatgtgttgaagattccctgccttactggggcctccctctcatgctctttcattctgtttaggcccagggaaaggattcctgcctgtggcgccgggcttgaggctgcagtactcaccatttttctatgatatgttgaagcaatcaactggtgttgagggatcttagaatttttaagacttgtatgaagtatccttccctttggaatcttgtttggagaatagcttaattagatgatgtcttagtccgtttaggctgctatagcaaaatacagtaaactgggtggcttataaacaatggagatttatttctcactgtttggaggctgggaagtccaagatcatgggcctgctttctgtttcatagacagcaccttcttactgtgtccccacagggtggagaaggcaaggcagctctctgggtcctcttgtataagggcaccaatcctatttatgagggctctgcccttatgacctggttacctcctagtggccacatctcctaataccatcaccgtgagggttaggatttcaacatatgaattttgaagggacacaaacgttccgtccatggcagatggtaaggctctgtcaccagaagaacatttgagtcagtcttcattcacgctgcccgagtattcttgcattacctgtgtgaactgaaccaggaagttgtcccctcacagggaatccatctctcttgcgccgttgcagctgctgcgaccaaatgctgtcatcgatgtttatcctggatgcccaccccgtccccagcgcaagattcttttcttagacccctgatgattttaatttgcattgtcttaaaacatcctgagatgattgaaacttgcctaaaatagtttacccagcaaatcacacatgtgttagcaggggctcatggcagccttttagaaatatagtagctctttagaggccagaattcttgcattcattcataaagccacatagacatctcccccgacctattgctggtgttattatggggttttatagaaatggagttttaagtatctgaaatgtactctcttcgttcttggaattttttctcacactcgagcatggtaacatcctttttcttctggggcatcaggatgatggctcccctactgtggtaccataggccccacgtggctctggggctccctgggcctctggtgcttcagtctctcccctggctgtcgtgggctcccgcttcttcttctgcagactgtgctgggcctcacgcagcatccggccctcctttttccttcagacagctcttgtttgcatttgtttatagtggttattgtaaaactatttcttaatgaggatttttttttttttttttttttgagatagagtcttgctctgttgcccaggctggagtgcagtggcacgatctcagctcactgcaagctctgcctcccgggttcatgccattctcctacctcagcctcctgagtagctaggactacaggctcctgccaccacgcccagctaatttttttttgtattttttttagtagagatggggtttcaccgtgttagccaggagaggatgttattaatgtaaacattgtgtttgcttacttttttcaatgttaattaaaatgatataatttcctcatgaatacagctttgttttacataagaattctaactgcacagaatcatatggggtggctcacgcctgtaatcccagcactttgggaggccaaggagggcagatcacaaggtcacgagattgaaaacatcctggccaatatggtgaaacctccatctctactaaaaatacaaaaattggctgggcatggtggcatgcgcctgtagtcccagctacttagcaagctgaggcaggagaattgcttgaacccaggaggcggaggttgcagtgagccgagatcgtgtcagtgccctccagcctggtgacagagagagactccatctcaaaaaaaaaaaaaaaagttgaaagtagttcttccaaaatgttccttccccaccccaccaaccctggattagtcaggggtctccagagaaatcgtgtgtgtgtgtgtgtgtgtgtgtgtgtgtgtgtgtataaacatatatgtagagaaggagagagatttgaggaactggcgtgtgcgattgtaggggctggcaagttcaaaacttttccatgaaaagttcaagatctgggtaagagttgcagtttgactctgaaggcagtgctgccggtcaagtttcttctttccagggtgtggggaggccagccttttttctcttaaagtcttcagctgattggatgaggcccactcacatgacggagggcatctactttcctcaaagtctgttgatttaaatatcagtctcatttaaagaataccttcacagaaatagctagaataatgtttgaccaaatacctaggtactactgtggcctagccaagttgatacatgaaattaaccatcacacacctcccattcatcttccttctgttcttaatattttggtgtggttcttctagatgccatctcactgtcttgcccaggctggtctcaaactcctggcctcaagtggtcttcccaccttggcctcctaaagtgctggaattatagacatgagccactgcacctggcctcatttaatttgttaatataataagtgatgttctggctgggtgccatggctcacacctgtaatcccaacactttgggaggctgaggtgggtggatcattcgaggtcaggagtttgagaccagcctggccaacatggtaaaaccctgtccctactaaaaatacaaaaattagccgggcttggtggcaggcacctgtagtcctagctactcgggagtctgaggcaggagaattgcttgaacccaggaggcagaggttgcagtgagccaagatcacaccactgcattccagcctgggcaacagagcaaaactccatctcaaaaaacaaaaaaagtgatgttcttaggtttctaaatgttatatcagccttcccaaggtggctgtcagcaggtgcctgctgcacattttgggaagttttaccttaggaagctggaggagtgtggtggggagaaggaggtgctattagtccagagcagaacccttcactggttgaggtgagaaggagggaagagtagggtggtcctgaaagagacctaattcaggagccagatacttccggaaccctgagagtgtctctcttgtatccacctagggaaggcattccttttaacctgagccctttaagtgcaggttggatatcagggttggcaaaggcagatgccatctgggaccttcctgaagagcaggttagcatattccaagctggaatatgctaaaagctttcaaaatacctattttctttaatccagaaatcctgcttctaacaatgtctcctgagaaaacgagaaacaaaatacacaaagccttagctctagggcttttcattgcaggttttactcatgagaaagaaagtgagaaacagatcatctgagtatccaagaatagggatttgttaaataatgacaattctaccccacatagaataggatagtctgtatctaccaggaattttgacacagagttacttttattgatgtgaagatattgctgatatagtcctaactaagacatatagcaaatggtcctgttttagtttgaagaaaaatgtgtgcatatgtgtgtgtctggtctataactttttttcttctctttaatttttggatctttttctgcaataaatatgaattacttgtgtaattatatgcaaaggaagatgttacattatgttcaatatgttttatttataagtcaggaaattgtagaatactagagcaatatctccatccaaagaagttaaaaatgatttttgggtgctccctggtgggatgacaagttttccggcacatttatgcgaaagcaggtgggtaggttagctgggagaatggaggtggtggtggcagcgaactcttagttcccaaagaggctgaaaacctcagtggcttttaagtagagcctgcctgcagcccactcttttctatttaaaattagattattgtgaaacatttcaccatatagatggaatgacctatttcaaagggtgcttaagctagattatattaaagaggctttaccatagtcaacagttattgagttgattatgctgtggtatggatgtcagtgttagaaaatcaatggtattctgtagaactttaaacatgtgaatatttgtgatttaatattcttctgtggggcaactaggagccttattgagataagtgggcagggctactcgagtcctcttgttgttccatgaaaaattatattcttactaaaaattggccgggtgtgttggctcacgcctgtaatcctagcactttgggagactgaggtgggtagatcacgaggtcaggagttcgagaccaccctgaccaacatgatgaaactctgtctgtactgaaaatacaaaattagccgggcgtggtggcacatgactgtaatcccagttacttgagagactgaagcaggagaatcgcttgaacccaggaggtggaggttgcaatgagctgaaatcgcaccattgcactctagcctgggcaacaagagtgaaactctgtctcaaaaaaaaaaaaaaaaaatctggtgaagattgggctgggccactgtggagttgctctcaatataaactttgtgcctctcatgcagtggtggtgtgactggcagtgccaagagtgacacttgattgcctggtcattagctcctgccctgggttgaattttagcatctcaccgtatctacgtctgtgaggcggtgagcctcacacctgagtctacgctgttttcctttgttacgaggtctcttcgtcaacttgggttgctgcaacaaagcaccatagactgggtacttattcagaatggaagtttattcctcacagttctagaagtccaagatcttttacagagtggaaatttatttctcacagttctggaggctggaagcccaggatcagggcgctagcatggtggggttctggcccgggccctcttccaggatgcagactgtagacttctctctgtgtccttacatggaggaaaaaggcacaagagagctcttgaggtcctttttataggacactaatcccattcatgaggactccaccctcgtgatctaatcaccccaccaaagccccacttcctgcgccattccactgggagctaggattttaacatttggtaatacttaattaatagatctacaaaatcaactatcagtgtatgtatccagcttggttctctctccatgactccacgctgctattcatctctacctgacgtcaccactgggttgtccagagacagtctcccacagtacactgaagtctgcgtgccatctgtccccacgcccgctctgtcccacatcctgtcgctctcatttgatggcaactgcatcctctcagctgctagggccgaaactctggggtcatcctggactctttttctattcaacctcacctccattctaacagcaaatcttcctttccagaatccaaattcgcctccccagctgctgcccccaccctggtgtgacaccatccttgcctgcctggccccacagtggtctcccatcagcccccttcctccaccccattcttctagagcctgtttcccacccagcagccagagtggatgcagatgattggcagccgatggctcaggacactccccctactcagggggtccccaggcccctgtccacggtctctgagacctcctgttgcctcctggacccgggttactcctcctcttctcactcactctgctctagccctgccggccaatgggctgctccctggatgcaccaggcacagtcctgagttggggcccttgcttgagctgtttcctctactggggcattttcccctctctgtgtccctgtggcccactgccttgcctctttcacacacggaccccaacatcacctctgccaagcccagcctgaccactctattccctagagagctgcacccgccctgcacacaccttttttaccccatcgccgtctgccgtgctctgtcgtttatttctctacgagccccatagttggtgtgtttccctccctggagaaagcacaccccaggagggctgagaccttagcagttcactgatgttttcacgtctaggccctcactcgagtcagtgctcaacacacatttgagaaggatcgagcggctggctcactctaaaccatctctgagaattgggactccaggtccctgtcattgccttgtccagccccctggagggtagtgggtgcccctcggggtccccagtgctgacccaccatgctccgactctgcccctctgacccgcttcccctcttcatttctagaccggccttattgtcgcctgctaccacggctttgtggataccgtggtggccttagcagagtgcccccacgttgacgtcaactggcaggacagcgaggggaacacagccctaatcacagctgcacaggcaggtaagagctggctttcccctttcctctcagagccgtggccagagcaccgccgccgggcagcccgggctcccgttgcgatgcagtcaggatggaaatgatcagagaccatgtcctgctaccaaggggtgccagggaagggctgattgctgtgaccacacgctatgcatttacccacttgttcagaattcagtatgggcagatcaagctccgatactgcccaaagtttttgaatatgaatctgtaccagaaagccacccttgtcaccgcttcacctgaagcctcacactccatcctgctcccgaagactgggggtggcacgaggctggcagacccaccagtggaagagacacaatcatgtgtctcagtgatagttaatcatgaaagtagacacgtgtagaaggtgactttgcacttcacctgtagagttaaagaaacgccaggaactgtttctgagagctgttagagtatccgtgtaacaagctgagatgaagtcagtgggagcatcttgtgagcgggtatccaagcatgtggccctcagcccatcagtcatcaagaagacagtgcttatgtcaatattgccaagtgcattgcgactctcctgctttggaactgtatccagacatttttttgaggacagacatgaaacctatgcttgcctcttcataatcacacttcatttggaacagtggtcttgaccaggtttatcactgacccctttcacatttctttgcctccaaagattctgtctgtttcatcggtcaagttctcagttgcaagcaaagaagctgcctgcagctgagccaggaagaacaggcgcttgtgtgttgaaggaaggaggggaagcttacacggttgtcgggttgttgagaatcccactcagggcctggaaactggaggaagtgcccccgaccacactgtatgttgattctggttgggaaatggctgttgctgtcaccaaaaggagacctccttgtcccttgttgcttcacaagctcctggaccaaagccaccctgggtggatctgatgggtggggggccagggaggctggaaaaccagtgtttgacagtttcatcccctgtggtgggagtggtctgggcaccctacttttcaatcaagacgaatagagtgggggaactcttcaaacttagaaagggccaggggctgtgctaacatgtgttcacctcctcaggtttcgaagcgtgaggcatcacttccatggagggttccaggctttgaaaacctagcaagagtgtgaaagggctttgtaaggcattcagtgattcgtttcctctcgtgggccagctgccatgtcagggaccaaggatacagaagtgcagggcagccccgtccttgagtaattctgcagctcatgggacagagaaacacacgaagcccagcaccatctgtctgccggagcttggtgctgtgggatgagaacactctatctagcctgaagttcatgataaggtcttgcaagaaggggatttgagctggggctgagagggagccgggcagttctcaggaatggcgagtcttagggacagtgtaggtgggcatggctgtaggatggcgtgtgtctaggagagatgagggaaggatggggaccagaccattaagggtctaagcccaatgcaagggaatgtatttcagtagcgtgaggctgcgtgagtggtgacaggggtgagaggatcccaggggcgtagcagagggctcagagcacagggaagggccgggagctgtgtggctagaaacacagttggcggtggtggtgatgcgggccatggaggagagctgggggtctaggatggctttgggctttgggacaggggataacaccaactgcaaagggcatataagtaaaagaagatgaatgggaggaacattggttttgagctggctatcatgactttgaaatgctctgagacctctaagtaaagaggtctccatggcaagtcaggaagagaaggagctccaaaatctggtccctgctagaaatacagatgagggacaggtgttgctggtgagagctgggacaaggattaggtcatgacaatatgagaatgtacgataagaggggatttcttttcttactgatctgccagagctctttgtgcgttagagataatagctgtgctttgatacccatgaggtgctttccagagtcttgcctgtttgcaggtgttttgattttatattcacccatgattgtttcttcagagtcaggagcacatcgtatatttttggcaagaatatggcattggccatgatatgtccttggtgtgtcctatcaggacacatactgccagtgtgtcctggtgtgggtgatgctaaatttgacgaactgcttacatttctccattttaaaggcagatatttcccctctgtaattagtaagtaatctgcaaggtgatacttagagattgtatgaatatcctgtttccccaccagtttttgccattgataatccttttctgaatcatttattttacacttattatctgatatttttctataaagaagagctttcctttagccccaccctttttttggtaccattactcattttttaaaaatctcgtgtgttctacttcaataacgcctttgttcttttcagtgctgaagttatcccaaacccagccagttggtaaccctgaagatggctccagtgtccttttgtcatatttctgtcagttttgagtattttcttgatttatggcacaccaaagtgttccacattctccctggactttcccagtccctgtctgtaaccagctgtatcttcaaggaatgatagttctttttttagtgaggaatggtatttagaaaccaaaatctggactctagctgtgctcattcacactaaatgttattgcttctaggcatttcagtgagcagagttagaaaaaaaaatatttaaaaaataaggatacctccaatccaaatgcaacaccatagtattcctcctcttcaccctttccatatgcttcccccattctttgtcggcaagaaacctggtttgcagcaatcacaatgcatttacccattttcctgtcctacgacaaatgtgcacaaagtggtgatactaaaggataattttcaaaagcttaaaaatttgactcttaggtggacagaaagtgaaaactcattaattagtgatgggctagtaattagttaaggccagttcaaaggaaatttgaagaacaggcacatagaggcaatcacaaatgctgaaatacatctgctaatagatgcaaaactggttaatatcctataaggcaatagaatataatgttgtgggttatcttttctataaggtgatgttatggactgaatgtttatgtcctccccctcaaattcatatgttaaaaccccaactcccaatgtgatgcattagaaggtggggatttggggaagtaattaagtttagatgagatcatgagagtagggccaccatgatgggattagtgtccttataagaagaggaagagaccagagctcgctccttccccaccatgtaaggacacagtgagaagacagctgcctgcaaacaggaggaggagcctccagaactgtgagaaataaatgtctattgtttaagccacctagtctatggtattttgtcatagcagcctgagctataacaggaagtaaattatatctctaccagatacaatgcaattgccttgctgtggacaatcagttttacagcttaacttctaaccttgtagagttgtggagcagcctaggaactgaatactgccagagggtcccctggacagcacccagaaccccacatccagcaccagcacttccctggagggaaaagagacccagtcacctcattagctcagtttccagctatgaacagtttttttttaaccaaagaatcagaaattagaataccaccactgctaccagcatcagacctaagtaaaagcccatatttctttgtggttgttttcttccaacatattctaccaaaagttattggtcttatagcaccatattcaaaaacgcggttaaatttttttaactttatgcagtctctccagatttcaaattgcttccctttccacaaatgcttatgtttttcactgagtcagtgacctattgaatttttctaagaatatggattgttaaaatttgaaaaatgttcttttgcttcttgcaataaaccaatttcattttttaaattgtttcctaggcactagacaaccggggagcaatcgatctatttcagatgaagatgctgccctgaaacctgtagcccagccccttctttttgaatctcactgtctttacagtgatccagggttgttttttgtttttgctttattttattttatttttttttttttctggcttgctcattcttctgcagggactgtgctcatccttctctggtttattttaagtcaaggatgacacaggtcctcttggagattggagggctctctggcaaaggaagaaggaaagggctccagctgatttccatccaggctcagtgcccagcagcctggggcgtggtgggaagaactcgggtccaggtgcaggccccgcagccactcccctcctgggctgtgtagttttacttccaagttgagtgtggcatgggagcctgtaacaaccaaggagcagcccccaccctttgcctggtgggacctcagggggaaggtggcctcgggagcttagtgccctccctggcctcatgtgcctggagtgttgaaaaatggcatcagtgggtctcaaagcgtccccatagaccacctctccttttctgcccttctatctgtggggcattgccggaattttgcagggttcactgaattaggtgtaataccccatcctcctcatcaacagaggcctgtccctgccatcttccttaaggaacagaaattgggtggtgtccctcgatggttctagtcacactcctggcttctctctgttgcctttggtcacagatggtgtcttcatctgcttaggctgtgataaaggaaataagcagctctctggggcctcttttgtgagggcactaatcccaccacgaggacccctccgtcaggacctaatcacctccgaaagccacctgctgtagtgtcatcctggaggcaggattttcgcacaggaatttcggaggacagaaacattcagactgtggcaggtgggaagctggataggagggaagattcctgtgttctcagctctcttgggagctggcccacccaggggtagccgtgctgccagacagagctggagtccaagtcaggtagcaggatcgggtggccggggtatgtaccagggtctgggctatcctgagggcagcatcacagctggaaacctgcctgggtggacaggaggaggcgggcagaggcctcagccattatcctgcttcctccacttggcctggctgatgttcttggaggctgattttaaaatacaatacacagtgtttggggggaaaatgaccccacatgagcaaggaaattagaggtgaatacctcttccacctcactgtcagccctctcttcagtctgctctctggagataactgttgttaatgatttgatgcctagatgggtttactctgccttttcaatttaaataaaatcattattataatgtattttttctttacttcttgttttctttcgttctttctttcttttctttttttttttttttttgagtctgagtcttgctctatcgcccaggctggggtgcagtggcacaatctcagctctctacaacctctgcttcccaggttcaagcgattctcttgcctcagcctcccgagtagctgagattataggcgccagtcaccgtgcccagctacttcttgtattttcagcagaggcggggtttcaccatgtaggccagactggttttgaactcctgacctcaagtgatccgcccaccttggcctcccaaagtgctggaattacaggcgtgagccgccgggcctggccttttttttcttttttactggcttttgttatcttcccctacttactgatttgcttgagctctctgtggccgccactgtgtgcacccaccctctggcctgggctctgatccctggacacccaacctaggctgctgcctgaggctttgggactgaattgttgaggttgcatacggaggcagaggggagagggactttacaccatttaaacaaacacagattaaaaagcttccttgtgtgtgtcttaattgcctcaatgtgccgaagagattttccctaatttctttctgaacctccaggggctgcccctgtccccatgggcatagtttccttagacactggctcccaatcttgcgcctccggcgtcagcatcacctgggctggctcatgtgagcattaacacagatctggtggaaacacagactgccaggccctgcccctggagtctttctttgaataggcctggggtggggcccaagaatgagcagatcaacaggtttcctggtgaggctgatgccactggcccagggaccccacattgaggatggagagctttgaagattttatgcctgatgacggcaaaggacccctctcagtgggcactgaagaccagcagagtcacagaccccacgagagatgttgtcagacagacacagaggcatcacggaattaaagtgaaaatgaggaaggcaggtgagcatgtgttcatgactttcctgtgctgttttgccaaagaggctgtttaggcccaatcaggtgatgtcccattttaatcaatttcataaccagttttatttctttgatgatttgttaatttcaaaagctgtccatgcatatttgcttacagccaaaaatgactacaaaagtattatcagggaggaagaaaaagatcccttctctgtcttccaaatattccagctcccttatcagcactcaggagtcacctcttcagacctcattcagtcctttccaaacacacacgtatgtatgtgcgctttgtattcacatgactgggctagtgctgttgagactgtgtttttagtggttttgttcacatggttattaatctagaagctcctgctgtgtcggtgtccctgagccctgccaggcgctcgtagccctgccttcctgcacggggatgtgtggctcatgcccggttccccaccaagacttcaaatttgagaggctgcgttatgactggccttcactcactgtggtggacccggctcttaggccagtccttgaacatgaagtacttgcttcttaaatatttgttggaaaagaggatattgtgtaaaatgcatgaaccgtggtatacttaactgtcccagttactggacaggtgggcttttgagttaatcaacggcagcaaggctgtagtgaagtctttggatctggggtgcatctctgaggacagcgtgttaggatcctggcagcttgaagcatgttgagtgacaggtggtctcagagggctgaacagaggagttgatgagggcctgtcaattacggggggaagggtagagttaagggaaccaacattgaaaggattaaggggagggactctgcagagagtgacccaggccaagaagctggaacccgagaggcagcctcggcctagaacccgagtgacacaggccaagaagctggaacccgagaggcagcctcggcctagaaccgcagccaggggccggagtgggaggcagggccagatgtcccgctccttccaccctggtcccctgctgagccaacccagaaacctcattggggcggaaactgggcaggtgctgttggtgcaggtcagcttcctaggccgaaagcagggcaaggaagaggagaagcaatgtgcagacacactcttagaacagaattgcttcagcaagggctgtgcctgttttaagtgtatgcagctgccaagtggtctttagaaagctgtggcgatttctcctttcccctgagtgtccaagagtgttcttgcaagccctggctgagatcagtcttttcagtatttccctactcaaatgaaccaaaactctggttttcagttgtatttccccagctctcttttgagcctagtacctgttaggatgcttttggcttcaaccacaaggacactgccttctcttgcaacacaagacatctgcgggcgatgttgcagggttgcttcactgagtagctgggtgatgctgggacctagagccacttctcagaaatacattcgccttttccttcatggtcccaaggtggccccagctgctagaagtgccacggcttcacgttgcaacactcagggacatcaaggaagaggagcaaatccctgtcggcgtttccctttataagacaggaaaacatttccagaaggctccagcagagtatcgttgccatctcaccaaccagggttgcgtcacaagcccgtgccaaaccagtgatggaggatggcttgtgtagacagcagtcgcactaagcagaatcagcattgtgaagcgcaatcttaaagcaaccatatgtttatattatttgctatggcaactgggttggttgtctgagagttggaagctctgggtttctggaggacacagcatttatgagtacgaattcggatgcaaatgccttcatctgccttttgagtgttctctaaaaagtctaatttcctcggctatttaatgcacaataaaaatacagccaaatctgtactaggtctgtaaatggagagaacgtttgaaaataaatccccatgtaatccctaagtctcatttagccagtcatttcaactttcaccaccgctccactaacaaaaataaaataagataaccaaagaaaggaacaagaagtcccatggatagagttgtgtgtttatttctgtttccttgttgtgctttaacagaatagcatggacgtggtaaagtgaggaaacgccaggggtctctttgagctggtgatgggatacagcacgtgaagcttgttttgggtataaggaacctctgatgtgtgcttgcaacttgttatttcttgcatttaattgtaaaattctgaggctacgtgctgagagccagcctggcaggatgctgcccggggacggggacagaacgggagggattctcaggggcagctgtgggtttgggctgcgggggagccctggttcctgagctgaatcggggagagtcccagttcagaggagaatttatgacttggtcagaacccaggaacaatgcctcttcatgttatttatcttattttattagcagtgcacacgatcacgatcttagtgtgatctcattgtgatgttcatgttgttttgaagtgcttccttttttctcagtttataccgtttcaaataagagagtagaacttggtgagtctcggtttcccagcgttgccttatcttttcctgtgagcttttctgagctcttctgattggccatggcagcgccacacccctgcccgctggccagccaggagggctcctcagccagcttggggcttgcctggctcctccttcagacccctgcctgccctgcaaagagcagggatgctgccctcccctactaaccctgcccctccatctgcatggtaaatgccttatgctaagaattcctggagtctgttcatgccgcgtggctggtatgatgtcatatttccaaagccgacagctccctctactggcctggtctggagaactgcagtttgagtgccttgagtcagtcaatcttagacaacccaattctgtaacattttccaatttttagagcagtttgtgtttattgcctgttttttttagatggagttttgctcttgttgcccaggctggagtgcaatgatgtgatcttggctcactgcaatctccgcctcccgggttcaagtgattctcctgcctcagcctcctgagtagctgggattacaggtgcctgccactacgcccagccaattttttgtatttttagtagagacggggtttcaccatgttggccaggctggtatcgaactcctgatctcaggtcatccacccacttcggcctcccaaagtgctgggattacaggcgtgaaccattgcgctcggccagcccagctaatttttattttttgagatgggatcttgccatgttgcccaggcttgtatctaactcctaagctcaagtgatcctctagcctcagcctccctggcctcttcgggccttggcctctctgctgggattacaggcacgagccaccttgcccaccctgatactttcaataaataaacttttcccaaaggagtggtaggaatgtttcagccttttcatctaatgcatatttattgagcaccccagagcatgcagtcagttggaagttttaagcatgtgagctgggtaacgagggctgtggcggctgtgggaacccatatatgcatgggaacgtggacgatgagacaccgtgggtcaaggggcaccagggaagacctggagttggaagggatggctcatcaggtcaccaagtaaaaagaggaggcagaatattccaggtagagggactccttgtgcagaggccactagattagaggaagtgtggctcatgagtgaattacacggaatgctggctgtttgaccataaagtggattgggagggcattggcggtgagagctgagggtgaagaggtaaaaaccagctcattgaagagttgagacctcatctaaagagcagagcccatggagagtttcggatgagtagtggggatggtcagaggcccctgttggtgtcaccgtgctgctggtgtggagaatgaatgggggcagaagtgggacaaaggaggctagtcaggacaggagctgtggccccatggggacgtggtagcccaggtcagggatggagaaacaaagacagttttaggaaatttaaacttttttttgtagagatgaggtcttgccatgctgcctatgctggtctcaaattcccgtgctcaagtgatgtcagaggtgcagttggcagaatgtggtgattgcttgggtgagggaggatgtggagggcttgagactgagtccagccgtctggcttgggtgatggggtgactggtggtgttcatcactgaataagggatgtgggagaggagtagcttcggaggaaagatgttttgggtttgatgcattgagtttgtaggatacccatgatgaaatactcagtagacagatactcaggtaaaaaactgaagaaaagagatagaactggaaagagttgatgtggaagctttagagctgaaacttggatccacaggagtgtataggatcaccaaaggagagtgtatgagataaggagggggcttagcaggcagctgaggaacagcagcatttcaggaaggagagaacaggagctcagaatgttgagagggcggaaaatcagaagggtgagcatctgcatgtccatggaaagagcgtgtttcagaaaggatgaaagagaggagtgagtgggaaatgctggggagatgttgaatgtgatgagaactgacaaatcaccactgagtctcattgtaagaaggtcactggggactgctgggggtggtttcagcaaagtcagagagtgtcattagcaacagtgagagtagatggatctggaattggactgaagcggagttgaatggttgatggagggtggcgggaacatgaagacggcccacaggggttgctgtgagtcacatatgcttttaagatgagagacccttgagcatgcatgtcagctagttattgctgtgtaacaaacaactcccatgctctgggatgtttttattgcttatgcatctgtggatgggctggggatctgttgatctaaactgtccttgctcaagtctgtgggcaagtcggggacctgttcttgggcacttcggctggggcagctctgctgcatgcattactcatcctcttcctgggagcagcgagccagcctgggcatgctcttcttggggagacagctgaggcacaaacatgcatgaaagtctggataagtacatttcaaccttctgcttccatcacgcctgcaaacatcccatcggccaaggttccactagacagagaactgggaagtcacttaacaaagggcagtgtgaagaagatgggccattagtgcattgtaggaactaagggccttctgaaggttcactaaaatcaacttgcaaaaggcaggtgaataagagaagaggcatacaaaagaggccatgttcccataacatgcgtacatgggagccttcggaatgaaaacccaaaaatgcaggaggaattttccatttttctgcttaggttcaacaaagtgtggacagttatgtagaaatatagttggacaggccaggcacggtggctcatgcctagaatcccagcactttgggaggctgaggcaggagaatggcttgaacccaggaggctgaggttgcagtgagccaaggtcgcgccactgcactccagcctaggtgacagagtgagactgtgtcaaaaaaaaaaaaaaaagaagaagaaatataatgctaataaatagactgagtggggaaaccccacaggcctgcctgtctcctcgattcttctaggtttctctgagcagcacttcttccttctgggagtgactctccctggaacaggggtcttatgacctacagtcggacatggcaagtcagataatttctttatgttagggcagtatttttaggttttagggaacctttaggctggccttagggaaaaggggttctggtttcaaagatctgccttggggaagagggattccagtttggatggctggcctcagggaagaagggactgagacatgggagggcaggagggcagagagaaacctttgcttctgaggccttcactgtggggtattgctttctgagccccaacagcattctgagggaagtgggtctgcaaggaatgagaggttgatgagaaacaggagggatctgataaatattccacagcagtgggcagggagtggctgtcaagcacaggaggggaggagcagggataagcctccttcagcaagaggagaatcccctgcgttttcaataggaaaagtgaactgaggattgacgaggttcataaacttggaaagaagagctttcttctcataaagggttgcagcctgcagggtggctattgtggcagggaagcagcgcctctggccagaagccagaaacagacccttccaggggcagaagaacaagacagaagaacaatgcatgctgaaggaggtggctcaatacacatattccataagctatgggagaagcattgaatatcgatgagaggagaaacacgcaagtgtgcaatcgagctccgtgcctctccctgggacctgtgttcaaaaagcaacagcgttagcatgatctgagggtggagttttcaggccctgacctcaaaaggtgaagcagaggacatgaaaaccctcactgcgcgtcctctgtggacctgccggacgcactccaaagccatggccagtgtctctcatgaggacggaatgctggtcggttgtttcatccaaattgcagaacggcggggcagcatcaggcggttggtttatatcagtggaggagtctttagaacgggctggtttctgtttagacttaggaaagaaagcctcacggttagcaaggaatgggtataacgaggcgcattgcccttccatcctgtcatagccaggactcagttttcaagggttctctggggtccccttgggcaggagggggtcggttcagtccgttggatggctcaggatttcacttttccttctcggaggcccgtgaatgtgggcagcgtggggggcgatgggggaaagccgagggacttcccttctggtggtttctgttccctctatgaacttgaagatgagtcatccaggagaggggtttgcgtgaggtcggtgacttccatgtgaaaaatttaacattttccccatggggcctggggaagagtcaaccgggaagcacaggagcactgctggggcaggctgagaagccggtcgggcccgggtggcgtgggtgtccacctctttgtgtcccccaacgaaggcaccttcgcatccatgcagagcggaaccaggggtgtggcggggccaggcgtcatttccagctttcctcttttgcataccacagacctgtccatccactcatttaggagctctctgaatcaagcactcctctccctcctcctgcccggggttgggggctgggctccatctctgcctcctgaatgctcccgtggcttcctggtgagctccccaccactgggagagcctcaggtccagggtggagaggccccacaccaggccgcacagccagctgtgaatcatggtcctgaccttgcactctttttgaacggctctatgctagtttccccttttttatttttatttttatttatgtatttattttgagacagtgtcttgctctgttgcccaggctggagtacagtggcatgatctctgctcactgcaacctcctcctcctggtttcaagtgattctcctgcctcagcctcccgagtagctgggattacaggcacccgccaccactcccagctaatttttctatttttagtagagatggggtttccccatgttggccaggctggtcttgaactcctgacctcaggtgatccacccccctcagcctcccaaagtgctaggattacaggcgtgagccaccatgcccagccagttctcctctttttttttttttttttctttttgagatggggtcttgctctgtcaccaggctggagtgcagtgatgcaatcttggctcaccgcaacctccacctcctgggttcaagcaattctcctgcctcagcctccggagtaactgggactacaggtgcacgccaccacgcccagctaatttttatatttttagtagagatggggtttcaccatgttggccaggacggtgtgatctcttggccacgtgatccacccgcctcggcctcccagagtgctgggattacaggcgtgcgccactgcgccaagcctatctcctctttttttaaaataaacttttgatttgagaatagtttatgtttacagagaaaccacaaacactgtacagagaatgcctgtgtgcctcacactggttccctctgttgttaagatctgacgtccgtgacgcgctgaacacaatgaatggacgcgtgtcaattcaccattattaactgaagtccgttctttattcggatttcctcagcgtttcccggatttcctttttctgttgcaggatcgcatgtggcatttagcactcatggctcctcaggctcctcttggctgtgagcttctcagacttctcttgtttttcatgacctcgacagttttgaggaggactggtcaggtacattgcagaatgttccttaatttggacgtgcctgatgcttttcttgtgatgagactggagttatgagtttttggaggaagacgcccgataaagggctgatgggccttggtcacctggctgaggtcatgttagcagatttctccactgtgaggttctctccctcctcccccgtttccgtgtaatagtctttcacaggaagtcagtgcacgcagcccgcgggttaaggaggggggaacacgttctagccccttgagagtggagtgcctgcctggattattcagaatttttcttccagatttttctattctgctgggcaccttttacacacagattgtctcctataattttcacaaatgggaggttgatattatccctcattttacagatatggaaaagctgacttccaaaagacacccggattctgagtggcaggcctgggccttgaacctggctgttctcagagccagctctcttcagtactgagctcattgtctacactatgttccagtgacgcgatttcattcaaattcacttcctccctgggtcacttgtgaccctctcttaagcagggtagggcttattggtggagagggggtgttctggggttctctaggtgaacctaccctttaaaagggcttctctgaggatttcaggaaccaagtccgattccataatgtccaagttggactgggctcaaactagatttttttcttttttttttttgagacagggtctcactctgtcgtccaggctggagttcagtggtgtgatcttagctcactgcaacctccacctcctgggttcaagcaatgctcctgcctcaacctcctgagtagctgagaatataggcatgcaccagcacacccagctaatttttgtatttttagtagagacaggcactatgttgcccaggccggtcttgaactcctggcctcaagtgatctgcctgccttggcctcccaaagtgctgggattacaggagtgagccactgcacctggcctcaaactagatttcaatatggcgtgtgtttgggttcccttgtgcaaggaaggctgtgtgtctcatatatgtaaagaaaaggaaagctccttttggttactcatcatggtttttaaagaagaaaggttaatacttatacattcttagaagtattgggtccacctttgatttccattgaatggggtcatctgtgtgatgagaggtattattctgccatcctgggaaaacccgtgggaagcagggcgtgatttcttggatcatcgaaagctcaggcctgtagtcagaacaagttgactgcatgttggtttttctggactcaacataatacgcagaacagatctatataatgggtggtttgctctgtggactttgagtttttcctctttccacctgttcaaagtgctgaggatatatcagtgcaaaggaacatcctgcagaagattgtgacggacacgctatttcacagtttaaagaaatggctccaaaggaattgcaattcattttactatgcccctggttaaatctaactgacaggtgccgccaagcatttaactggaccataaaccaaactgagatcaaaggattcccccaccttcccataccacccagttgagagtaattcagcagctctgggtacctgacagctggccttagcccctccccgcacatagtaaaggacgagggagagcaatgtggtgtaaatgagtcaaaaaagcaccagcgactggctgtgagtcacgcagcgaggggatcgtaccctttgtttcctgcttataacctgaacactgttagactcatcagggcttccttttcaaaaagatacatggttccccttttcacatttgtggagagctcaggagatgggctgaggtcaatggcgagcttgctcctcaggagagttcacccctgattttggttgcctgttccttcttcttttggattgatgaagagcaaacccacaggatttcatactggtgaggcagcagcctggagtggccctcaaaggaggaaactgggttccaaccccggcagtactatccctcagggtgtggctggggagacagaagccacttgatatatcggagggtttcatattggatttgctgaactgaaggggctaggggagcagaggccaagggcgcccagccctgcctactggagatctcagccgcagcggggaatcctggaggctgctgcagcgtcatgctcacgtagtattctgtctgcagaggtgggctgggctggggaggcacctcaggtctcatgcctgcccgaccccagagtgatgtccttgccacctctctcccatcccaaatctcaggcagtgccacccattggaagtttctgtgcaaaccagatgcctgtggagattctgggcccagggcccggcttctccatgattcaggtgttcctggggggagggaggtgatgccaagttaaggagagagtgcatagaaatgtccacgaggcccctgcagctgcgacagtgggggctgaaaggaacatgcttgagttggaatgaataagtggggatttctgagcactgcgtcatcggtgcataagaatggggactgtggccagacacagtggctcacacctggaatcccagcactttgggaggctgaggcaggagaactgcttgaatgcaggagtttgagaccagcctcggcaacgttgggagatcccatctctacaaaaaaaaattttttttaattagctgggcatgatgatgctcgcctgtgagcccagctacttgggaggctgaggagggaggatctcttgagcccaggaggtccacactacagtgagctatgatcgtgctcctgcactccagtgtgagtgacaaagagagactccatctcttaaataaacaaaaaggatgggaactgggtacccagcacctcccctggggttcaggaggagagactcgggcagattgctcatattcccaagagtttcagacctcatcagcaggggcctggatggaggtggcagctcaggggagggtgcagcagagggagagaggaaggaagctctttccaccaggtgtggttggtcacgaaggagtgaagtctgagcttcggggacagtggttctcacctggggtgttcttgccccaccgatggcggtttggtggtgtctggacacagttttggttgtcacaacctatgcgggagtgggggtggttgctactggcatctatcgggtagagaccagggatctgcctagtgtcctgcagtgcacagggcagtccccacaaccaagagtcatgcggccccctgtgccgactgtgccaaggctgggacggaccctgctccaggacactgaagtgggggagggggagatgtattcacacaaggacttatgagctagccggcatcaggtggcatggacagttgacccaagaggatgctctcccactccattttggttttccatgggagaatcctggaaacagcactgttgctgtgacattctccttattcaccattaactgagagcaccatgggcgtgcctgggaatgagcagaaagttagatcctttttggaggtgcaaggtgagaaaggggagaaatctgtgttctctgagacatctccttacctgctttgctttatagctgagggccttgcctgcgacactctgtgggatgtgtgtgggcgtaggtagttagacacacacacacacacacacacacacacacacacacacggcggcggggggaggggtggtggtgggtaagggtggagagagagactcctgcttctgggtgggaacagggtgccagcgtgaattggcactgtcctattgctatgatgatgactttttcctccctgcagctctggagcacttggaagcggttctgaagctcatttgcagctttgcatctgtttgcacgggcgtctcctgctgggagttgaggcttcctgccctcattggctgtctgaggctgcgctccctacctgcccgcagcgtccctgccccccacatccacccccagtagtgtaatgggacagctcctccctcgagtgctttgccgaaggggacctgcaagaacccaaaacagcagcgctgcagccagggcggtgccttctcctttcctctgtttcctgggctccaggagaattctgtcttggggtccgagaaaaactcacacagcagaccggctggcccagggctgactcagtgtttctttctctctctaggaaggcctggctggaaccagcacattttgtggaagtgggaaccaatacacgtgtacacttctctttacagggcacgctatcatcactaactacttgttgaactatttccctggtcttgaccttgaaaggaggaacgcgttcgggttcaccgccctgatgaaagccgccatgcagggtcgaacggactgcatccgagccctgatgctagcaggtatgtccacctgtcctgtgcagcttccaggggccctgggacaccagagttgctcctttatggaatatgttttgagattaatcactcccatagaaacaatgcctagttgctgcaataaataatagtttcttcactgacatatacttctgtaactatctgaggttttaaaaaagccacagcattggttcccttcaggacacccctttctgctccctgctgagctttgcagtgggtggcaccttccctcacctgctgttttcctcctgcccacccgttctacaccccaagtcctgtccatatctgttcctcctcagaaaggggtgatcccttggctgtaaatggcaagactgtgctgttgaaggtgggcgtagggatggtgggaacggcccaggccatcctaggtcactgcttgctggtgggtggcattgcatagtaacgttaggaggtgatgtggagttgcatgttaatgttgggatgtgatgtggagttgcatggtaacgttgggaggtgacgtggagttgcatggtgacgttaggaggtgacgtgttgcatggtaacgttagaaggcgatgtggagttgcttgttaacgttaggaggcgacatgttgcacggtagcattaggaagtaacatggagttgcagggtaatgttaggaggtgatccggagttacatggtaacattaagaggcaatgtggagttgcatggtaatgttagcgggtgacgtggagttgtgtggtaatgttagcgggtgacgcggagttgcgcggcgatattagcgggtgacgcggagttgcacggcgatgttagcgggtgacgcggagttgcgcggcgatgttaggcggtgacgcggagttgcgcggcgatgttagcgggtgacgcggagttgcgcggcgatgttagcgggtgacgcggagttgcgcggcgatgttaggcggtgacgcggagttgcgcggcgatgttagcgggtgacgcggagttgcgcggcgatgttagcgggtgacgcggcgttgcgcggcgatgttaggcggtgacgtggagttgcgcggcgatgttagcgggtgacgtggggttgcgcggcgatgttaggcggtgacgtggagttgcgcggcgatgttagcgggtgacgcggagttgcgcggcgatgttagcgggtgacgtggggttgcgcggcgatgttaggcggtgacgcggagttgcgcggcgatgttagcgggtgacgcggagttgcgcggcgatgttagcgggtgacgcggggttgcgcggcgatgttaggcggtgacgcggagttgcgcggcgatgttagcgggtgacgcggagttgcgcggcgatgttagcgggtgacgcggcgttgcgcggcgatgttaggcggtgacgtggagttgcgcggcgatgttaggcggtgacgtggagttgcgcggcgatgttagcgggtgacgcggagttgcgcggcgatgttagcgggtgacgcggagttgcgcggcgatgttagcgggtgacgtggggttgcgcggcgatgttaggcggtgacgcggagttgcgcggcgatgttagcgggtgacgcggagttgcgcggcgatgttagcgggtgacgtggggttgcgcggcgatgttaggcggtgacgcggagttgcgcggcgatgttagcgggtgacgcggagttgcgcggcgatgttagcgggtgacgcggcgttgcgcggcgatgttaggcggtgacgtggagttgtgcggcgatgttagcgggtgacgtggggttgcgcggcgatgttaggcggtgacgtggagttgcgcggtgatgttagcgggtgacgcggagttgcgcggcgatgttagcgggtgacgtggagttgcgcggcgatgttagcgggtgacgtggagttgcacggtgatgttaggcggtgacgtggagttgcgtggtaatgttagcgggtgacgtggagttgcgcggtgatgttagcgggtgacgtggagttgtgtggtgatgttagcgggtgatgtggagttgcgtggtaatgttaggaggcaacgtggtattgcatggtgatgtgtgtggcaatttccgttttctatgctgtgtcatagagtggaaaattctcaggctatcaacctggatcaacccctctttgtcttttgcgccatcttggagaacgcactttcctgttcccatctgtgaaatgggagtaatgacctctttctccctcacctccctgaggctaaaatgcaacaatactttatacactcctagaggctatccagcttcaatgagctactaagctaaatgccacacaactaatagctttaactcttttcttcactctgaaatagaatcaatgatcatccttcgtgcaacctcatcgggttattttgagaattaaatgagaaaatatgtgtcaagcacatgtcgtgttagattcagttagcagctgacatctcagtgaatgtgcgatgctgctttcaccattacttaattctgttattttaatttctctttatttttgttcttggcactgggttcagccagtcctgcttggcgctgcaagttcctgaagaagtggatttcctctctgtcttagttgttctgctgctataacaaaatacctcacctgtgtaatttgtaactgtagaaatttattgctcacacttggggaggctgagaagtccaagatcaaggtgccggcaggttcgatgtctgctgatgccccttccttcttactgtctcctctcatggcagaggggacaccgaggtaccctcaaaccctctttcataaggcactagtttgattcaggagggcacagccctcatgatctaatcaccccctaaaggcctcacctcttaatactattccagtgggtctgaagttccagcataggaattttggagggtcgtcaacattcagaccacagcaccacccctgtcttggttatcctgagggtggcatcagagttttcccaggcatcagtgcttccattaatgtcacttttctgttccaggacccctgctgggctcccacatttagttgtcttcttcttagttgtccccagtcttcttcttcttcttctttttttttttttttttttttttgagacagtctcactctgtcgcccaggctggagtgcggtggtgcaatctcggctcactgcaacctccacctcccgggttcaagcgattctcctgcctcagcctcccgagtagctgggattacaggcacctgccaccacgcacagctaatttttgtatttttagtagagacggtgtttcaccatgttggccaggttggtcttgaactcctgacatcccgtgatctgcccgccttagcctcccaaagttctgggattataggtgtgagccaccgcgccctgcccctcatcttcttgggtctgtgaagtttctgtcataacctgttgcccatgacgggacagtcttgattccaaccagtgtgcagcaccgcccagtctgagcccgtctgttgtttttctcgagatcaatctggagttacaggattcacaattgcttcagatttatctttctttttgctttaaccttaggggattctttagtcttaggagatgctataataaaaataagttcagtgaatgagaatagaggcttcaaagatgaaaactttcttggaaataaaaaaaaaaacataattaaaaacgagtcctatcgattgtacttttgattcagagatgatagttttattttaaaaaaacgagatatcagtttcaacagagtttcggccctgcctgccctcatcaatgagaaatggttcctactaattaaatggtaattatgtgatgcttttgtgtttggcgggagcttcagacacttttactatttctggatctagttataattgggcgtagatgtttggtaattgactttttcaactgaacatttatgatgtcagtcacatcactgcactttcccattgaattaatttgaactgcaaaccttttttaggtcagttgccctctaatcgctccgtttgactgccgtgctttcttccctgggtctcctgggggtttcaggcatgtgtgacagcatttagaggattccagaaacaccttgcacatctcttggaacgatgagtctgcgggcagtgggtttactgctgacattgctcttcccccatcagttatttggatacaaatttgacattagatttgagactctccctcccctattctccactttgcaagcccatcccccatcacagtctagaacaatccacggattattgtctgtgggatcctctagtgagtctctccctgtcctatacgaggtacagagcaggagctgaacagaaacagtccaggaaccaggacccagtttcaaattcatcttctccacttcccatctctacacctgcagcctgtcactcacctctctgggccccagtttcctcttctataaaatgaggctaatgatagcacccaccgcaggaaggtgggatgcggattgggcacgttcacaacagaacagccctcgggtgcatgctgggcttggagaagccttcggacatgttggttgtgattattgttattattatgattattggtgagtttatgtgttcaatagttatctgttaagtgaatgaaaaaatacggtttgtttttccctttgagaaatatcttgtaaatgagatacttaaactttcttaatgagggtagtaagcccctacctcagggtttttgttttttgcttttttgttctgtttttgtttgtttgttttgctttgttttgttttgttttgagacggagtctcactctgtcgcccagagtggagtgcagtggcgcgatctcggttcactgcaatctctgcctcctgggttcaagcaattctcttgcttcagcctcctgagtagctaggactacaggcatgcaccaccacatccagctaatgtttgtatttttaggagagacagggtttctccatattggccaggctggtctcaaactcctgaccttgtgatctgcatgcctcgtcctcccaaagtgctgggattacaggtgtgagccaccgcacctggccaggggtttcttaatttcagcactactaacatgcagagccagataattctttgttgtgggggctgtctttcaaattgtaggatttttagtggcatccctggcctctacccacaagatgactgtagcacctcttcagttgtgacaaccaaaaatgtctctagatgttgctcaaagtctcccaggttgggggaaaaattgcttcccatcgagaaccactgatataaataatttaaatgggaaaggatatacaaagtgagaagagacattttcccctctgtgtactcttcctcgcttgttctgtattcctccctcaaataaaagtgtgacatcttggccgggcatggtggcccacgtctgtaatctcagcactgtgggaggctgaggcgggtggatcacctgaggacaggagttcgagaccagcctggccaacatggtgaaatcccgcctctactgaaaatacaaaaaaaatttagccgggcatggtagcacaagcctgtaatcccagccactcgggaggctgaggcaagagaatcgcttgaacctaggaggcggaggttgcagtgagccgatatcatgccactgtattccagcctaggcaacagagtgagactctgtctcaaaaaaaaaaaaaaaaaaaaaagagaagtgacatcttgtttagggaacttttgagctgccctcttaagctttggttgtagtgtagaacttacggaatattttcatcttctactattactactaagcttacagttctcccaagaaaagtgggttttattttcctttgacagtagatgggtaagaattaaaaaaaaaaaaaaaagtgttgaattgcttccccaggattagtggagagcaataaggacagatgttgatatatttctaaaattcacacaaatattttaagtcttattctttccatttaaatacgtgatattaagaaaaaaataaaccatttaaagaaactaatagccagagcctttcttttagattgacacttcagattgtaataaaaagtataaccgggttctgagaggctgatcgattgcatctttggtttggcttcgtaaggagtaatgcaggctctgctgaagagcatcacaagggagttgcagaaccttgttaattcactgaaatattaatgcccacagtgacaggtctatttaaataggtggctctgagaagcgtatcgaggatgtgatttttttctgaagagaggcagaatctgtggaggttgccaggttccaggcttgcttaagggagctcactttcagacctgaagtgtggtgtaactgccgcagccttcaggaagcaaaaacaagcagcaataacctcaaatcttcctgtgattccaaggcgcaaagtggatttaaaggacggcgaggaacagagatcagagatgctcccgctgtgggtcagagggttgctcttgtctcagggaagccctgatatctctttctggaaagtcagatgatttccaaccatatagaggtttctttctgtttataaggaaaacttaaatttcctatgaagtgtgaatttgccatgtagaattgtttgaagtcattagccagagaaaggatgaaaagtcaagcattctgtgtcacctgcaaagcaaacctcgagacaaggacttgggggcaagtagttttgagggatggtggccccaggaagtggagtgagggggcagcaagtgagattgggaagaatggaagctaagaaatgtccaccaatgagcaggttcctcttgtgggcagctgggactcagaccccctggaccctccactatgaggaaaagatatcgcagagatgctgggaagtttatttcccaactccagtgcctctttgaggggagatgagaactttgagcacacttcccacctgctatgtggtgggggtggcttgtcctccctgctgggctggagcacaagctctttcttggaccctgcatccagatttgtcatcccgattatacccacaatgcccaagatacaggctggaggtggcacaaggggaggcagtgagggctggtccacagtggtctcctgtggccaggaaaggccccctggcaagagggagacctgagctagggtttgtagagtggataacatgggggtgggtgggggctggtggagaagcaggaaaggaagtgacacattcagggcttcacgctccacccacctcctgctagtcctgggcctggccatggctcccagagaaagccttcttgagaatgagtgatggaaagtatagatttttttttcccattagcacctgtttggaatgtttttggctgcaagtaacagaaatcctgactagacagtggcttaaagaaaacaggccgcatttctcagctccctggaagtctgaggttggcagtcaccctccagagctggccctggattccatgaggacaacagtggtttcctcctgtccatttggctccccttagcctgttgatctgtcaccccttgattccacgagaatcacccaatatgtgtttcagacaggaagctgcagcagcaccaaccatgctggtccctttcgtcaggaggcagaaccctctttagggctcagtcaccagtgctgggttgcttggctacttttagctgtaagggaggctggaagaatggggaacaggattgcagccgttagattccaatagtgattctcagctggaggtaatgttgccccaggggacatttggccacgtctgtagacatttttggttgtcagaactggcggactgctactggcatctagaagaaggtagagatcagggatgccgttaaatgttctccaatgcacaggacagcccacaccaaataattacctggcctaatatgtcaacagtgctgaggttcagaagtcctgggttagactgatcgtgatgcattgccaagaactgaggatgttgctgcctcaagtgaaatagaggattttgtgtagacttagagcactcaacaaggcagcgagtggacccatgggtggcagctccacttttgtccacatgattgagccctgggcaaaacaacactgggtgggagatgacgatgctggggggtctgctggcgagaagatggatacagtggcatttcagaaatcctctgtattctctggaaggtatttgtataaaatgttaataatcggtacttatcttttataatttaattgctgtgttcatgtcattaatataaccctttacagttgcttcctaaggcagcagatccctaatttatagcatgactctgattctagggctcagtggcctttgttccttagaatgtttgtattttctgagatcattttgaaaagataggtgaacatcaggacgaagagtgcaaaactttggacagatcttcctctggttttccattagcatttgaaaaatgtctctttcaggcagtgttcattaagattttaattttatagtttgttccttttttaagtgacatgcaattaattaaggtttaatgtgtcatctattttttgcaatgacacttttactgcccccttttcattttagtcagtttataaattgtactctagctaatgagttccatcctgatatccagttccaaataattaccactcttctaatatggctattctttaatgtgtcacagaactaagatccttaccaggcaagctcaggtgagctgggtctgccagagccatgaggccactgtgggccaacaggccagggcagtggctggggacccgaccttcctcagttcagcacacgttgatcagccatcacatgtcagactcctgggtctgcatgggatataaatgaagaagcgtctgtcgggtccggtcccctttgagctcacagactagataattgccctagttctccatgttgctttgctggtggagatatgactaatgggacttgaaatcctcaatgatttttttttttttgaaatggagtctttctctgttaatcaggctggagtgcggtggtgcgatctcggctcactgcaacctctgcctcccgggttgaagcgattctcctgcctcagcctcctgagtagttgggattacaggtgcctgccaccacgcccagctaattttttgtgtgtttttagtagaggtggggtttcaccatgtattggccaggttggtcccaaacccctgacgtcaggagatctgccctcctcggcctccaaagtgctaggattacaggtgtgagccactatgcctggcccctcaatgatttttaacagtatgtgggactgagattggaccaagattaattgaacagcaattccgtattaatttctatactacaacattgaaatttatgcagatttcatcaagttgagttgaagtttaactttgcaatatttgggggcagtgggtggactggggagatttattaagggagtgactagtgtcagggagactgtgtaaggggacctatcagtcaaccaataggatgtggatatcaagagatttattttaaggaattggctgtgtggtttggggggttggtgagtctgaaactggtgcggtaggctcgaaggctggaaactcaggcagcagtaagtagatgccgcagtcttgaggtggaatttctttgtttccaggaaaccttggtctttgctcttaatgccctcaactaattgggcgaggcccacccgcattatgaagggtaatctccttgacttagagtcaactgattatagatgttaaccacagctgcaaaatacctttggggcaacacttagatccatgtttgattaaatcactgggtattctagcctagccaagttgacatagaaaactaaaactgaccatcacaccaggactgccaggtggtaggaagtacattagactgaggttaggacacccaagtcttagaccctctctctgttactagcccacagccactgtgactgccattctttttgcaacaagccttttaaaaattcatgccccctacccaccaggatgaaacgtgttgagcaaacaaaaatgaatttttctatcctggaaaagcccaccatcggttaaaggtagacagaccccagccagctaggccgcagtgggagaagcgaaggaaccacccatttcccacagtccaggacccatggcagtcctcaagagtgagaccacagctggggtgccaccactttgcaagtgactgttactggtcatatttttagaactttctagccacagcattcaagtatgcaaggcagctttgttgtctggtcatctctccattgatggaaagctataggatcttatttctttaaaaaattctgtaatttggccaggcgcagtggctcacgcctgtaatcccagcactttgggaggccgaggcgggtggatcacctgaggttgggagttcgagactagcctgaccaacatggagaaaccccctctctactaaaaatacaaaattagcctggcgtggtagcacatgcctgtaatcccagctactcgggaggctgaggcaggagagtcgcttgaacccgggaggcagaggttgcggtgaacggagattgtgccattgcactccagcctgggcaacaagagtgaaattctgtctcgaaaaaaaaaattctgtaatttaggtgctgaattcaggcggggttttattcaggacagataatcaatggagcacttaaaaggcaggttgggctgggcacggtggctcacgcccgtaatcccagcactttggaaggcggaggtgggaggattgcttgaacccagcagttcgaaaccagcctgggccacatagccaggccccatctctacagaaaattacctgggcggtggtgtagccccagctactcgggaggctgacttggggggatggcttgagccccggaagtcgaggctacagtaggacgtgttcccgccactgcactccaggcccgccttccggcgctcagatgagcacagggttcgcagagtgaactaggtgcagtctgttaggaggcttggggccaggggtggggggtgggggcagttttgcctttgccccaggctctgcctgggagggaagagtccttgttgccgccacccacttctgtttgtgttttgcgttttgcaggggcggatgtccacgcgagggacccccgccgtgggatgtcgccgcaggagtgggccacttacacgggccgcgtggatgccgtccgtctcatgcagaggctgctggagcgcccctgcccggagcagttctgggagaagtaccggcccgagctgccgccgccccctgaagcggcgcggaagcccgcgggctccaagaactgcctgcagaggctcacagactgcgtgctgtccgtgctgacgccgcgctccgtgcggggcccggaggacgggggcgtcctggaccacatggtccggatgaccacgagcctctacagccccgccgtggccatcgtgtgccagaccgtgtgccctgagagccctccgagcgtggggaagaggcggctggcggtgcaggagatcctggcggcgcgggctgcacggggcccccaggcgcaggaggaggatgaggtggggggcgcggggcagcgcgggcggaccggacaggaggacgcggactcccgggagggctccccgagagccggcctccctcccgccctggggtcccggggccccgcagcgcccgccccgcggaaggccagcctcctgcccctgcagcgcctgcggcggagaagcgtgcggcccggtgtggtggtgccccgggtccgagtcagcaaggcgcccgcgcccaccttccagcccgagcggccggcgcggaagggcagcaccaaggacagcggccacctgcagatccccaagtggcggtacaaggaggccaaggaggagaagaggaaggcagaggaggccgaaaagaagcgccaggccgaggcgcagaaggagaggcgcactgcgccctggaagaagaggacgtgagggcccgtgtgcctggcgctggggccggggctggggccggggcggggccgcagggctgggcgcggagaaggaggcggccccgttgcgcatcgcaccacttccgctccatggaccacggggctgcgcgcatttccaggctgtttgtccaggctgcttccaagagagggctgagggagccacatggattcgcttgtcgccagccctcctagcaatcagtacacctagcgggcacgttgcctaaaaggctccctttagagaacctcaattaagattttttttaaagatcaatttatcaaagggcgttttctccgtaattttgtatttttaatcattatttatcaaatttgcaacgttttacaagtgatagggccccttatatccaaggcagttttaatacacttgcctgaagaccttttgtttaagatactgtttctagcaataagtatccatgatacctgtatgagttcacacagacatcatgggattctcccctttttggctgtttggtcttttctcctcatcgtgggtgtaggtgcacactggatgttcttagtcattagattaagtgttgccggatatttctatttgacggaggcattggctcgttgagccacatgatcaagtgagacagaggatcagatgttactgtatctttttaaaactcttatccatatagtaatatattgaggaaaaacatattgtcaaattataaaacaatggagcgataaacatgtatttattgctagaattaaactcattttaagcaaggggttttaggtaaactggatacgaaatctttaacattaaaaatagatatgagaaaaaaactgtcattcgataaaatgaggcaaatttaataataaatgattaccagaaatacaaaattaagccatatgtgctcttaagtaattcgaatccagatatccttaaaatgtcaaaaagatgcaacaagagtcaggagcccagaatgacgcaaattacaggaatggggaggaggtgatttttagaagaggtgagagaatggaatggggaacagacttgttttcggcaaattctcctggagtagactgggcagccccctcctccaggctcagttccaaagagtccgttgtgtggatatttcttttatttttcctttgaggactgcgcttggtgtttagttcatccttatgccgacctcttagaatttccaagatgcagggccttgggcagggcagggcatgggtgtgatttgccttgggccacaagctcttggtgagagtcttatgtccacacttttatctccaaagtgacatggagatcacttttctcagtgatcaaatttgaatttatcaaagggggttttctgcataattttgtatttgtaatcattatcagatttgcagcattctaattcggcagggcagggtatgaaagctggaaactcaggctggagtttctagttctaatggctctctggccatgtgggttgtagagtgtctgtcacatatgcactttatttcagtattaattgaaatacttggacacgcacgatcacaggcctatttggaggctctgtactatgaccctaataaccctagatacatcatgatacatggtgtctgtctcaggatgcaggcagggctggtgcaggcttctccatactcccttccacttggcaccagcaggcatcgagcaaccagggatcttaaactggcctctccaaatactccattgaacaggactgcaggctgcacccaggctaatgggagattggtgtgttgatgatacagtgtttaagatgagattgcagtgagttcctccttaatcccagaagggcaccatgatgaatgccacaggagactggaccctctttgagaactgcagatattagttgactgtgggtcaccctcgtggccaaggagttgggattggccatgtcttcttcgaggaggtggagactgtaactgacactggttatctttggggttgtctttcctgaatcctttggcatgtggcaccttcctgccacatgtagataattcacggcattaccaagtcaccacgagccccaccctcacctctgtcaaccgaggacccagccaggcagtgccatgtggtctcccaggcacgcttctcaacaccggctacccctgctgtgaaggttctcaaggccctggtccggggagccaagccctgggagcgccctaaagctccgcaggtaactgcactgcagcccgcattgagaaccgcagctctaacacagtgattgcgagaggacacccattctgagctcccacagagggctccacctccccaagaatgtctcattgtcattggaacagccagggtcaggcagcttctgctcggactgacgtggcgtctgacccttggtgggttgccagacattcctgcctgtttccaccatgggaagctgtcactgggaatggtatggagccctcacttctaccccaagcctgggtgtctgctgcctccatgtcaaaaatggacatttctggtcctgcccagctgctacctcaccacaacccatgctcagagttgtcagggatgcgtggaacagcaatgatgggacagcaaatgactggcaatttccccaggtcccacgctgttctggagtggacgtgttgcggccctgcccccgatgtgttccagcctcatccaggtgcacaggatactctggggccagcacagggattgtccagtgatgctcctggtgtccacaaaacagctctagagatacctgcattttgaaaagcctgctgagccaacaagcttggggcaggacacggatttctttggcaaatctgcaggcgagctgaccacttgcctggtgagtggaagctgccattacctggccagtgtttgcaactcgagggaaaatgacagctgcatggggggaagcctgacctcccggggagctttattgtggcctcagtggaaagattggattttgaaacctgccagacccaactgaaagaagggtcattcctgattgagttggagactctccccagtccctctctctggactcattctagctgtggcctgcctgtggacagcccttccctttggcccatgcggcgggtccaggcagctcctgcagctgtgctcatggctgctggcccagaacttctcatttttgccatgtggaagcagatttgctagtagaggaattttccaagtcaagggaagtgttgccaaacctcttgcctcgacctgtggggggccttctgctcttgttttctcattctctttggagtgggcacagaggggacaagtcggcccccagtgaggctcagggagtgcaggagaccagggagggaagcccagatgatggggaaacagagccaccttgagggggtgtcatggggtcagtgtcagggtgatctgacgggtcagttcatacttaagcaacattattctgttcgtttcttttgggtaaggaattcctcatgggaggtgtggtcatctggtcgtagaggtggacagaaacaccccctcgtcttcctgagccatttggaagccctttcctctagccctaggtactggtgacacaggcccctcggtctcaggatgtggacagggctgggaggtgcaggcttcttgtcccatccccactcagtatcatcgggtatctggtagtcaggggtctcacagtggcctctccaaaagcctggtgtccttggagaacatttttcattttgtctgttttcgttgctttgaacagctgcattcactcaccgagggctcgccctccctggatctgccatgtggttcagggaggaggggaccgatgagcaccgaccccttctcttcacctgtcagtggccaccacagtgccccctctggctttgccaccacgttctcctgcccccgtcaccttgtctcttctaactcattagcctttccttcctttgtctgttttcttctcccagctggtttaagttcttgatcatccctggcaccacctaccctaaggtcttccaagaacagaaaagccagggcctgtgtggggcaatgtgttgtccctgtcgggttatggtgggacctcctagaccccagagtgaatgaatggcaggcctgccagtgactgtgctgatggcttagaattcctacacggctgtgcctctcccaccccgtcctctttgctcggaagggagacctggtttgctctcctccatgacagcccagcccctgctgtgcacaggggtggggctcgggatccctccctgcaccctgatgtttattaactgtagatagtgaatttcaagttgacaggtaccttctcagggatttatatataaatatagttagaggaaaagttgaagtctattttactactttttagtgtttgagtaaattatgctttaactggacagaagaaatatttctcagacaatgtcgatgctgctgatgacaactgagatgcctggagctcacccttgatggagacttccttggtgattggagatgggggactctggtggcagaaatggctttggggtaggtgtgaagttgcttcagtccctctgagttgcctcttctggatggaacgtgtgtatcaacaacaatgaaatgcacctccgtgtgcatggaggcggctgatgagaatacagataggccagtcctcgctcttccctccagaaccggccgctcccggtctgacgttggagcacgtgaactaagagtgacaattttttctacttgcttctgtgaataaagtgttctacagtcagcccagcactaaactcaccagaaaagaggagggaacagcacggagccattcatctggaattactcgatgtgcagaggctgccccttggccgcacttgggaacatcgtggacatcttccttcctctcaggctcctcctgacagactcctggcagcactggagacctcaggactatggagatcagaattgtaatggctttgtcatctcagtgtggccactcctgaggcaagaggctcctcctgggagcaggagagagagagtttgtgatgttggttggaaaataggatttatggatgcaggagggccgtgctaggcccctctgcccgcttctctccctgctgttggcggtgaccaggtctcaggagcggagacgaggctgttgtgagtgaaacagaagcccctggcatagggccagaccctaggcctgaaaaggatgcaaagcctgctgttttcaggctgttgggaagaatcgtgcgtaccgagtgattatgatgaaacgtatcccagagaggaaatgaatgggacctgaaaagtgggtctgccacatccctggtagcccgcctccaagagcactacactccccccagccccaccggccacactacatgacgtgggaaggctgtccgttcatccttaccctggggactcaagtgtgctctgcggagtgagtcacagccctgatgtgcaccctgcactactctttccccaggtgcgccggagacgcaggcttgctcatttccgtcctgacacagctcgctgttcctgcggtggtcagagtccccctgtgctgtgtcagctcctggacactactagtctttcacatgataaagcgcgagcactttttcgcttttgcagtatttggggaaattctaacacatttcccggggatttgcccaggtccctccacctcccacggtgggtaactgtgtggattctgcacctggcaatcggcgctcccctttggaaacacctgggggccctgtttcttccagcctggtccttggtttctaccccagccgctttcagccggcacctgcatgggactgcctggagggccacggtccagggaaggacaggtgggaccctgaccatgacagatctttctaaaacaataaagtcccattgatgacaactgcagtgggatgaatgccattgcagcggtcatgctgggagctgccgagagcttacaacaaaagcagttcctctcaagacactgcttgcatcttccctccacgcctctcggtgcatttggaacttgtttatgcgctggtataactcgagtcagctgcttatttctgtgcccttgcactcacaggttccttcattaacattttaaataagtggctaaaaaaactcctctggaggttgtttttgaaagagacaggaaaaagaaacacacagtacctggattgttttgacttattttcaagcgactcagctgaaagccggtgttgcatacacaatttcctcacgctgacccagcctgactaagacttgataaaaggcacagcccttggcagcaggcagtgccaatgtggacagtgtacactaagctgtgagtgtgtgcacgggcgagcacatgtatgtgtactcatacatccagatgaactaaagggacactgggctttgtgctggcaaaggttacgatgctgctgtagcttggctgtgggccccaggcagtgtcagatggaacctgctttgatggcgtgttgttcagtgtactcagtggggtctcacatggcccgaggacccactgtgagcactccgcccgctgtggcacagaacacggctggggtcatcacagcccaggtctttattgaaaggcggctcatatagaacccatttggccaggtctgggccatctctctgcctctgccctatcttggctgcctggaggggcccaggcccaagaggattctttacccctggaagagctccccaggcattcagcctatggcccttgacatttggctgcaggttaccgtcagaatcaacaccatatcctgaggaagccctggtatttccccaagtctgcctatgtattagacactctaatcaatgctaacacagttcagtttttgagggaactagttttgtcataatactacacccctctattgtttttaaataagaaaaaaaaaaaccccacgaaactttccatcaaagcaatggtccgtgttggcctgatgctttaagaagtttgaggaggtaggtatggaggcaccttaacaccagtttttgagcagaagttctagaagctgatttagaactacacagctatggatacacctgatgaaaaccgcaaaaggcgatgacaggcccagaaatatgaccagcaagcccgtgagcctttggggcatccgactgaatttgaaaataataccccattcagatgaacattaaaagccaatgtactggaattctctttgttctgcccgacatttgggggtgtccaaggacctgtgtttttaacaaagatgactttatgaccgttctaaggattgaacagattcctgcacagggtgccaggtttcaagttaggtcctcttagtataagctctctttttttctgaatgtaaacctatttgcattgtcatttctaataatccagtaggtttctggatattgtaaagatactgagtacagatataactgtgtaaatttcatagtgttttattttgaggtgagagttttgttatagtttataaaagatattttcctattcagacctcagggctattttgggacctacaaataaatgtgattcccagcagcttcaatttttgatattcaaaaagttaataatctttaagctaaatataatgtgatatgattcagaaaaaaatgtttttcccttttaacttctaacaaattatgtatctaatgtttaaaaaatatggaaaaaagggataatgtaaaaatgtgggagaattgtggctaaagaataaaaaatcacttgttaaaacgca

SEQ ID NO: 785 - DNA, 279420 bp, Homo sapiens
cgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggtaaggccgtcccctccccctgctcgccccgcaccccgtgcctgtgtgtgcgtgtgtgtgtgtgtgtgtgtgtgtgtgtgtggatgcgcgagcacctgcgcacgtgcgcgcctccagcatccacccgtgtcctcgcctcttccccagtgattgcgtgtgaaggcctggctgcccccgcagcggcaccttctgaaccactcaccgttacctggtagctgggtacccttacctggcaactgggggacaaatggaggtggggcgcagccaggtggtgggctctttggagggggacaccgaactgcttctaagaggtgacacgggaagaatcttcaacaaaagcatcggacctgatcctgaatggcctgagacccattcgccctcaaggtgcttttcagagcacccaccgtgggatgaacttgttgcaactgaaggaaactgggtattgtctagtgatttggaacttcacctgaaagaaccaaatccttctcataagggagagaaagcacctaataaagttgtcttctttgcatctgtttttttcccccattgtcaataatttactttcaacctttaccccgtacatattaggagacagagatgttcaaagtgcatttccaaggtgactgtacacacttctctgtcttcccatgtacaaatttacagtagtttgcataagcagctcctctgttggcacaatatgataatcttgacaggtgcaggttattattagtatatcattttgaaagtttttctatttctggcactaaaaggccctcttcaacctccctggagaacagaacatgggcataaggcccaataatgaactcatggatggacctaggaatttcagggtaaaggtgactaagacacacgctaaaagattattaggaagaggcttaaaacaaaagcaatgaagttctaaagcactcagagaaattgtagaaccaattcctgggactccctgaactgtttatccaagactatacagttggttggctacaccagcaagattataatctcttgttgaccctccattctgatgaagagaacatgatacctgttttaaaaatttccaaaggcttaggatgcctcaaagaaatgcagagaggcttttggtttaaaaataacaccttatatttgcattatattagatactttcagagtggaatttcaattctgttgcccagcagtctccaaactgtgcacatacccttaggcccacaagacttcacagggtatagaatgttgcaagggttttaattttcagatcctcatcttccaactctgcttgaaactaatttccctctgaacatgcgtgatgcctgccagttctcctttcattctccccattcatccaagtgaggagcccgtgacaagactctgaggtgtgcttttctgtctgttccttttagcttccagaagatagatggttgtcaccagggctatctttatatttgattgaacaacaatgtcggagttgccttgacagaaagtcttattgggttgattggcttgtcaatgaggattggctttgccaattatgttgtgtagcagacattttctgtatactgaatgagctaaatctgcaaccctgaggttctgatgcatatgtatatgaagcaagcataccacccatagagcgccagaaagatgtccctttttcaagtgtttacacttaactatgttaaggatgttgagatgttatttaaaaatatgtgcatagattttcagaattctttgaggggctatgtgagcaaaactccttttgggacactgccttatcccattcctaagtcagatcttacttagagctggcctatttgaatgttgctaaagagcagtgctgggcaagaatacagagatgctgtgggagccataggttctagaaacagccctcagcatcactcttgcagtagatgctgtgttgtgggagcaaggcaggggtcagcaggtgaacagaggtagaaattgagggtgttggttaacccaagagatgcctgcttttcataattagcattgcttactgtgcattgaaaaacaaggctcagaagaaatgatatacctctcataacctttgtgtgacatgaaaccatagtagagtcagcttgatatgctgtcatataatttatcttttagcattcaatgattggacttgcctgttttaaatactaatcaccatacaggactttttctatcccagaagtcagacagtagattcaaatgtgaaacatttactttgcttcatatttagcttcagattgtataggacctttagccagcgttgtaattttttactctgtggctcctgattgaaacataataattatctttaacaaagagtgcctgtgagaaagtatgtctgagatatattcataaaaacattcatgcaaagtgttattctttttattatttgagatttagaatccttagagcttaagcattgtacagctgttaaaacaaccaacctgtcaatcctcagtaatggcatgaaatgattaggctactataatttagccattttacttttcacttttaatgttaaaaagaccgtaaactttattacctagtgccttgtacaatattaatgagtctaagtttattggagtaattttgcaagagtttaactttttaaaattgtaatgtgaaggcccttttttctagccaacttggattgcaggaatcatttatcctgatagccacagttggattccatattccatggcttcagtttaccaggatctgagtcaggaatctcaggctctatgcatccaggagcagatgattatgtggcagtggccattctggctgtattcatttctctccttgggtatgagggtcattccagtagattcagagcttatggtcaaaaactgaaatacacattgttgctaccagtaatcttatactgttattctccaatggtttcttttcctagtattgagaaactgtaagagaactaaggtgtttttggaaaattgaagttagtaaatggaaaaagaacactgtcttggtgtggtaggcagaataatgggcctccaaagatgtttacattctcatgccaggaacctgtgaatacattaggttacatggcaaagggaaattaaagttgcagatggaattaagattgcaaatcaattgaccttaaaatagggtaattatcctgagttatcccattgggcccaatgtaattacaagggtccttaaaaggaatagggaaacagaagacaagagcttgttggaggaagatgtgactggaagaaagtcagagagagatacgacaatgctgggtttgaagatggaggatggagccaggagacaaggggtgtgagaggtgtctagaagctggagaggacaaaaaaatggttttcctcctagagtttccaggaacacatacctgctgacagcttaatggtagtgtattttggacttctgacctccagaattgtaaaataataaatttgtgtcatttaagccattcaattgatagtaattggttaccacagtaatagaaaactagtatacttggctttaaagcctctgacttagaaaaaaaacttaactctttttgtacttatatgaaataaatgcagtgactcagctagccctttatgtatagtagataactggttaattttagctttaacaaaaatgcaagttttttcctacttcatccatgaaattatgtggaggagacatacatatgtgtaacagtgggcaatatgaggatttgtaaagactggactgtcaagcgtgtctgtgtgaagagaccaccaaacaggctttgtgtgagcaataaagcttttaattcacctgggtgcaggcggactgagtctgagaaaggagtcagcgaagggagatggggaaggggttgctttatagaagttgggtagctaatggaaaattacagtaaaaggtggttatttattgttagcagagaagggggtgacaaggtacatggtggggagatcataagacttattgtccagaagaagaatgtcacaaggtcggttgatcagttaaggtagggcagggacaagtcacaacggtggaatgttgtaatgttggttaatcagttaaggcaggaattggctgttttacttcttttgtggtttttcggttgccccagacttcttggctcctgcaggccatctggatgtatatgtgtaggtcacaggggttacaatggctgagcttcggcttagaggcctgacatggacaactttggaaaaactaggtctttactatgaagtatttcagagactatcattaagtaacatgtcaggccaggagaagaaatacacttaattggaaataagctggaaagaaagaaaatttaaactagctgttactcaaatattaacactttcttagtcaatatcacagctgatgaattttcttcaagtgatgtggattcattcactagcaaaatgattatgctgtgtgttacatgataattgccccaaaagataataaagaagaattaggataaaaccaacataaataaatgaaaagaaaaaggcaaatgtattttgaggtcttaaagtagtatttggggtataataggtgtttagtaaatgtttaagtaaatggaagctttctcttcccaaattttcattgagtattcttttcttgtcctgtctcctcccaaaaacattcaaaatgataggaatttaaaaatgtatcaaccagaacattattcatatgtatatggtagagtctaacagatgagtcagaatcaacttctttgaaaaccatgaactggattttttagaaaacttaaaatattgatgatggatgtaagacatcttgatttttaaagattgaaacatatctgggaatcccattggctctagtttgtagtactggccattttgagagtcatcctctcttagggccgtatcatacccattattcctcctagactggcttttcattcatgtcatggcagaatattgttcaggccctgcctactcaaagtgcgggctgaggaccagcaggatcaactttgtctgggagcctgtaagaaatgtggcatctccagctccaccccagagcttctgaatcagagtctgcattttaataagatcatcaggtgatttctatgcacattcaaggttgataaatgctgctctaagttgcattgttttttcatttacatggattaattgtaggaccctgtagagcagtcttaatatatgaattctgcctattttctttgttttttttttgagacagagtttcactctgtcacccaggcgagtgcagtggtgatcttggctcacttcaacctccgcctcccaggttcaagaaattctcctgtctcagcctcccgagtagctgggattacaggcacctgccaccacacctggctaatttttgtatttttagtagagacagggttttactatgttggccacactggtctcaaactcttgacctcaagtgatctgtctgcattggcctcccaaagtgctgggattacaggtgtgagccaccgcgcctggcctgaattctgcctattttcaaaacatattacagattgactttcactgtgatataacaaaaaaatgtaagaaattacaatttgaaaataaaagaaagatatgtttcagatacgagagatgggttagttattgctattgagaaacaaatttaaataatcttcagggcaactaaggtgaaaaacaatacacatttgattgtattgtccttatgttgaaagaaaggaggtataacaatttattgggaaaaatacagttctttccaggcactgacttttcaaggtaatttatcactcagatatttatttaaagaacattaagggtgggtatggtggctcacacctgtaatcccagcactgtgggaggccatggtaggaggcttgcttaaacccaggagttcgagaccagcctgggcatcacagcaaggctcccactacaaaaaattaaacattatttgggggtgcttgcatgtgcctgtagtcccagctatgtgggggctggggcaggaggatgacttgagcccaggagttcgagtttgcaatgagctatgatagtgccactgcactccagcctgagtgacagagccaaatcctgtctgtaaataaaaataaaaaaaaaacattggttagcatagtagataatgtctttgattggtttttagtgtaatatatagaaaaatttttatggttaatgtttcttatttgatggttttatgaaagccaaaggcatggtcttatattttggctaggtgaaggcatttttgtagaagtttaaggtaatataatctaggtactttttttgttatctaaatctgtattgcaaaggaatttcagaaaaccagagagagatgaggataaataaagtctcagatgtggaaaagcttggggtgctcaaagaataggaaatagtcaagtgtacctggacgataccatttttgcttttagacatgctgagaatttttgacatttaaaaaatgttaaagagggaaaataagctgcttaagtatactacattttgcatttgagttagtcttatatttatttacatacttatcataaaacatattcttgtctctagttcatgacttaattttaaataggaaataaaataccttgagaagagattctgcatgtcattatgtaactatggtacttagttttgccagtcaaaaccacacattgccacgtgaaggccagtagtttattgagtactcagggaacaaaattaggtggatttttttctgttttttgttttttggggttttggatattatacagagagtgtaaaattgcaatttttttcttcaggagactcagacttgaccctaaaatatgcatataaacttgaaggctcaaataatgttttttcctaacctggaggaagaattgtgagaataatgctttgcatagaatcctcttcaccttctttgcatgtttcttttggatcaggcataaaataggggcctggttttgttagagtgggggaaatagttgatgatataatcacccattccctcttagttgcaaatggtattgaaattacagaaagtcatctgaccactagttgaggtcacttcttttcccattcctgccattcccccatgtctggtataacatttggcaaaattggtaactgctcttgagggttttcatttgtttctgtgtgttcctctgaaatgtcatgtttctgggggaagcaagaacaacagtacaattttccacattgaatcagatgttcatgtgatccaagcgtgcttggaaaaatcttactgcttaggattctatacaacatagctctcttgtgcagtctgtagttagacagttaaagggcccatgcctcacctgcagggtagcccttctgagtgcggtggaagcagagctttcttggaaagtgagacaccacttgatcagatccattgtggaattgaacaagatgtaagacagaagcatggaattctgaaaagtcagacaatgcattagtgcactcacattgtcttatatttaggtctgtcaggttgtgttataattttaaaaattaatttcaaaagcgatacatacttattatagaaaatttgtgcaaatacaggaaacaatagaaatacagggaagaaaatatagtccatcttaattctccctaattttccttgcatcttagcattttagtgcttcaggatggtatttattttggaactttagtacatacaggaacatagagagactacagtatatatgtatatgtgtgttcatacgtatgtagtcagatatcagaaaaaatcatattctttaaaacttattttaaaattacggatatcacttagagatactgatgttagtattttgatatttgacttttcagtcatatatatacttctgttaaaaaaacaaaaaattcaatatgaacatatggtttttataaattcttcatccacatacactaaaatttattcctttttttttttttctcttgaaatggagtctcactctgtcgcccaggttagagtgcactggcgtgatctcggctcactgcaacctccatctcctaggttcaagtgactctcccgcctcagcctcccgagtagctgggattacaggtgcatgccgccactcctggctaatttttttgtatttttagtagagacggggtttcgccatgttgcccaggttgggctcgaactcctgggctcaagcgatccacctgccttggcctcccgaagtattgggattacaggcatgagccaccgcgcgcggccaatttattctttttagtatacaatactgtaagttttgacagatgcatagttttgatagatgcacagttttgatagatgcacaattttccagagtggatgtgccatgttgcattaccaccagcaatgtgtgagagctccacagatgggaactcatattgtatcttcagagtgtggcgttgtcaatttttcttttatttcagccattctaataggtgtgtagcactatctcattgtggttttgagttcccctcatgactgaagttgttaattatcttttcctgtgccttttaataatatattcatgttctttgtgaagtttgcccatttaaaaaatactgggttgttttattattattaagctttgagaggttttatgtttgccaaatgaaagctctttggcaaatatgtgatttgcaaatgttttcttcctgtctgtagtttattttatcaatagtgtcttaaacagagcaaaagttcattttgatgatacaaaatttaccatttttcttctttttatggaacctcctagaagttttaaagttttaggttttacatttttatctataatcctttttttctggtatatgttgtgcaattttccctgcaccgtgtcttgaaaagattgtcattttgccattgaattacgtttgcacctttgtcaaaaatcaattgactacatttgtgtgtctgtttctggattctgttctgctccactgatgtgtgtgtcccttcacaggtaccacacattgttgattgcagctttatagtaaatcttcgaagcaggtagtgagaatcatctaactttgttctttttcaaaatttgtttatgctattctaattacttttcctttttgtttaaatttagaataatcttgttaatatctacagataattgtacttggattttttagtagaatttaattgaatctataaaacgatttggggaaagttggacatcttaacaatatttacttttccaacccatgaacatgacatatctcttcatttatttagatttttaaatttctttcattgatgttttgtagttttcagcatatagtttgtgcgtgtattttgttaggtttatacctattttatttttgattagtgctattgtgaatggtatttttaatttttttttagaaatttttattttcttagtccattttgtgttgctatcacagaataccacagactgggtaatttataaagaaaagaaacttatgtcttacagttctggaggctcaaaagtacaaaagcatggtgctggcatctggtgagagccttcttgatgcaccatagcatggtggaaggcatcacaggacaagagaggcataagagaaagagccaaactagcttttatgacagacccactcttgtgataactaactctcctgtgataatctgttaacacattaatccattaatggcagaatcctcatgactcaatcacctcttaaaaggccttacttcttaatactgttagattggggattaagcttccacatgaattttagagacaaaaacattcaacggcagtgacccttttatatttaattgacattttaattgaggtaattgtagattcacttcagttgtaagaaatacagagagatactgtgtaggcttcacccactttctcccagtggttacaccttgcaaaactgtattataatatcacaaccaagatattgatattaaaacagtaaagttatagaacctttccattatcacgaagatacctcatgtagcccttttatggccacaactaccttctccctttgacccatccctaacctttgacagccattaatttgttctttctatgatttttgtcatttcaagaatattgtgtatccataaccatacatatgtgacttctggggattgctttttttaaaaatcagaataattacctagaaagtcacccaaggtgttacatgtatcagtagttcgttcctttttaattgctagtagtattacatagtatgcatacaccacagtttagccatttatccgttaagggatatctggattgtttccagttttggctattataaataaagctgctgtggacattcatgcagaggtttttgtgtgaccataagtttttatttctctgatataaacatccaagaagaaaaatgctgtattctgtgatagttgcaatttttagttttaccggaagctaccaaatggttgtccagagtggctgtaccattttatatctccaccagaaatatgtgacagataaaatttagccccattcttgccagttatttgatgttgtcaatatttttaattttagccattttaattggtgtatagtgatatctcatcgtggtggtggtggtagtggtggttctttttttgttgttgttgttgttgttcttcttcttcctccttctccctctttctcctccccctcttcctccttcttctcttctttttttttcttttcttgtgtgtgtgtgtgtatgtgtgtgtgactgagtctcgctctgtcacccaggctggagtgcagtggcatgatcatagctcactgtcatctcaaacttctgggctcagttgatcctcctacctcagcctcccgagtagctgggactataggcatgtgccaccgtgcccagattgtttttttttaaattttttttttgtgcagacagggctttgctgcattacccaggctggtctcaaactcttggcctcaagtgatcctcccatttcagtcaccgaaagtgctaggattacaggtgtgagccactatgcctggctcattgtggttttaattttcatttttcaaatggctaacgacgttgaatatattttcatgtgcttacttgccatctgtatatcctctttagtgaaacaaatagtactgttttgttaaattttgctttctggttgtttattgttagtgtatagacatatttaatgtgtatattttgaccttatgtcctggtgatttaactaaacttatttattaattcaaggagctttgctttagattctatgggagtttcttttttttatttagactatcatgtcacctgttaatagagacattttatttcttccttttcaatatggatagcttttatttcctttttatggtttattgccttggttaagacttctagtaggttttaggtagatgaggagagagcagatatccttagaaggatcctttcttgtttcttgttcctatcttaggaggaaaacatgtagtcttttgcaattaagtatgatgttagatatagattttttttttgtatatgccccttatcagttgatcagttgagtaagtttctttctattccaagtttgccgagagatttaaaaaaactacaaatggatgttgaatttcgtcttatgctttgatttgttcatatggtttttcttgacttttttccaaatttttaaaaaataaatttcattgtgtgtatttaaggtatacaacatgatgttatgggatatatttagatggtaaaaagattactgtattgaggcaaattagcatatccattatttcacagatttgcccattttttgattttgtggcaagagccactaaaagccacttgtttagcatgaatcccagatacagtacaattttattacatagagtcctcattttgtacattagatgtctggacttggtcatcctacatatctgctactttatgtcctctgacctacttctccccatttcctccccacttcccactcccgtgcctggtaaccactgttttgttttctatctctgtatatttgaattttttttggatttcacgtataaatgagaccatgcaatatttttctttctctgtctggcttattttacttagcatcatgtcctctaggctcattcatgttgtgacaaatggatctcattcttctttagggctgaattgtatgtatatatacactgcagtttcattgtccatttgtctatcaacagagagttaggttgtttccatatcttggctattgtgaatgatgctgcaatgaacatgggagtgcagatatctttgtgagatggtgatttcatttcctttggttatatgcccagaagaggggttgctgggtatatggtggttctattttttatttaattttattttttagaaacctccatactctttttcgtatggctctaccaacctacattcctgccaacagtgtacaagagttctcttttatccacacctttgccaacatttcttcttttttgacgttttgataatagccattctaatgggtgtgagatggtatctcatagtggttttggttttcatttccatacctgagactgggtaatttataagaaaagaggtttaattggctcatggttctgcaggctgtgtaggaaacataacactagcatctacttctggggaggcctctggaagtttacagtcatggcagaaagtgaagtggaagcttgtatgttatatggcaaaagcaggagtgagagaattaagtgctaaacacttgtaaacagccagatctcacgagaggtcactcactatcacaaggacagcaacagggatggtgctaaaccattcatgagaaatcaccatgatccaataacttcgcaccaggcctcacctccaacattggggattacatttcaatatgagatttaggcaggaaaacacattcgaactatatcagtgatattgagcaccttttcatagacctgttggtgatttttatgtcttatttggacaaatgtctattcaagtcttttgcctgtttttaattgggtcatttgtttttctatgattgagttgcatcagttctttatgaattttagatgttaaacccttatcaaatgttggtttgcaaatatttttcccaatttgtaagttgccatttgatttcattgtttcctttgctgtgcaaaagacttttagtttgatgtagtctcatttatttacttttgatttgtggcctgagcttttggtatgatatccaaataaataagtaaatcattgccaagaccattttctgggaactattcccgtgtattctcttctaggagttttatagtttctggccttacattgatgtcgattatgcatttcatgttgaattttgtatatggcgcaagagaatggtctaattttattcttctgcctgtgaaaatctagtttttccagcaccatttattgaagagattatcctttccccattgtgttcttttggtggctttgtcaaaaattagttgactatatatctttgaattcatttctgagctcttgattctgttgcactggtccatgtttatatcagcaacttactgttttgattaccatagctttgtagtgtaatttaaaataatgatgtgcgatgatttttgactcgaaccaagcttgcatttgtggggtgaatgctacttggttatgaggtattgctcattttagatatagctggatttaatttgctaatattttgttgagtttttttgcctctcagttcatgaggaacatttgtcaatagtgtgtttttcttttattgtttttggctttgatattaggatatgttggcctcattcctcttaagtgttctggaagagattaagcaaaattagtgttacttctgtccagaatgtttggtagaatttaccagtgaaaaccactgggcttgtgcttttctttattggaaaattttattcacaaattctatttgatttcaaaatgtaggactattaatgtcaatttttaaaacagatttggtatctttcaaataattggtcaatttcatctttcagcatttcctttttatctttctcttattgtctgtagggtctgtagtgataatcatacttcattgctgatatgggtaatttgtgccttatctcctttttctttatcagtctgggtaggagttaaacaaatttttattgatttgtttcaaagatcagcttttgatttttttcgtctatttttattgttctcaatttcattgatttctctctttttttgttgctgttttttgttttgttttgttttttgagaaaaggtctcactctgtcacccaggctggagtgcagctcactgcagcctcaacctcccaggtttaggtgatcttcccacctcagccccccaagtagcagggactactggcacacaccaccatgcccagacaattttttgtactttttggtagggacggggttttgccatgttgcccaggttggtcttgaactcctaggctcaagcaatccaccccactcagcctcctaaagtgctaagaccacaggcataagccactgtgcgaggctgatttctgtttttaacttttattattttcttccttttgtttgttttgggtttgttttgttcttctttaactaatttcttaatggggaagcttacatgattaatatgaaccctttattctttcctatataagcattcgatgctaaaaattttaccctaggcaccactttaaatgtatctcatgctttaatacatcttattttcattcaattaaaaatatttttaaaaatttcctttgattctattttacagtgagttgtacactatatttttttacagatagcttttcatggtttacttctaatttaattacattacaatcagagatcattgtttgcatgatttcagttcttttaaatttgttaagtttggttttatggctgagaatatgggccatcatgttacatattcagtgtgcacttgaaatatgtattttgcttttagtaagtggagtgtttcttaaatgtcaactaggagaagtttgttgatggtgttattcaggtcttgtatattcttgcttgttttctgggtctctcattaactgagaaaggagaatcgaagtctctaagtataattgtgggtttgtctatttcctaattcagttttattagttcttgcatcatatattttggaatgtacaccttgttaaaagtacatacacatttggaaatgctatgtagcttggtggattgaccctttatcactataaaatgttcttattcctaggtaaatattttccttgctctaaagtctgctttgtctgatattagtatagcttctccagctttctttgtattagtgtttgcatggtatgtctttttccatatttttacttttaacttatctttataaacacatttaaagtgaatttttttgtagataacatatagttgcatcttatttttaaagtttaatttgataatctctattctttaataggtacagtttatgtttaatgtaattattaaaatagttggacttagggctaccattttattattaggtttttatttattatcctttttttgttcccccacctccatttcctgccttcttctgggttatttgaatttttttttttttttttgagatggagtcttgctttgttgcccagggtgtagtgcagtggcacgatctcagctcactgcaagctccgcttcctggttcaagcgattctcctgcctcagcctcccgagtagctgagactgcaggcacctaccaccacgcccggctaatttcttgtatttttggtagagacagggtttcaccatgttagccaggatggtcttgatctcctgacctcatgatccacctgcctcagcctcccaaagtgctgggattacaggtgtgagcgaccgtgcccggccttgaatattttttaatatttaactttatctgtcggctgtttgtatatatctctttgaattattttagttgtttttctagtgattaccatatacaaacttagctttacacaatctacttagagggaatagtttatcacttcaagtgaaatatataaaccttgtcactttaccctccttgatttgtgtcatagttgtcattttcattatatctacatgacttgagaaccctatagataaggttataatttttgctattaacaataaatatgttaaagaacttagtatagtaaaatattatgttacccagatatttaccatttctgttgctctctttagttcttatgttgatatttccctctgatatcatttcccttcagctttagaatttatttcagcatttcattaagaaatctgctggcaagaagtctcttggtttttcttcattgagtatgctttgttttgccttcattcctgaaggatatttttgctggatataaagttctggttagcagttcttttctttcatcacttaaaagatgtgtcactgtcatctagcctgtgtgatttctgaagagaaatttgcaattatttaagccattgtgctcttaaaggcatatgttgttttcctctggttgcctttatatttttttcctcatctttggttttcagcagtctgcatatgatgtttctgggtatggttttataagtttactttggtaggagtgtgctgagcttcttgaatctccaattatgtctttcactcagtttgagaagttttcagccattatttcttcaaatattttttctatgattacctctttctttcatttcttcttctgccaattaaaattccactttacatccaaccatcactttggctttgaagccgccacttaatattaacacttggtagatgtagtatgactattcttatatgtctctatctactgatgaggatcctactcctttaatactactgaagagtactctttttagatcctgctcttccaggactccattgatatgcatgtcagatctttttattatcattccataggttgctgaggacttgttcatttttttctgtctctctttttctctgttttttagattgtttaatttctattgatcaatcttcaaattcactgactctttccactgtcatctacatattgctattgcatccatctagtggatttttaaatttccaatattgtgtatttcagttctaaaatgtccaccgggttccattttatggttactgtttctcagcaattaatttctatctttcattcattttaacagtgttcatctttacctcatggaggattattgaagagctgccctaaagtccttgcctgataattccaccattggtgtccttttggggttgacatctgttgattgtgggtttcccttaatattgatccatttttcctggctctttgtatgtcaaattgttttggattataccatgaacattttgaatattgtattagtctgttttcacactgctgataaagacatattcgagactcggtaatttataaagaaaaagaggtttaatggactcacagttctacatggctggggaggcctcacaatcgtggtggaaggcaaaaggcatgtcttacatggtggcaggaaagacagaatgagagccaagcaaaagggaaaaccccttataaaaccatcagacctcatgacacttattcactaccttgagaacagtatggaggaaaccacccccatgattcaattatctcccactgggtccctcccacaacatgtgggaattatgagagctacaattcaagatgagatttgggtggggacacagccaaaccatatcaaacattatgtggtgaggctcaaggtcctgttaaaattctgtggagaaatgttgattttgtttatctgtttaagcaggcaaccaaccaagtttcctttttccagctcttctttttgtgatttcttttatactctccagctctcaagatgtccctttttatggtttctgcagccagaaagagtcttctcaaaattttagcctcttatgatgtcatgcggttcacacaattggtgacgccttcacagtgaggcagcaggagaaaagagagagagagagaggaaaaacaaaacaaaacaaaacgtattttctctccactatttacacagcaggacttcctcttgcttggttcctctggtcattgagttggatttttcttggggttttaggtactcatgctaaaggaaaaaaaaagagggaatcataatctctagcagagattatgatagaggacttttcctctatcctcagactggaaagaaggggcttctcctggagtttttgctgtcagtgtttgcttcccagttctagaatgcagtctgcactcaggtcaaataaggggaagaaaggagagtaaaaatccacaaactgtacccttatgggtccttatttatttttgctttagttcccaatgcacctgtcattgtgtaattttcaaagtcctcaggcagttgatttttgtactctgttcagagttcttagttgtaatcaatgggattgataggctgtagtcagcttactccatttgggctggcaccagaagcctacatatgttttcaatatctacttttttacacttaaaatattttataaacatttttccgtgccattatacattctcccataacataatttttaagactgcatattcattcgagtgtttatattgattgtcttagtgaatatatgaataaataaatctttacacacatctgtgattattttcttaggatagattccttttttttttttttttttttttgcagttgcaagatttaatagagtgaaaacagagctcctatacaatgggaggggacccaaagggggttgccactccgtgctcaaatgcctgtgtttatatcccgatcattatccctgccccatgctctctggcgatatatgatttgactatttctttacctcctctttttagcctaatttgtattttagtgagccctctttatacctgattggctgagtgtgagctgagttacaagccctgtgtttaaaggtaggtgtggtcacctttcccagctaggcctaggaattcttagtcagcctaggaaatccagctagtcctgtctctcagtcccacctctcaacaggaaaacccaagtgctgttggggaggttggctgacaaccgctcttaactgcttcatgctgaattggggcatagtaggggtcgtgcagttgagatttccttgggaggggtgccttcaatgtcatcaacattggagcatgggctagcaggccagtccaggggtccgcggtagatcttagtcatggactgcatctggggctccatttgaagaaccatttgtagttttacagcttcgattctggaagagacaaacgtaacaaggaggttaaagatacaaggattgaaatgtacggcctgaagtgcaggggcatatgagtgtgggcggtgcaagtggggtttcctttagaaaaactccgatacaatagggcatcaatatttctaggaagccacattctccatagaagctctcggtaaggggagctactggtagtacagcagcatacagggggtgcagtgagagtgaaagggggtaagagaacagtaaaaagaaaaatatgacaagggagggccaagaggatctacgattctagttactttcctcacggttgtcgcctgaagagcaggcgcagatcctctagaggttcacaggaatagctagcattgtctgctggattttcgggttcctttggcagtatccagggtttggctcgagtgtgacttatccaagactccactccagccacttaactgcggttagggtagataaaatgactgggtagggtccttcccaggatgtgtgtagggatggggaattaaaggggaagggacttgactaataccatgtcaccagggtggaataattcctttccctcctctcagggacaggttccctgtaatgttttaagaactcgttgatatttggctaaggaggtgatgtctgcaactaagttggccgtctctcagtcaagcacaaggtcattggttaggaagggctgtccatacagcatctcatatggactaagtcctgctttttggggacagtttcggattcttagtaaggctataggcaacagagcaggccatgcaaggtgggtttcttgggttagcttttttagatgtcgtttgagtgtttcattcattttctcaacttttcctgaggatcgtggcctccaggcacagtgtaagtgatattgtatacctaacgcctgggatactccctgcgttactgcagccttgaaattggggccattgtcactctgtaaacctcagggaagtccgaatctgggaattatttcatgaattagtacttttattacctcttgggccttttctgtcctacaagggaaggcctccacccaaccagtgaaagtacccagattagtagatactgaaatctctgagatttgggcatgtgggtaaaatctagttgctagtcttctcctgggtaatggcctgttctttgttctcctgaaggagcttggcaataaggcaggggattatttctttggcacacttcacaggccctgactatctgcttgacagttttgaaaaggcctggtccagtaaataatgatttggccatctgatgggtgctgtcaatgcctaagtgaaaggtctggtgaagggttttaagtaatttccattggttagctgcaggcaaaagtattttttctttggtggctggccatcctgaggagaggaaactatgtcctcgtgagtttccccattccatttcttctgctgagtactggagcttggtttcccagaggggattaccccatactaggggtccttctgtaagcatttctaatggagagtcctgccttgtggctcttttggcttcaatatctgcttggcgattccctatatttccctttcctttcctttcctttctgatgaccccagcagtgtaagactgccatctctttaggtttctgtacagccaataataatgtcctaatggtttcctgatgtttgatacgtgttccctcggaagttaggaattccctttctctccatattgctgcatgggcatggaggactaggtaagcatacttagtctgtatatatttaccctttttccttctaattctagtgcctgagtgacggctattagttctgccagctgagtgctagttcctggagtgaggggattactttcaagtattccattatcactgaacactgcgtaagccgcctttcgaagtcctttttctacaaaggagcttccatcagtatacaagttgaggtcgggatcagtcaagggaacctctaaaaggtccccttgagcggcataggtttgagcaattacttgttgccagttatgttctattttttcttcattgtctggaagaaatgtggctggattaagagttgcgcaagtgtgcagtcacagcactggtccttcaagtaatagagcccgatatttaagcaaacggttgtctgacagccacaagtcccctttagcagtgagtatgctgttcacatcatgagatgtccacacagtaagagctcttccttgtatcattttaactgctttagatactaagactgctattgctgccactacccgtaaacagtgaggccaacgctttgccactacatcaatttccttactcaggtatgccacgggttgcaagctggtcccagtttccttactcaggtatgccacgggttgcaagctggtccttcggacctgtgtaaggactcttagagctgttcatgttttttctgtgacatataaagaaaagtcttgcctcgttggtaagcttaacactggggcttgggttaggccctactttaggacctgaaaagccacttctgcttcaggtgtctatcttactaaatgggtattggctttctgagtttccttaattagtgtgtataatggcctggctattttgccatacctgttaatccatatttggcagaagcctgttatgccaaggaacattcttaattgcttcagggttttgggatgaggataagccgatataggctggatacgttcctcactgagggccctggtgcctttggataattttagccgtaagtgtttaacctgctgtaagcagagctgagcctttggtttggaaaccttgtagccacaagtggcgaggaagtttaaaagcgcttgggtggcttgatggcacaaggtttctgaacgggcagctagaagtaaatcatccatgtaccaaaggacatgagtgtccaagtatgagaactggctcaagtcttgggctaatgcctggccaaacagataggggctatccctgaacccttggggtaaaacagtccaggtgagttgagacattgggttcaaaggatcttcaaaggcaaataagaattgagagtcaggatgtacagggatgcagaaaaaagcatccctaaggtccaggactgtaaaccactctgcttcctctagtatttgggaaagtggagtataagggttaggtacagctgggtatagagggacaatggcctcattgataatcctgagatcttgcactaacctccattgtccattgggtttctgtactcctaaaattggagtattgcaggggctactgcatggttttactaggccttgggcttttaggtccttaacaatcttttggagtccttgctgggcctcgggtctaagtgggtactgcctttggtagggaaaggaggcagaatcctttagtttaacttgaatgggatgagcattctttgctcgtccatattttccttctgttgcccagacttcaggattaattccttcctcaagtaggggacaacaaacgtgtgttccttctcctatgttcaggtgtctaatggcccctgcttttgctagaatgtcctctctaacaaaggagtggggctttcaggcataattagaaaggcatgtgaaaagagtaaagttccccagttacaacttattggctgggagaagtatctagtgactggctgtcataggacccctcagatagtgacagatctggaggacagttgtccgggacaggagagtaagactgagaaggccgcaccagtgtccaggagacagttaaccttctggccctcaatggtcaagcatacccgaggctctgtgacggtgatggtatgggctggtgcttgccccgggcaccctcagtcctgctaccggctcatgtggttagtggcttctgactcagaggaccttcatcccctggggcagtgggccttccagtgactcccttgacataaggggcatggacgagggggtggcttatttctattcggacaatcttttttacagtgtccttgtagactgcactggaagcaagccctattaggcatttgatttgcccagcctttccctgttccagagcctccaaagtctgcttgcctgagggccatgactaaagcggtggcctttttcttatcccgtttgtcccattccacctgctcctcctgatctctattataaaaaaccgaggttgccaagttcagtagcatttctaagctttgctccaggcctaaggcggacttttgaagtttttttctaatgtctgcagctgactgagtgataaacttatcctttaagattagttggccttcaatagagtcgggtgacagggaggtttgcttcctcaatgccttccttagtctctccagaaaggcagtaggattttcttcctttccctgtgttatagtggacatcattgaataatttataggctttctcctagtttcccttagtccttctagcacacaagttagtaaatgtctgcagcaccaatctccatgttctgattctgcatcctaatgagggtctacactgggaagtgcttgctggccagtggggaattgttcttttctctgttgtcatcctatcattgacttaactgtaactgagatatcagagatcgccaaactctcgggctgcagttacggtggcacttctctcatttggggttagtgtctgatctagcagtaacattacatctctccatgtcagatcaaagtattgtcctaacccttgtaaaacatcaatatagccatcagggtcatctgagaatttacctaggtctattttaatttgcttcaagtctgagagggaaaaaggtacatgcactctgactgggctgaattctccagaatacatcttaggggtgtttttgccttgtggagaacgtttcccatctgaaaatagaacatagggatgccagcacccctagtcattttctgatgagcattagtcataggtgtcctctgtggtcctaatgcttattcctttccaggacgtataacaacccatggacctctgcttattggattcgttacgctcaccgatgtagcagtcctgcaccccttttcccacctttcttgaccacaaagaaaggggtccaggctgctggattctagtggtccttttccagcgtgcccaacattgcctttgtgctcaggggtgagtcctagagctgggctgggttcctgagtatttcatagcaacccagctgctccatcaagatgcattcccataaacaacagtccttatgcaaattcatttcagagagggtgtaggtaaccttttgagtcaggattgagatagagtttttttgattccgtaagtactttgaggcttggctaagtgcaaacagctcagacatttgagcagaccaattattaggcaattctcctaactctgcttccacaagagtctccctatcaattactgaatacccattgtggtttttctctcaatcacccgggaggtgccatctgtcctcctgtcctgaagggagttcctcctaggtctggtcggacctttgtatggtaattaagatttaaatcccctgttaggaaatctgctgggttaagggaattttcagtgattaatgttaaatcaactttttctaacagaatagccccatactttaagatttttgagttagtaagctacctttttgcttttttgacttagaatagttctgaactggtgaggtgtgctcacaatgaggtttcctctaaaggttatttttctattttattctgttagcaaagcagttgctgctacagattgaatgcatttgggccatccatggctgagataaggatttttgataggaaggctacgggttgtcagtggtttcactgttttcaggctacacccttgtttacactgacaacaaggtagtattggagtgttatagggtcatggagaagaccttcaattatcaattataggttttaaatttaccctggcttttaaaggaatagggcacactttttttctttactacttctatctctctttttctctctttctgcctctctttccccaccccctgcctctctttcccctctctctctctgccttgacttactcaattcactttcatcctgatctgttatgttgttgtagacccagttccagttgttaaagtactgggtcatcagttctaaggccctggcaaggatggtggggaacaggtgtcacataactgcccatgttgagagctgtatgcctaaattgggagggacacgagggacaagacaccctgggttcatagcctagggccctaaggacacagtgtagagcttccttagatccctttggagatacaacttgctctaatacttgggagaggaagtgaaagtctgaagcattagtacctaggaggcagggatcagaggaagtagattcaaaggtaaggagaattttggggctatactttcaagaaagttgtggtcgggacctaggaggtataggtcagaaggaaagatggggcgcacgcatgggcaactgttgaagagagacttctggctgtgccatgatctcagctggcttatgccgggagttcaggacgacagctctctgcctctagttggccctcggcttcccccagaaaaattgtgaaagcggaagctggttccaggcagaccaacgctcccaacccagagggttgggggttgttagaaagcgttttcccaggaagcctcacacctgagtcttaagtcaggcagccatgctcattgtttttaactggccaacaggtgcctagtattttccttcaattctaaggaaggataggacagaatagcaagtgaaagtggtctcatattactcacctctttggagaatcccagtacggtctaccaaatgttaccggcgggtctttgttcttagagctcccaagatggtggcgggctgctcccaaggtggtggcaagccttttgttctctcacctggggttcttggcctcacacattccaaggaatggaaccttgggccatgtggtgactgttgtagctctattagaagctgtgggtcatggaagagaaccatggaacccagtgactagtgttcagctcaattaggatgaacccaggtgcttagccgtgcccgaacattggtgagactttagtctgatcagagcagcaatggacgcctcactcgatcaggagtgcagtggacaccttgccagatccagagggatggaagtcagcggcgggtctgcgacggcggcaaacaacagtggtggacagcgagcgaaagctcagctcaagctgtgaaaagcacagaccagaagagtgtgcagttgcaagatttaatagagtgaaaacagagctcccatacaatgggaggggacccaaaaggggttgcccttaggataaattcttaaaggcagaattgctatactgacatctttaagagaatatcttaactttaaatcaatttagacaccctccaatacttggagtactgatttctctatattctcgctatagaatgggatagaatagatagaaaaataatggcaatgatcactcagggtgtgtaaacctgacaatttcctgtttagtagattaactgcagatctttcgccacatatctcataaatataagtgactagctgtctttggcttgatgtttataaaattcagtgatatcaggcacatttggtttgggctcataaaaccttgagccagacataaatcttcagtttcatagagcatcctaattaggatagaatcggcatggctgaagagagcaggaatggctttctgtgtgcagtaatcatggggtctgccttatgcattccattcatcttgcattaaaattgtgctttagtcatgagtgatttattaggtccaatttgaagagttggcttctcaactttaggagtctgaggaaagggtattttctataacactgcacatctttttttttttgtaattacatatgtatacctttgctgttttaaaatagacatatgaacattaaaaatccctatagaataggaaaatatactcttctaaactattatgacatatactatgccagagaagattacttctgtatcagcccaagccctggcagagaagagaactggtgcactcaaagtgggtaatttgaatgagtttagtgaaagaaccatttacaattgagggcaggatgtagagatcacaaaatatagcacgaaacatgtaggttagtaactggggactggagagtatcacttctaggcctggagctttgacctttggtgctcatccagtgtgcaggctgccttcagagggtgtgtgaacagaacaaagacctcatgtttcctgttctttctttgtccaatactcattggacagtactcattgattaaacctatcagaagtcagagggtcagcatgcctttcaatgcaatgaacacagatctaccaaagtgaatacaggaaacatgggattgaaatctccttccacaaatgtgttccacaaatgttgctggctaatttgcaactaattgtaaatgatggaagaacatttctatttcaccaggtatttatagtagaatataaaatgataattcgtaacataagacttcttagcagtgccaggcatggtgcctcatgcctgtaatcccagcactttgggaggctgagacaggtggatcactggaggtcaggagttcgaaactagcctggccaacatggtgaaaccccatctctactaaaaatacaaaattagccacaggtggtggtgggtgcctgtaatcccagctactcaagaggcagaggcaggagaatcgcttgaacctgggtggcagaggtgcagtgagccaagatcatgccattgcactccagcctgggcaacagagtgagactatgtctcaaaaaaagaaaaaaaaaaagactgcttagcaaaatatactaccaatttattagagaattatatatagcatattatacatctattaatacctatgatatgaggaatatattagactttataatataagggataagcacttgggcttgggagttacacttagtttgaatcccctcttttccatctatgagctctctgacttggggtgagcttattaccttctgtaagtcataaagcttctattttgtttgtttcatacgttacacaggaatataatagtacctaccatataggattgttgtgaggattaaatgagataatgtatttttcttagtccatttgtattgctataaaggaatacctgagatggggtaatttatagaggaaaaagatttatttggctcatgattctgctggctggaagactgggcatctggtgaaagtctcaggctacataaactcatggtgaaatgtaacggggagcctgagtatgaagagatcacgtggcaagggaggaagcaagagagagaggagaggtgccacactctttttagcaaccagctcttgtgggaactaatagagatataacccatttactgccccccagagaggggatttacctattcctgagtgatccacccccataactcaatcaattcccattaggccccacctccagcactgggaattaaatttcaacatgagttttggaaggatcaaactttcaaactacagtagtatggaaattgcataagccaatgtctggcacatattaagtattgtacttaataaatgtctattattctaattgttacacatgtgtgaccagggacaagaatgaagagttgagttggttcatcctctcctcattttaggatgaaactaattgcttaacttagtgtttagaaaggatagagagtttagtaattaagggcacaggttctggagaaaaatcttttgagtttgcagcctagttctgcctctagctgtttctttgacaaatacttatctgctcatcttctcagtgctttaatttcttcatctgaaaattgggtttgatatctctatcatctatctatctatctgtctttctatctatctatccatccatccatccatagatatagttatatttttaaaagtttatatactgtatatataaaaagataagtatgaaaattcattataatatcaaaaacttagaatttatagtcgatctgttttcaggatgtgagaacatagtcccacagaagccagatctggtgaaattgttttccaatataggcataccttggtgagattgtgggtttgggttcagaccacagcagtaaagtgaatattgcaataaagtgacgcacatgaattttttggtttcacagtacatataaaagttatgtttacactttactgtaatctaccaagtgtgcaatgccattatgtctaaaaaatgtacatgccttaatttaaaaatactttattgctaaaatatcttaatgatcatctgagccctcattgagtaattgtcttttactagtggaggctcttgccttgatgttgatggctgctgattgatctgggtggtggttgctgaaggttggggtgactggcagtttcctaaaataggacacctgtgaagtttgctgcattgattgacttgtcctttcatgaaagattgttctgtaccgtgcaatgcttggtagcattttacccacaatagaacttctttcacaattgttgtcaatcctctcagatcctgctgctgctttatcaactaagtgtatgtaatgttctaaatcctttgttgtcatttcaacagtgttcacagtatcttcaacaggtgtagattccatttcaagaaagcattttctttgctcgtctataagaagcaatacctgatctgttcaagtgtgtcatgacgttgcagcaattcaatcatatcttcagactccacttttaattccatttctcttgtaatttctaccacatctgcagttaactttctcctctgatgtcttgaactcctcaaaatcatccatgagggttggaattgacttcttccaaactcctgttaatgttgacattttgacttcctcccataaattacaaatattcttaatagcttgtagaatggtgaatcctctggtgtttagctatgtatagaatggctcacattaaccagggtctctgctctgctttcaaagaagtttcgatctgacagtgcaactgcagattataatgagcttaacaccagagaaatcttttaatatatgttttaaaataaatgaataatgactgtattaataaatgctaaaaatcacaatccttgctgacaacgaagagaaaaaaagctgtgtctctatctttgaaagcactagtctattccaaggcacagttacgatggtaaaacaaaatattgttagtctcatagatgcacatcaatgaaagacagtaggttggcatcttaatagccatagctatagaaatggctctgcgaaactgtaattaacaaaacaatataaactggagagaaacatattttagtatgagagtactaaagttaaaggttccaaatattatcaattaattaatccctaattcattccaggaaggaaagctatacacatgcataagatgaaatgtactattgcttctctttgtttaattttgttacttttttcctctataaaatagtaaattccaagatagtcataaaattaggtgagaggaaacaccatctgtaagcaacgtctggtgctttttaggtgtattagtaatattaataaaataatattttacctaaaaaaaaatggtgaatcctttccagaaagttttccatttattttgcccagatccatcagaggaatcactgcctgtggcagctacagccttatgaaatacatttatttatttattttttgagataggatatatctctctcacccatgctggaatgcagtggcatgaacatggctcactgcagccttgacctcctgggctcaagagatcctcctgcctcagcctctcatgtagctgggactacaggtgtgcatcaccatgctgggctaattttttgattttttttttttttttttttgtagagacagggtctcactttgttgcccagactgatctcaaactcctgggctcaggcagtcctcctgcctcagcctctcaaagtgttggtgttacagggatcagctaccatccccaacctatatttcttaaataataagacttgaaagtcaaaattccctcttgatccatgggctgcagaatgggtgttgtgtcagaaggcatgaaaacattaattttcctttacatctgcatcaaagctcttgggtgactaggtgcattgtcaatgagcagttatattttgaaagaagtccttttgttttctgagcagtagatctcagtagtgggcttaaaatattcagtaaaccatgctgtaaacagaacccttagattttcgaaatggtaaatgagcattggcctcaacttcaagtcaccagtctcattagcccctaacaagagagtaagcctgtccatcaaagctttgaggtcaggtcaggtgcagtggcttgtggctgtaatcccagcgttttgagagtctgaggcgggaggattgcttgaggccaggagattgagactagcctgggcaacatagcatgagtctatctctacttaaaatttaaaaattagctatgtgtggtgtcatatggctatagtcccaggtactcaggaggctgaggtgggagcattgcttgagcccaggaattcaaggctgcagtgagctgtgattgcaccactgcactctagcctgggtgacacagtgagactcttgtctctgaaaaaaacaaaacaatcatccctcccctcacaaaaaaatcactttgaagccaggcattgacttctcatttctagctgtgagagtcctagatggcatcttcttctaatagaaggttgttttgtctacattgaaaatctgttgtttattgcagtcatcttcagcaatgatcttagttggatcttctgtataacttgctgcaacttctacttcagcacttgctgcttcaccttgcagtttatgttatgaagacagcttttttccttaaacctcatgaatcgacctctgctagcttccaacttttcttcttcagcttcctcatccctctcagccctcatagaattgaagagagttaggaccttgctctggattaggttttggcttaagggaatgttgtgtctggtttgatcttctctccagatcactcaaactttctccgtgtcagcaataaggctgttttcttttttatcatttcagtgttcactggagtagtacttttaatttctttcaataacttttcctttgcattcacaacttgggtaactgtttagcacaagaggcctagtttttggcctgtctaggtttctgacatgtctggtttcctcaccaggcttaatcatttctagcttttgctttaaagtgagagatgtgcaactcttcttttcccttgatcacttagaggccattgtagggatattaataggcccaatttcaatattatttaatcttgggaaatagggaggcctgaagagaaggagaaaaatgggggaatagccggttggtggagcagtcaaaacacacacaacatgtatggattgcacttgccatcttctatgggtgaggtttgaggtgccccaaaacaattataatagtaagatcaaggattgctgatcatagatcaccataacagatataataataatgaaaaatttgaaatattgcaaggattaccaaaatgggacagagagacaggaagtaagcatatgctgttggaaaaatggcactgatacccttgcttgatgcagggttgccacaaaacctttaatttgttaaaaacaaaacaaaactacccatctgtgagttgagtgcggtaaaatgaggtgtgcctctatgtgattgatgtccccccatatctgctggtctaaaatctgaggtggcgtccataagattcttttccgtttgactcagagataataagcatctcgaaaggcttcttttcatttcagggtggtagatctgggaggcagccaatgtgttgccaaattggtggcagaaacctagaaaatgggtaggaagaagtagtaaaagcactaacagaagtacgttacatcctgggagatgtaatatacacaaataaagtgttgtaggttgttgctaatggtaagagttagcagcagtgtacactgaggcctgtagtttctattttatgtactccattgcttcggagtgagagaaccagccggtgagtaggggaaaataccttctcaatagagctgaggtttgttgcatggaggcctacaaagcactattttactaaattgagctagaattgtacatacaaacattttcaaccatagatctgggactagaatagcacccaagtaaaaaagtgacccctagataagtctccgtatcctatctattgaaaaatattaatactagcattagacaaatatttccttgctccaggttgatcaaatagaaaaaaaaaacaactttatgcaaccattgaaaattattgtagaacaaaggaaatatatatcatcctgaaaactcgaaagaacaccagtgaaaattatttacaataggaaacaaaaaagtttagaaaactgttcagaatcctcactatattgaaaaaggtgtagtctcagtgaaacagagcacaatgccatgagttgagaattgagaaatgaaaaggcaacaggatgagttgaaaaggggagtggatgaaatgaggttagttgcaagactctaaaaatgcaatggcaaaaacaaaaaaggaaatgcaatagcaaaattaacatccacaatgggggcagtaaaaggtaaaattgatactgtgggaaaccagatcagtgtgatggagaataagctaaagaaatgttttcagaatttagaagaaaaggaaaaagaaaataatgaaagagaaaccgtgaggtaaagagaatggaacttcagtaacaattattgattattcctgaataataaactatagtaattagaaaaaaataataaaacaaaattgaagaaaattactagtgcaggaagcaaaaaaaattaaaagactactgtatgaattgaaaggttaattgtctttcaggcaaaacacataagaaatgacatttagctggactcatcctggcaaagtttgaggtttaaaataatgatcagctatcatataagtagccatgcaagaaaaaccaaataaaacatacacaaagagcactccagaaaattacctagtaaggagcaaaaattacagttttttgaatcatctaaatttattatgtattatttagactctgagtcaaagagagtaacagagcaacacctaaagaattttgaggcaaaaattgtcttctaaaaattttatacctgaccaagttatcttcctaagataattaaaatatattatcagttatgtaagttttcagaacatactatgcatatacctcatcttgttttttcatccctttattactgcattttaattgaacaagccaagaaaggaattaaaataaaaaattcaacaatgaagtagaaatgatataaaactaaaatgtcactaatttgcagactattggtcaaaaattgagctgagttagtgtggttttaattacagctactttatcttttttttttttttttttttttttgagatggagtctcactctgtcaccaggctggagtgcagtggcacgatctcggctcactgcaacctctgcctcctgtgttcaagctattctcctgcctcagcctcccgagtagctgggactacaggcgtgtgccaccatgcccgggtaattttttgtatttttagtagagacagggtttcaccatattagccagggtggtctcgatctcctgaccttggaatttgcctgctttggcctgccaaagtgctgggattacaggcgtgagccaccacgcccggccctagatactttttaatgctgttttcctggttaaagttacagagaaataatctggccagatatttcctacagaaatgctactttaatgagtacttaagaattatttgttaattagcacctgaaagtactgatctgaatatgggcttttcctgccttcattgctgtttacatgaatgaatataaattgataagctggctaaggtatctcttctgaaattttaatatgctttatcattggtcagtttcaaaggtaaattgcagtctaatttaggcctatctagcatgagagtgactaagttattttaaagacctcacccagtcagatggcttctcttcttgctcttaaattgcggttttaaatagcagaatcaaaaagagaagatgaagagtgttgtattattgtcactgtaaatagacttatgcttaatagctcactgtgggaattcccctgagatttcatttatgggtacagtatcagaatgtcatgctgatatggatggccaatagataagtatatattaataattgatagtttcttaatgacgcttctgtctttgaaaaaatgattttaaaagaaggaatatctttcaatccagttatggatctctatcaaatataagtcagaggttaataggactgtgtcattgatactgtaatacaattgcaattgccttattcctactttacatttttattgaaagtcaacctagcatataattttaaaatgattttttccatcttatacatttaatttttctatatattagcacaaattaaactcatagcttgactgtaatcaacatatgtgaaccaatatctggttaccacagaaaaccattattatatgacctaatttgatatttaaaaaattgccattagtgaccttaggcacaaatagaaagggaatagccctgtaacagcagacttaaattgtaaaggaaaagtgaagttttttgtttttttttttcctaagagaatgcctatcagatagaatctcccttgctttttgatgaagtggggcttgctctgttactttgtagtgggagaatttctcagacattctgctgtagcaaaaaatttagaccttatcacctttcccaatcctataccccctcatttcctcattatttttcttagtggcttagagtgcatggcccaaccttataagcacacccccagcataccctcatcatatcctgtttaccttcaatcttactcatttgaaaaatctataatccggattaaactcaactacttgtctactcatgcctgtacactagcagctaagaatgattgaagaaaatcacagaagcctcccgtgtgatcttgcttgatgtttataaccacaaatatccaatgagcgctccgtactgtgctgaccaaccagctactacacttacctaggcagtttcatcttcgattctcacagtgcctctttcacctgttttcctctatcctcaaatcttgggcatccctctctaatcctctcactcagctgtctctttcactcagagagcaatcttcatattagccaaagggcatggtgaccttgctgcttgtttcagtataagacaacaaaagcaatcggaagaagcttctacattctcccatcatcaaatttctcaaaccacctccacttgaaactctactatactttctctcctattgcagtagaagaagtgtctgtgcttctaaggacaactcttccatgtataccttggaatctataacctcatacctactcgagcattttattactcagagtatctctcctccctcctgtgttacagttttccatttcaattgcttcatttccatcagtccacaaacatagtgtgctatcatctctcatcttacacgaaacaagacaaaataaaatttgtctttgtcttaaatctcctagtgtcactctatttttctggttctattttcagcaaaactccttggaagaagtctacacttctggttttcacttcctcttcctccattctctctgaaacacactctgccccagtgaaggaagtctaatcaaggtcatcagtaaccactgcgtcaacacatacagtggctaattctgattttttacttacataactcacaggaatgactagcctagtaaataaccttctttttcttgaaggattttcttaaaacttggattctgggaagtgacactcttacctttcttctgaccattctggctattttctgtttcttcttagcctcccttactggttcctcttcctcttcttaacctctcaatgttgaattcctgagaaatcagttctagaccatcttccccttatagtctacattcactaccttggggaactcaactagcattatggtggctttaaatacattctatctgatgttggtcccccaaatttatattttgagccccagtctctcttgagctctatattcttgtatctaaccacctgcttttcaaacttatgttaaaaaacttttcttgattttacctcccaaacctgcttctactcccttattctctatctaaataaatggcaccccatcatccaagacttttgtgttgtacaactccggggtatgttgttcttatggattaattggacctttgttagcatcttctgtgcatttttttcccatgggtatctcatttatttgaattggactaaaaaatgtaaaccgtttggtagctgtatttagctcttgaaagtttcagtctatctgggtagctgctatactaattacatgatgaaaatgaacagctaatattcttttgtttgagaaattgccaaagatcagagaaccatcttcatattgactaaagtgcataactcaaaaaataataattttaactttaacttcagatcttggaaacatttcagtgaagagtttttgatttaaaaagaccatcagttttcacttaccatttaggataataaccatataatatttttcgattccaccaaaaatggccacatttctctttgactaaaaagtagtaaatatcagcagctctttttatttgctgctactactgcagaaagcttcataaacttttcagccagaaatattgtaaagatcaaagagctttcaaatgagtttctaactaacaatgtagatactctgtctgcattagccaaacttgctatgctctgttccctagagcacaccatattctaagcaagacagggattattaaaaagttaaccgtggaataaataatcaacataaaatagtatgcatgatatgtgcataagtttttaaagctaattataaagataattttacctctactgctgttttccatatcatgttattttcccagactgtaattttgcctcctgccctgaagtagctgccatcctgaattttgtgtttatatcctcctccttttttagtagtatatactcctaaacaaaatattgtgttggttagttttgcttgattaggggcttcataaaagtggtttcattatgaaagctttctttatccaaatagaaatagtgtgtttaagtggggtaagcttggcagaacaatggaccattgtgatatcatttacatgcttatgttttttattgccttcagtactatgtaatttggtcttgtcactgattagccaattaggaattggaaggatgatatgtaaatgttactgtctaactgacagaatgatttattagaagtgtgtatttgtagaatttcacctgctttgttgtttgggaggctcagtgccaaacctaaacacaagggtcaatggcagacctgtggccagcggtttataagaaaattcagccacagttgaatttcattcaagtacggttttgtttgcttgccagtggtgccatgctgactttagaatatatttaccttttctatagtttccatcagcattgttgatttcagcatgtatggatataacccgtgggtcctgatgccacccactgacagcactggcttggtttttggccctgcttgtgctggtactttctattcttccaatgtcagtgtttctactctattcttactgccaaatggatcctctgaaccgtaagatttacatgaagagggcttccctttgctcttggaaaactgtgtggctcattgacctaggttgtttcctttgatttcagagatgggagaggttttgttctcattaaaaatattcttttgatttcacgattttgtcttaatgtgttttggatagaaaaatgctaaaaataatactcttacaaagaaagcagaaaaaaagaaggaactgatatttgtccatagctttaatccacaaaattaaaaagcattcacttattttaagaaataataggagtcatttttatgaaaatgtgttagttagagcttactaagtttaatcttctgatgtccttattctctttattttaaaaagcaagcaatatatacattgcaagcctctgtaaagattgcgtaagatgctaatggagagaagatagtaatatagtcatacttaaagtttattctctttttttttttttgagatgaagtcttgctctgttgcccaggctagagtgcagtggtgctatctccactcactgcaacctatgcctccaggttcaagcgattctcctgcctcagcctcctgaggagctgggattacagccactcaccactacacccggctaatttttgtatttttaggagagatggggtttcaccatgttggccaggctggtctcaaactcctgacctcaagtgatccacccgcctcggcctcccaaagtgctgggattacaggcctgagccaccgtgcccagcctattctcttatataattaatttaagctcactcttataaaattttcaagttttatttcatgtcatctttttatgcatgcctgagaggttatttttcatataattttttttgcttactgatgctttaaataaccagtgtaggtaatgtttattaaagtgagatgtcaggttgctggctttcattgttgaagagtctgttttaggtgaataaggagagaaaatgaggtaatgaggtggcgcatatagtagcatctcggagaccactgagaccaatgcaggaaaatatcctggagtgcacagtccatcaattccagtatgagtagcctgcaaggatgatccacatcaacattcacaacattgtgtaaattacactaattaagtaatcactttgtttttcttccaccattttagaagaatttccaaggaattattggttgggggaaagagggataagttggaatagacaaggagaggaagataggattaagggtctagattccttcagtgaatggtggctctgagcaggtagagatgaaggggaggagactggagactcttagaggactgtatgagggatagagctctgaaaactgggaagacggaatccagagtggtttgtcaggtgtgacaccgtagaaactgcctattgtgttggactttggagacttagggggaaagggtaggaagtgggtgagggataaaagactagaaattgggttcagtatatactgctcaggttatgggtgcaccaaaatctcacaaatcaccattaaagaacttattcatgtaacgaaatgccacctgttcccccaaaaccaatggaaataagaaattaataataataataaaaacttctactctaaaaaacaagaaaacaaacaaaaacaatcacttggggagtttttacaatttctaatgcccaagtttccctttatatcaattaaataagaatctctagtggtagacattggcatcagtatttttcaaagatttcccaggttattccaatgtgttagcaaagtttgggaaacagacctagcctatgctattcagtctcctacagtattaatatattcctgaaaatgtgtaagagtaaagtgatgttttttgctgttgtagaatatgttcatccctagagaacttaaaatataaatattttatagcttgctttatgacatattattcactatattgataatattttatatgactttattctttgtttacatttgaacacaatcttgtggatatgtggtgctaatattttcctcttttggcacatctaattagttccatgttttctcacaattaagtttataagactgaaggtttttattcttaaaaaacaaacaaaaaaaacacctattgtgactcctcaattaatgtccgagaaaatattttcagccggaagggaaggacttaaaacgtttcatgagatattaaatggaaatgcattgttcagggcctcttaggatatatatatatatataaaatataatatatataaaaatatataatatgatacataatatataatataatatgtaaaatatataatatagtatataaaagataatgttatataaatatatataatataatatatatagggtcatagaacatatcccaggggagattatgttaattgtctatcattgcatttaacatgtaacagtattctagataaaataatagtggttgatattgttttttcatcccctctctactcctttacattttgttttggttaacagataactgacttaataaaattaaaaagttagttatgagcagagacacatgtagacatgtcaaaatagtcatgcatttccatgtcaagccaaatagtcatgtatttccatgtcaagccaaaggcaaactaaaagaagcaaataaaactccatacaatggatttttactttatttttttgtttgttttatcccagaatcctgaagatttacattaggtgaaaatctagtgtacatatatatcttaggaaatggatattagagtacaatcattactagagaatctgttcttccagaaagtaccactaaattacacatttaaaaccagaacaaaggcaatgaaggaacagtcatttttattagttgacttatttatttgataaacactttctggataccagtgtgccactctgctagttttagtaatacaatgacaagtaacacacagctcctgccttcaaaaatattgtgatgtaatgggggtgtcaggcccaatcaacagcatagaagtatagtgaaagaggcatgtacaggatattacaaatgattaaaaactctaccccttccaattattgttggattctaaggtaacattgattagctaaattaagtccacccacattaggagccacactgctttgtggaatgtatatatacattctgcctttgccctggggaagtcaatggctgtatttagaagtacaaagttttagcactttgaggtcatttatagcattgacaaagtagatgtgataaatacagaagttttcttttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccattttagccgggatggtctcgatctcctgacctcgtgatccgcccgcctcggcctcccaaagtgctgggatagaagttttctaaaatgagctactgaacatccttcttcctgataagttctaacacaaaattgttcacttaaaggagcattacctgggcctttgaagaggtttggtcactggccaggattcatattagtaagtgaatgaaaagtactctactcaaaatgatttgccttcattttctgccctaaatggaaggaattgacaatgtttctgattgctgttgctgctggtggtgacaatagtggtggggatgatgggaagagatttctgtttttattttaatcaaccacagacttgttccccagaagccatgtgatcagcaaatttagaggtgagggttggtctatactggtttctgagaaagtcccctttgttgccttactagtccctctttgggacctttttaatttaagagtgaatcttgcagccaaccattctgtggaaatagaaatgatgctacaattaaaaatagaaacattgaaaagttaccgtgcttagagcctattacataaaagtctttacctaatattcctctcatcccttcacagaagtaaatgaaagactctgcctctcttttaattatgagggtgaagcttccttctgaccttgctatagtgaagggattcctttctccatgggagtccctcattccaggctaaagatgccatctgtgcagaaatatagtggttgtttgtcccaagtgggcattttgtagttccaaagacctttgagtatgtgacatttgttcaccaaagacctcttagcctttcccaggtgtgagctcttctgtttgtgtttttatgttttagtgctggatcagagaaaacatagaaactatagaataccctgagtgtagggcttatggctataatcccagtactttgggaggccgaggcagggaggactgcttgaggccaggagttcaagacctgcctgagcaacacagaaagcttcatctctacaaaaataaaaaataaaaaattagctgagcatggtgatgtgcgcctgatatcctagctacttgggaggctgaggcaggaggattgcttgagcctaggagttcaagactttgatgtgatgctgccactgcactccagcctgggttacagagcaagaccgtgtctcaaaaaaagaaaaaaaaaaaaagaacattctgaatgtgtgcaagagatatagctagtaggcctcgaattgaactccaaaggtgaggcttgtctatgctgggcataaaatggcatattaacagttaagctcaggtaaggtaagatctcatgattcctcccagctcattgctgcatttctacattttgataaaattttgaataaaaataagggcaacatggcacagaccagtgagatcatagcatagtagtgagggtgtggtcaagccagggtaagacagatggttaatggagcatcccatgccacaagagccagataaatcaaagactgagagaacgtacattacaccaccacggccagatacactgaaacagccttgtgagagcaaaaggaagaccctgcatggccctcagaagcgggtgtgagtagtgttcaagatgaggttgctgaggaacccatgagagtgagccagtagggcacaggccttcacacaccaggaagcgcagaaatctgttgtgcattgtaatgataatattgctcacatccttaagtccaaaatatttgtccaggagtatcatagctggaatgcttttctcaagctgactataaacactatggagagtgggttttactgagaaaaaactgccgaatgataccaatatttctcccacagctccagaaaaatgtgtccacaagcacagtcctatccttgaattggcaatataagcgaaggatcgttttaggttaggggatgtattgctgagttctctaacttgtcttttggacacttttgagtagtctgggttctgccatggggctttgctttgaaagttaagaacaaggtcaggcccctcacacagctgtcatatgcattcagtggtagtagtacatgttccttgaggttttagctgtgcaggcagccaacttccacaatgggcagatggcagaatcaggggactgacttttggaaatggatggtaggaatggaggccattatggaaatggtggcttttccacgaggatgcccaaaggtctggtgaatggttctagtgagctcgtgtgcttttcccctctgttctcattgcctttctgaattgttaaagattgaattgtgtccctctaaaattcatgttgagttcctaacctcagtactttggaatgcaaccttatttggaaatcagctcatttcgatgtaattaatgaagtttaggtgaggtcatcctggagtagggcaggccctgaatctgatgtgactggtattcttataaaaaggggaaatatggaaacaggcatgcacacagggagaacaccatgtgagcatgacggcagagatgggagtgatgcttctacaagccaaggaacacggaaggttgccagcaaaccaccagagaaaagatatggaacaggttctccctcacagcccatcctgccgacatcttgatttcagacttctggcccccaaaactgtgagacagtaatttctgttgtttaaatcatccagtgtatgatgctttgttatggcggccctagcagacaaatgcatggttatctgttacttggctgtctcttctagggcactctacattcattgaggtcagggactgtgtcctgatcatttccaaatcctcatcacatacagcagtcctggtacacttaggcctccccaaaatatttaccaaatacaaaaagtagatatgttgatttctgccaataaacatttagctatctctcaagtaggaaagcatatatactgttttcccaattctcaaactcatttcagtttagcaaccttgaccttgggttaggtttggggtgacttccctgtgtcttagtctatttgggctgctataaggaaatatcatagactagacggcttatcagcaacagatttatttctcatagttccctcaggtgggaagtccaagataaaggtacttacagattccttgtctgatgaggacaaggaatgatggcttcctagttcatagacagtggaagggaggaaggctctctctcgggcctcttttataaggacactaataccatttatgagagctctaccctcatgactaatcacttcccaaagctccatcttcaaataccctcacattgggtgtggagttgcaacatatgaaagttagagagacacacacattcaaaccatagcaccttgatcagttcttcgtctccctaagtcccatcaattaccctcattatactgtatttaaaaagttaagcctaacaactttcatagtatccacaggtaaatgaagtttttataacgtagcactgttttaggaaagccttcattaaaagaatgtgtataggcagtatcaagaatttgattaagattttcttgagaagaaaagaaattacttaattttcacacaaatgaaggatattttaatataaagatacctactcattgtgaagacatgtcctgaataaatatggaatataagtggacaatttatttagacagataaaagtctccaaaacatattaccatagatgcagacatctgtcttctagattgtagaagctagctgtataaaattatggtgatatacgagtgaactgagatatttttaaactataagtgaaaatgtaggtccttaaaagtaaactagaataaagcttccttcataactgcaagcaaaaaaaaaatatgccaactggctatatctggaaacctcagtatctatttacttgaattttaacctttgtgctaaaggtctgggaagcagagggaaaagaggctgactggaatgagatgacacaggacaggaaagaggggaagaattctaggtcagaggtggaagggacatattctgtaatagttttctgggccctcgagttataagtcatttctgaaagcttagagatcaactaaaatatccttccactgtgataaggtggaaacatttttaacttcatttatcttttgtgtgttccattttctgtggtttcttgtgtttcttctaacagagggaaaaaaagaattctttattaaattcctgatctagttaaatatatgacagacagcatgattttacataagactttctctggaaactgatttgcttgatttactgttgttttaagttggcttatatgttttgcttaaacgtttagacctgtcaaaatggccacccaaagctttgatgccagattgcatctctcaactgacagttaagtaaaacatagttttagaatataggcaaggtcttaccctatgtaacagaagcgactctgcagcacttttctctactgtttgtttactgcataagcacattgtaacgggtgtgatttagaagcactagactcaaatctgtttaaaaatcattccagatttactctactaaaaatactaagagaaaatttttctttaagatttcttacttgcaacatagcatttaagaaaaattactcaatgtaagacaatatcttgagaaacctaaaaccaagtgaaaagacttggaaaacatctcctgaccacgatggtcaaatgtttgtggtgtctatttgatagcacaacaagcgaaatagaatgccttaacttttccttttccctgatctaacctctgtttctaggaataaaaaacagaagggcagtttgcagctcagagatttctcacttaacaacttcagctgggatggggcccagaatctggctctggtgtataaaattacacttttaactgtatgtgaggatattaacacttgccttcgccagttttcaacagacacatatatgtgggatgcatgtaggtatttaactttctaagatgtttatagttagaaatgcctttaaaacccctggactatgggtgttttcctgtggaatgccattatcctgtttatttgtttatattcaaagcagtgcacacatcttacatgaattgactacagcttacagtgttctgtttatttgtatatttttattttcaaagcaaaccaggtatacggagaagtcttatatgaacagctcaatgagtttttaggaaacacatctgtgtaaccaccacccacatcaacatatcaaacatcaccaataccccagaagctactctatcccttccgtgtcattagccccttaaaggtaaccaccattctgacctctgtcactgtagattatagctgctcattcttcaattctacagatttccatagaaattcctatggtattctgtaggaatcatgcagcttacgttgctgtttttttttcccctagattcttttcttcagtgtgcgtctgtgaggttcattcttgtggttgtgtgttctttttcattactatacaggactgcatttgttctttttcattactatacaagattccattttgtatgttttaaaatttatactccattctattgctgatgcatttctgtgttgtttccaactttcagctatcaagaataatgcttctatgaacgtgcttatacatgtaacattggtacacagggatatgcatttctggcgaggaagagacttactgggttatagagtccacatatgttcagcttcgtggagactgccagttttccaaagtggttttaacaatttacattccctgcagcagtgtttaaaagttccagttatcctgtgtcctcaccaatgctttgtagtgtcaacgtttttttctgatttattattttttttaattttagctattctattggctatgcagtaatcttttgttgtgattttaatttggatttctctgatcactagtattgttaatcatttttatttccttacctgccatttgaaattggtctttttaatgacgtgtgtgttaaagtcctttgccgtttaaaaatactgggtagtctttcttttactctggcttgtagaaggcaagttttaaaaaaaatttgttcattttcagttatatacatgacaaatatattttctttctttatggcttatcttccctctttatgacatcttttgatcaactgaagttcttactttcaatgaagtttaacttattaatccattctattattgcattgttgttttttgtccttttcagaaatatttacccaatccaaggtcatgaagatattctcctctgctatcttctagaagctctgtcattttgcctttcgcatttctggtctgtctgggagtaatttttttgtataatgtgaggtaggaggcaaggatcattttttctcacatgggtatccattctttttcccagtggcagctttgccctatagcagttgaccgtttatgtgtgggtctgtgtctggactctgtgctgccccactggtctatttacctatccttgcactgataccataccattccgatgactataactgtaaattaaatcttgatatctggtaatataagttctccaactttgttcttcaatataattttttttattcttgagcttttgcatttccatgtaattttagaatcagcttgccaaatttcacacacaaagatttagattattaattgggataataatgaatcaatttaagtagaattgacatttttcaatattgtaccttccaggaacctagtagatgcctccatttcttaagtcttctttcaccttgtcagtaaagttttgggttttctttgtggaggactgcacatcgttcactggctttattcctagttatgtgtcctcttttcagtagagagctgcttccagtttgtataaaagcaaaatcttcctttacggtcacacccttaaacaaaacattatagaggaactattttgaagctgaagagaggaagtgcccttgaaccttgaggaggaggtgcggagttttttttggttgttggtttgaggtaggtgagatgcagtatgtcttgtccagatggaatctttggaatatccttaaaggcagcagatgtgtgtgggaagaatgacagagtatatcgagaagcagacttaatgcattgagtaatcgcatagttgaatgaataaaccaatgcatattttaagtatctgaagtacattcattgatgcaaagcaaatgaccattctaaacataggttatatcctggatttaccttcttaaatctttgatttaccatccccagttgccagagatgaagttataaattaaatgattaaaatattatcaaggtaattgatggtttagatttaccaccaattatatttcccattaaataagaaacattttgaaatttaataactcatgtgtgagtcagtgacagcatactgttttagagttaaagtctcttggagttcctgctggttactactctgtttttcttttctttcccaatcatgctttgggaaagaatattccttcttgctgacaccagtgtctcagctccaattcacttctcataccagcccctgactcctgacatccatcaaaactgttttcatccttaagacccaaagacctcataattgccagattcagtaaagaagttttcttcaagttctttcgacatttgagattattgaactattccttctccttaaaactcttcttttgcggctttcttgatatttattctcctttcctggtctccttcctacctctctgactctttctcaggctgtcttcattccacaaatgttgttattgcacatggcctgcttcagactcattgcttcttcattgtgaattctcaatctggtggaactcgttcactctgtggcttcctgacaatcagtcttctgacgtttttgaaagcttatcctgaaatatcctacactacaaacacgtatatccaactacctgttggacctctccatttgagtgccccagagacacttaaaacttaacatgtcagaacaggaaacatcttaacatgttctgcaccttggtgaatgccaccctttctcctgggccagcagcctggaagtggttattgactattctctcttttttgtttccccatgtctagtgaaaacatccaactcgtcttcctccttaatagccttaatatgtctgcagtcttgaccctcttctctatatctctctcttttttctgttcccaaatagccttacacctggctttttaaaacaggctcctaactggtctctctgcccattcaatatggtcatcctccaatctcatatctgctttcaagatgatctttccaaaatgtactacttctctatttaaaactctacagtggttctatttttccttcagcacaaaagccaagaccttcaatatggctttacaaacctagccataagggagctccttctgcttctctagtctcctcttgacactaccccttttcacctgcctgacctgttatccagagcccctgcagttccttccatcactctgtgccttcccttcataaatactctgcttctgcccagaacagtcacatctctatccacaacttcttctgtgggtggtttcttactcattctccaaaacttaccttggttatgtcatgctctagggggaaccttttctcattcccctgcacacaccagtctggaatatattatattgcattatatgtgtttctttatctcactctgaacttttcaaaggcgaaaaacacattttttcacgtttgtatcctccctctgcaggtacttttagaaataggcactatgttaggctctagagatgcaaagatgaataagacattatccctgcctatgaggctctcatagtatagaaagtaaaacagaaacatcaaaagatagttaccgtgcagtttgacaagtaccagatgacaggtatttttaaaacatggaagatagagcacctgattctgggtctgagtgagttctatttaagtgtatacaaggattgtttgagaaatatggacggacaaataatcctcagagtaaatatcctctccaggaaaactcctggcaaccccatcacccatttcaccagttgatctccagagactgtgcatttttgatcctcacatgtagagaactgcatgggagataaaatattaacaaataggacccaaacatgtaaataaacatgatatggcttggtgggagaggtaaacgtattaagccatattttaggacttagttgagacttgaaaaaataagcatcttattttgtgtgctcaggagctgtctgacaaaatcctaagcctgactgagatcatagtccaccctgactttgtctaaaaatgttgctgactgggcatggtggctcacgtctgagatcctagcactttgggagactgaggtgggaagatggcttgagcctaggaggttgaggctgcagtgagctgggatcacgccactactgcactccagcctgggcgaaagagcaagaccctgaaagaccctgtctcaaaaaagaaaaaaaaaaagagaaaaaaggcgtttgcctttatggtaataagaacagcctaaagccttgaaagattcattctactttttcagatacaatgttaaaaaattattaaagatttctggcggggcgtgggggctcacacctgaaatcctggcactttgggaggctgaggtgggcggatcacgaggtcaggagttcgagaccagcctggccaacatagtgaaaccccatctctactaaaaatacaaaaattagccgggcatggtggcatgcgcctgtagtcccagctacttggtaggctgaggcaggtgaatcgcttgaactcaggaggcggaggttgtggtcagccgagatcacgccactgcactccagcctaggcaacagagagagactccatctcaaaaaaaaaaaacaaaaaaaaagttacagatttcttttttccaaagcagattcataagctgtcccttacgctatgaaacttactggaacgacttttaggtttggtgagttttcttaggacagacaaacactgtaaatgttttcttaacctagtccatgtttatcttatgtaaatgttttcttttttttttgagacggagtctccctccgtcacccaggctagagtgcagtggcgtgatctcggctcactgcaagctctgcctcccgggttcatggcattctcctgcctcagcttccggagtagctgggactacaggcacccaccaccacgcccggctaactttttgtatttttagtagagatggggtttcaccgtgttaggcaggatggtcttgatcttctgacctcgtgatccgcctgcctcgacctcccaaagtgctaggattacaggtgtgagccaccgcgcctggccggaaatgttttcttaacctgttaaacaaacagaatttcaaacctaacaaataacccaaatacataggtaactgctttcatttcatggccctgaatggctggaaagttagtagaaaagtatatcttcaagctgagctttcaaaacacatatctgttttcaaaaatcttgtacaggtgaaatatgtaatgcttggttttgttttggttttgtttttctcctaaaaaaccagtgtgactagtttaaaacaatgctaaataattcctaagggaaaatgctgcgagaacctttcacctaatgagtttactgccttagcttgctgttttagttacatgttttcaagaagttctcagacgtatgaatggaagaacatctctgattccactttaaaatagatgggaaaaaaatgcaccaaggtggaagtggttggcaggcaaagaagaagaatatgaacaatatgagggcagcactatttttattttattaaggattagacatagtgcattacaattggaataaaacgttcaggttgtaagtatgtatttttccacttgaataagtcagttaaacttagaaactattcaatgggtgtcagcttgcaggttctggatcaatagaacatagtatcatggcatactgtctaccattatagtatcatgattgtcagttatttggagtattctggctaaatgctttatttctaaatcattatttcttcttatgtgttttaataaatttgaggttatgttatatgtaatatgcttttctgtgcctctacttcttcatttgtgagatagagatagctggagtcctggctcgtggagttgttacgaagagtagatgagaggggtgactaaagtgcccagcacagagcctggtgcccagtcagcatccaagtagggtttgttgttgccttacttgttttttatactttattatacatcgtgagcattttctcaagttgctaaccattattcaaaaccatgatgtctcatggatatgtaacaacccacttttctcttaagatttaaataatgtcattttggtcagttttgcaatttccagattggcaataacataaattccactgaactaaacattcttatgcagaagtctttgtgaccaagtaagatacatttctaaaatagaatgattggtcaaaatgtatacatattttaaaggctttcattttcattcatatgtccaaattccatccctgaaagattgtagccatttgaaagtacccctttctcttgccatgtttaaagaagaactaaggaaatgtaaaagcatgtggcaaaaataatagaaggctggaagttttagagccagaatatttgcatttatttattacttataccatggtatttatttataccagggagggaagataaataaattcctataatttctcatatttaaaaggagcttttgtgtgataaagtaaaagcactgcattgactttaagcagcctgtttcttatattgactgatacaggattaaacaccagcttgaggaagtcactctacctctcatagttacagactcacaatttgcaaaacggtgatatcatacgtatactataggacttttgtggcagttaaataatattctgcatgagaagcaccaagcaaaggtcttggcacatagtaagcacctgtagttgatcacaggcttattgaccatgagtatcatttttgctgcagagccagccttcagctttcctcgctttattgcatctgtagattcataaagtagtagagttcccgacaggtgtactggctgtgtcctgaatgaggagagggcagaaatccatgacatttttcagctgtaatgtcaacacacttgatggtcctggttagcattaacatgacatagttttatgacttgacttagtgcacatctagcccctgctttgtgtcagacactgaatcaagagttggtgatacaggaatgaataaaaggtaatctttgtcctcgaagggctcataatctagacaggaagtgtttaccatcttttctgggtgaaattcttcttctgtttatacttattgaacattcatttgtgctgttcccgtaagacatgcactggtaggtatttggaggtgaaagtaagtaatgataaagccagactgtgcccctaagatgtttagaatgtggtgggtagttcagttaattggcatgctgtggtaggaaaataatgggctttcagtcagaagaccttagttcatattcaggcctcaaaacatacttgtggaatgatgggttgggcagggaaggcccttgtgttctaagcaagaaaatgaaaagagttaaaatccagttattcattcatccatttggcaagtatttattgagtacctgggattcagcagggaataaaatatacaaaaatccctgccctcatggagcatagattcagtgggggtgacgaaggatgtaaaaactgctgccatgaaatttttaaaaggcagtgaaggaagctatggagaattggggaggagaggtggcatgtttacagagagtggcaggagaggcctattttgccaaatccctttttaagccaatggggatggcaccaggttcaagaggcagaagagacccagagccagcacacgagatggggttttattggggaactttcatactggggagagagtctagtagtggtgggatggacaggagaaccaccttacatacagtccaggggcggcaagtgggctggacaggaaaaccacaatggcttgtgaaaggcatccagtttatatagcattttcacttaacaccctctccataatgacctccacctggcaaccttcatgcaatcccaaatcggggccttgattccatgggcagcctgtgttgcataggacagtatgggggctcagatgttcctcatcgacaaggaacgaatctctgtttcgccattcccggattccctagctcagaacacacattcagtgtgtctgccgtacagggtctttctcagggtgtgcttaagttattgctgtcaggtgcctttaacatacagggcctcattacaaactaacatttgaatgaagagctggaggaagtgagggtgcagttcaaagagacagccccaaacccaggagaccagtggcactggagcagagcgtgtatggggtgcagttagggggaagtggcagtggcaggaggcagggaagggcctgtgggacatgttgataaggactttggcttttactgggcataagataggaagcctttgaaggagtgtgaacagagtgatggaaggatgttcccacaacccagggagatgtggaccaatgagatagcagtagatgtggtgcacagggtcagattatggaggttatttttaaagatagagccaacaggatttgctaaagaatggcattagcagggtttagagctgagttactatgaagcctgagtggccatccattgagatgaggatgacggtggaagaagcagattgtcggggagagctcaaggagttcagatttgcaccagttaagtttgagatgcctgtctgactttcaaatgcagaagtctggctaactggagttcaagggagaggtcctggctgaggacgaaaataccaggatcattaacatagaggcagtatctaaagtcaagagtcgatcagatctctaaggtagtgattgcagctgcaaaagagaagagctccaacgactgagcattgtggtaaactatcatgtagatagtagttataactattatgcacttctgggaaaatgtggtacctcatgaggtaccttcactctgttcactgtggccgcctccaaaaacattgtgtttgtttactaaatgctgtcttcatgacatgaaaaattgaaggttttttcctatcagggattggattgattcaggcacaaagataatttgggcaccactggagttgggcataggcagttctgtgcaggatgcttcacaatagtatttcaacagatatagtgatctcggcttctgattttgttacataaaaacacattgattcagaaaaggacaaaagcaatgtaggtccacaaagattaaaacatcactaggccgggtgcagtggctcacgcccggtgagcacatcatgcccggtgagcacatcatgcccggtgatgtaatcccagcactttgggaggccaaggcagtcagatcatgaggtcaggagatcgagagcatcctggccaacatggtgaaaccctgtctctaccaaaatacaaaaaattagccgagtctggtggcaggtgcctgtagtcccagctactcgagaggctgaggcaggggtattgcttgaacccaggaggcagaggttgcagtgagctgagatcgtgccactgcactccagcctggcaacagagcgagactccgtctcaaaaaaaaaaaaaaaatcactaaaatggatgtgtacattatgtacagcatgctttcaacattaaggtaaaaaaaaataccgaaagattggacttaagacgggccagtttttctaggttaaagatgcctttcagaaaaatgtttgttcagccatgctttagcaatcacttatgtgtagagaacttttccacgtctcctgtatttattcaatcaacaggaattagcttagcagcataacccaaagacttatcatttatgttgccttatgactgatagtgctaataagtaactaagtcctatgatcctattaagaattttacaacaaagaggggcttgagtgacctaaataaaaatcagtgccaaaaaattcctatatggaacttctggagagtgtcccaaagaaagaattttctttttttttttttttgtctttttgagacagggtcttattctgtcacccaggctggagtacagtggtatgatcatggctcactgcaacctcgacctcctgggctcaattgatcctcctgcttcaggctcctgagtagctggtactacaagtgtgcaccattgcatccaactagtttttctattttttgtagagacagaatttcatcatgttgcccaggctggtctcgaacttctaggcccaagggatccaccctccttggcctcccaaagagcaaaagaattttcaaagtacatagcgtgcttatcacctgctgacaaatttctcagatcatgtctgggagcacgctggctatgtggggattgtagatttttgcctataaatgctcaatttaagtatcaaacactccataaaccttgcggtgcatctctttagagatttttaaaggctctacaattcaaaagtattgtaataattttcaaagtatgccacattctcaagaggtgtccatctatggggtgatacttgggtagggggaataaagtccacttctgaattgtgggtaataaacacaagtccaaaagtgcacaggcaggcagcttgtacttaccttaacagatgcatactttggaagtgaacagcattgaagcattagggctttctacactccagtggcagcgtgggccttacaaaactgtagggccttcacctaagacaaagataacacttttgtgtttgcagtaactcatggacactttggacttagtttctaaggggcttatcccttctccactcagtgtttctggacttcttcctggagtaaggaccttgggaagaagccttcgttcctgtctgtaacccctatttagtgcactgattggggtgcttagcacaatcacacataacaaaggaaaataatgccactaaaaagaaagattgttctgactcaatatttgagaaaatttcattcaagatattttgaagtcacagaagagaagttggactttgtatatttaccaaaacaatttgtcctgggctcagtgttggtaatattaatatgtccttttttatttttatttttgagatggagtttcgctcttgttgcccaggttggagtgcaatggcatgatcttggctcaccacaacctctgcctcctgggttcaagcaattctcctgcctcagcctcccgagtagctgggattgcaggcatgtgccagcaatgcctggctaattttttttgtatttttagcagagatggggtctctccatattggtcaggctgatctcgaactcccgatctcaggtgatctgcctgccttggcctcccaaagtgctgggattacaggtgtgagccaccacacccagcccaatatttccttttttaaaataactgaggcagatgttgtgggtattacatataaacttcctcatagacaatctgtaagttggcagaatttgatgaacacctttggataatgtattagtccattctcacgctgctaataaagacatacctgagactgggtaatttataaagaaaaagaggtttaatggactcacagattcacatggctggggaggcctcacattcatgatggaaggtgaaggaggagcaaaggcatgtcttacatagaggcagggaagagagtgtgtgcaggggaactcccctttataaaaccatccgatctcatgagacttattcactatcacgagaacagcatgggaaaacctgcctccatgattcaattacgttccaccaggtccctgtcataacacgcggggattatgggaactaaaattcaagatgaggtttgggtggggacacacagccaaaccatattagataatattttcagttcagctctgggattcactgtcaattatggcagaaaagatggatagagttgtgttgggagcaggccctccataaactggccccaaaactggccataaacaaaatctctgcagcactgtgacatgttcgtgatggccgtgatgcccatgctggaaggttgtgggtttactggaatgagggcaaggaacacctggcccacccagggcggaaaaccgcttaaaggcattcttaatccacaaacaatagcatgagcaatctgtgccttaaggacatgctcctgctgcagataactagcccaacccatccttttatttcggcccatccctttgtttcccataaggaatacttttagttaatctataattgattaaaacaatgcttatcactggcttgctgtcaataaatacatgggtaaatctctgtttgaggctctctgctttgaaggctgtgagacccctgatttcccattccacacctctgtatttctgtgtgtgtgtctttaattcctctagcgctgctgggttagggtcttcccgaccaagctggtctcagcagagttgctcttgtttgcccagtatgtcttcaagtatgtgatttcttccagcatttaccagtttgaatcatcatctctcaggtgctgctctctgatcaagttgaacatatcatgtaatatacatatatttttcaaagtgcctgagcataccacaactttacattacataatccttttttcccaaagatcatttatcttcctttcccttacttcccttcctcctttccttccatctatcctttcttgtttatctacagacagaattgccacaaagatgtcactgttagctatttggagaagctattaaaaccatttgctaggagcaattccagtgtgtgtctggttagcaaccagggctttctctgacaactggtagaagggtccagttgtgcatgtcttaaccattcataaaccataggtattttattttcactagtaaaactgtgtgataattatttcaaataatgttattgttaatgactgatttttaaaacacttctcaggaaaatattacttggattcacttagaaatttataaacatcttttcactaaatgtaatatatcataccaagttttatgtcaacttgtttttcctcgctatctttaaaagttagtataaatttagtaagcttcctaatgtaaaatttaatatacttcctgatttctaacaaagcacagtttagttttgtttatggtattctggtgaaaaaattattgatagttttaaaattagtgtaccttataaagcagcataaattatgtattttctttgttctgagttcttagagctcttagtgctatttcttcctgattttagatttgtaaattttgtttgactttttgatgtgtgggcattgaattagtttctcttaggagaagtttccagatgagtactgcttttagaaaaagaaacatatatttttattaatacctgttggaacttctctggaaggttttggatttgttttctttcttctgtctactacaaaagtgatgagactagccttatcctttcatggagtgctttcatcaaaaaaatgtttgttgttctgtccatgtacaactttgactattgatggttctatttattagaatttaaacatatactttgtatgtttgtaagaatagaaaggtaaaaaaaaatcaaaaggatatgcatcactttaatgtaactcaacagaaaaaatgccattgtttatatttctgttgatgcaagatactccattactattcactgttttataaacatacagtttatattaataattgtgtacatagttgatagatttataaaatctctaatttttagaacatatgtttctttctattcgattctaatttctcttaactattttcttgccctacaatttacagtaacataatgggtacatgagattagttcttcatagtgtttttttatctcctcaaatccactgagttttatctcatccacctgggagcttactaccatggccacccctggatttcactgtcattgagaacagcttgacctttaaaaccccctactggcaccacagattcccatcttttagtttgttccctcccaccatacctgtgatctacccaagcacccttgttttctctccctcctgactccatgtttttctttaatcattctaagccctatgatctatctctaattattcatctcctgataccctcagtgccccagtgtcttgttgagcttccttacaaaccctcagacccattaattcccattggcatgtcctataactatggcactgggcactgttgaaaaaacaatcctgtaacaggtggaaatatactattatggcatccttccttatggggccctccgcatttcctggctgtccttctaccagtcccaagtcaggtcccctcccactccactcagctgccttcactgctatattaattctgtaattggtaaatatgcattaatactacatcccagatgtgtgctaagctctagggatatgatgttgaaataaaaactctacccacatagtctgcaagagagtcagacacttataaagtagcaacactaatgatgatttcattacacttgaatcaagcagtgaaaaacaaaatgttgcctgagaatagattgagatagagtcaggcagactctaacttggctatgtgcaggcttttcttactattattgccttacttttccttattgtttactatatgtggattcctgggttaatattgttgtttctttcatttcttttcaaaatttatttaaatgacattatactttttcagtcatttatatcttgcttttatttttcaacattatgcccgtgcagttcatccatgttgatacatgttactttaggcagtttgttttccctgctgtatatatattttttaatatttctatttatttatctatggttgagtctgtacatatttgggctactttctattttttgttattctttatagaattctgatatgagcaggaaagatgtgataaagattggttaattttcaatatacagtttaaagttaccttcagccattcactgtagccttctttatctaacataagcatcacacattactaataaattagcccactttgaatgttctaccatatttaaaacaataagataatgtcttcataggttttcctgatctactttctttggaagaggattgaaaataattaaatgtccaaagtcagaaagacagaactcagactgccagtctgaataatttaaaagcaaatgttttaaaatgattcttctgcagttcataagaagaactgaaatagtgtcagcaatgctactaaaaatcaacaaagtcatggtgaattacatgctatcatatataacatctttcagttccaaatcacccttcaacaccttctgttccttagcagactggattttatgagcatttctccttcacagaaaggccgatgttgagctttctcagtaaagagcgctgaagggccattgcaggaggaagggcctctcttactgttttcagctgctgccccactcatcagtggtgtaggtgtaaggacatccagtgttgctctgccccagccacaggcaagggaatgtgcagtccctcagtgacttcacagccccagcctgttccggtgaccactttcctgcagccctcccaacgaggacactacatgctccaggtctcctgcccacggtggaccgtgaactccttctgtgcacctgctcatcggtggtggctcacttgcccctgggaaggctgcttcctgcttgcccagctgctgtggctcttccagcaggctgcaaacacaccttttccagtgaggtcttgtattagtctgttctcacactgctatgaagaaatacccgagggtaatttacaaaggatagaggtttaattgactcacagttccatgttgctggggaggtctcaggaaacttacaatcatggtggaaggcaaaggagaagcaggtaccttctttacagggtggcaggacaggagtgggtgcaagtgggggaatgccagatgcttataaaaccatcagatctcatgagactcactcactatcacaagaacagcatgtagaaaccacccccatgatccaattacctccacctggtcctgcccttgacatatggggattatggggattacaattcaaggtgagattttgggtggggacacagccaaaccatatcaggtctgaagcccatctttggggaggacgtccttttccaagttttgtttttttggggtactcttcctgagctccagggtaccttttatactttatatttcatttaggtttcagagttatctagctctttaatgatatttttagcagttaaattatcttctgttgaagaaaattgttaccatgaataaaaatttagtgggacaaaatattttacaaagttagaaaatttactgcacttcagaacatgatcaaagatgcaacatcttttttcccccagtaattgcttatcactattattgtgcttaaatctaaatgtcatatacttagcaaaaggagatactgctaagttagaggttaggcacttaaaagcatattcacctttgtagcagagtgcatactggtttcatagtgtgcctttctgcattagtagtttactaagtgctttgtacatagcaatcaataattatttgttaaaaaaatcaatggtatatttaattcagtgttcaaaaagttcatgctaatattaactatgtaaaaatctttaagcttgtaagatttttgagtagctcatagagtcagcatctgctccacccgggtagctgaggaagctcagtcagaacaccctgggggggaattttctatcataatttgcagattagaatggagtctctggggaggtccctgctgtgtgtttatccagcaattgagggaacatggcgtgactgtacccattactgtgtgaagaatatccaaatgccttctttagacggttgttgttcttgctacttatatattaaaagcaattatgtgatattgtaatgaattatgttgacaagctttcattcccaaagctgcttatctatgtacattatttctgactggaaaacttatgttttttcctgcccgtttgaatgaattgcttgccactggtgacttatggcctgtttcatcgattttcagtaatgagatggagcagtatgaggtaaatatctatgcacaaaagcagggattctaaatcacattctgcaaaccacacatttgatggtgcagttagcccatctcctcaaaaatgtttgtggtgaagtttccttgaaaaagcttgggcttaaagcatgtcacttagatgacagatttagaaagaatttcggtcattacagtgagaagtcctctttggctcagtcaggctaacccgctccaagggtaggagaggataattcaccaggcggtgcatctaatggacatcgtctctggatgagggaggtagagagagcctgtggttcttttaaatgcattgatttctctacggagtagcattcaaatatgtaactgatcatggactccaggtaagtgatgatggactcccctggttgtagaattgctaccgggtgttcagatgtctcaggcaaggaaagcagtgaaaacagaggcaaaggaaacccttgtgggattcactcatctggtttcatactgagtcactgtctcacggggatgaagtaccgttggagttcactcttgataacagggagaaagaattatgcgctgttaaaaagaaagatgtctgtggaaagcgggggatcccttgaagatggtgttttatagaactgctattttatggctcttatatcctttccatgcattatttaacttcttttagtctttgctgaacatggatactgcctaggttggtttccagcaagaactgcattgaaagtttgatgaactgaaaacaaaataactttttatgctataaagtacctcatgatatgtgactgtaggtgaaatacaggaaggtctcaagctcacaccatttctctgaatgtgctactttcatttctgcatatgacaaactactctctcttttatgtgtatataactatgtatgttttatatgtacatatcatatatatcatatatatctagatagatatatatagtccctacttgtgctcccctactcgggactatagtacctatatagttggtactatatattcggtactatatagatactatagtcccaagtaggggagaagaagtagggagatctacagagtaatatctatctatctagacatatgtgacttttatagagagattttatatgtagatagactattcctctctggattacatataaatttattaaatgtcacataatactttatgttctctagttagaaaagagaccaggtcgatttttcatttcttccttatcatttcccctttaattaatggttttatcctcatatggggactcttccaggcctttctttatgacaccaataaatctcactgcctctttcccatttgttctctccacagttttccttcattccatgatccatgtcattccagtttccattgctgcccttctcagcattccgtcttcttgtttcttctgtctgctgtgcctaaaattaacttgaaaacatgaaccatcttcaagacaaatctatggtgttctttacattaattttataaaagtacaccataatcaaaatgtggaacaccttgactaccagtcactggggatatggccaaaggtcaagacaaatatactctggccttttaaaattcatacaaataatgattccatttttatttaaaatgctgcttttcttatttgattaattcttgtgttttgcctgagtttagtcaattatgtagaaatgtacaaattagcaactaattaaggacataacttgatattgttttttggtgctgacctttcttgttttttttttgagacagagtcttgctgtatcatcaaggctggagtgcagtggtacaatcttggctcactacagccttcacctcccatgttcaagtgattcttatgcctcagcctcccaagtagctgagattacaggcatgcaccaccacgcccagctaccttttgtatttttagtagagatggagttttaccatgttggccaggctggtctggaactcctgacctcaagtgatccacctgccttggcctccaaaaatgctgggattacaggcatgagccaccacatccagccataattaaatttagttgaggatattgaagatgatgtaatgggatgaaataaaagcaattctggataaattatatatgttttaggaataaatggtagaagtctaatgaatttgtcctatattacaaacaggagtgtaatagtttagtgcattccagagaagaaaaataatagactattacattaatttaatcaaaaccaattgtgcatttcaaaaaagataaagacatgaatggaatttgagtatacttccatacttgcgaaaatgaatttaaaatctaacatgactcagtaaatcagctatgatttcctgacagggagagttggggaggtgtagaaaaaagatggagaaggaattaaacagtagagaagattttagagaaatgaatactgagtgactccaaagtaatcctgggatttttgttgttgttgttctgatctattcctatttatatttcttggagagacatgatacatttgaccacttcatttcagcatgcaacgtaaaataataagagcaactagcctgctaagaacccaaagccagatggtgtatatgtgtgtcatgctgagttgatggtttggaagtgccagctctgcagaatggctggagtcgaataatacttcaaggtaatcctgcttaagatccacttgtgcatctccatataacttttacatttttaacagttaagttaatgaattttaagttgcagtggtcagcaggattcatgtaggcaacagaaaaacacacataaaatgtctgtaatgggatttgttaactgtcagttcaaatcaaactcttataaactgacagaaacctcaagtgttttaatagtattggcaaactgcttcttaaataagcaaatagccaaaagtgagtttatgcttctttcctgagaaggatagactgtttcatcatttttagagattatcttttgaggactaaccagtgtgagttaaagaaatagtagcataacccaaacatgtcctctttgtctccttgtgtttagaaaataggaaaaaatggctgggcgcggtggctcatgcctgtaatcccagcattttgggaggccgaggcaggcagatcacgaggtcaagagattgagaccatcctggctgacatggtgaaaccccatttctactaaaaatacaaaaaattaggcgggtgtgggggcaggcacctgtagtcccagctatttgggaggccgaggcaggcgaatggcatgaacctgggaggcggagcttgcagtgagccgagatcgcaccactgcactccagcctgggcaacatagtgagactccgtctcaaaaaaaataaaaaaagaaaaaagaaaataggaaaaaatcattttgtagtacctcctttccctgacctccacgtacactctttggggaagtcttcttagcagttcaggtgaggtgggggctgtactatagtcccaagtaggggagaaccagtagggaggtctacaaagagtgacaggtaatagtgaggggactgctgtgttagatgacaccattgggtaagaagatgaatcaactgtagaaaagtataagacttcatttgtacatactgttaattatataaatctgagaaagtgttgcttagactattacatttagatttgcagaaattattttgttttttcgctctcctagaattcgagattctgtttttccctttttttcatgttaagcttccttcctattcctatttcttttcttttaagtctttataaaagcaactgtttcacaagaattagtaaattacttatttatacaaaaaattgttgagtaatttagttaaattagtttctttttcctctattttgaaggtctgatattaggtacatctatatttaagatcattatttcttcctgattaattgattttttatcattatgaaatgttcctctatttttggtaatattccttatgtaaatagacactttttttttttttttttggacgatgtctcccttggtcaccaggctggagtgcagtggcatgatcctggctcactgcgacctctgcctcctgggttcaagtgattctcctgcctcagcctcctgagtagctgggaccacaggtgtgcaccaccatgcccagctaatttttgcacttttaatagagatgggggttcaccatgttggccaggatagtcttgatctcttgacctcgtgatccacccatctcagtctcccaaagtgctgggattataggtgtgagccaccgcgccctgctgatagatactttaaaaaaaattaaagttatctttttattgagatgctggctatcctgaagtttgtgaagtaggaaaatctaaggtctcacaaagaaaaatatatctctacagtgttgctgactatgaaggctcaaaagagaaaaaagtgttccctactgtatgcttagcttgctctggaaacctatttaataaaaagaacttttggggccaggtgtggtggctcacacctgcaatcccagcactttgggaggctgaggcgggtagatcacgaggtcaggagttcgaaacctgccagtctggtcaacgtggtgagaccccatctctactaaaaatacaaaaattagctgggtgtggtggtgcgtgcctgtaatcctagctactggggaggctgagacaggagaatcgatttaacccagggggcagaagttgcagtgaactgagatctcacaactgcactccagcttgggagacagagcaagactctgtctcaagaaaaataaaagaagttttaaattcaggggtacatgtgcaaatttgttacacaggtaaatgtgcatcattggggtttgttgtacagattgtttcatcacccaggtattagcttggtacccattagttattattcctaatcctctccctcttcccacctccacccctcaatagaccccactgtgtgttgttcccctctctgtgtccatgtgttctcatcatttagctgtctcagttataagtgagaacatgctggaaacctactttaatgttagtgtagttacttcagccttcttatggttagcatttgcattcatttacttttaaccaacgttacatttatacttacatgcttttttttgttttggtttggtttttaaaatccagtctgataatccctgcctttgcattggagagcttaaaccatttatatttagtgtaattacagacattgttgggttaagtctgatatcctattttagttttctttttgttccatttattctttcttcctttcccccaatttttgactttcctgaattaatttaatattgctaatatttcattttatttccactattggcttactagctatgggagacaaaattttttaaatggcccccagagatgtttcacactaatgtcaggaacctgtgaatatgatgagatataattcctttcattgtgttatgatatatggccttaagaaatgaacactatccaggtgggcttgattatatcacatgagtcttaaaggcagagagctttttcaagccaatgagagatgaggaaagcagaaaggaaagtcagagatctgaagcataagaaggattcaacattctcttgctggctttgaagatggaagggaccatgtacaaggactggagaacagacacaaggagccgagagtgaccctagccaacagccaataaagaaacacgaatcttagtctcacaatgtcaagggactggattctaccaacctgaatgagcttggaagtagatcttttcttttggcctccacgtaagggcctagcttggccaacacattaattttggtgttgtggtaccctaaccataaaacctagagtaaccttcctgggcacctgacctacaagctgaggagtaatatattggtggtgttttagctgctaagtttgtggtaacttgttatgcagcaatggacaactaatacattagctgatcccctctattcttttgatggttgctctgtggtttacaatatgcatatttaacttatcacagtctgctgtcaactaatattatacaactttatgtgtaatgtaagaaccttacaactatataccttccattctttcttgtccttggtgctgttgttattataaattttacttctaaatattcttaaaacctcacaaaatagttatatttttgctgtagttaattatcgttaataaatgtagaaattagaaaagtaaaaatcttttatatttattttcatatctatattatccacatctatttttcagcaattgtcattgatctgtatagatttccatatgtgatatcatttcttcattcctctaatatatcctttagtgaaagtctaatgatatttaattctctcagtttctgtttatctgaaaaagtctttcacctttgagagttttttctccattataagacttaaaagatattgtttcattgtttcttggcttggatcgttttacacaagaaatatgtgttaattctttttgttctgtatggtgatatgttttttttccctccagtggctttaaaatttccatctttgtcaaaattttatgaaatttgattacactggggattgatacggttttctttgtgtgtactccactgttgagcttcttggatctgtgggtttatagttttcagaaaacttcgaaaaacttcagccattatttcttcagtttttttttttctacctgacctttgggtctccaatacacatatattagactgcttgatattttctcacagttcacttagattgttaatatttaaagtctttcttctttcagtgattaattttggaaagtttcttttcatgtattcatgttttctatgtattcaatttttaatcttttcttttttggtgtctaatctgctattatttccatacagtgactttttgatttcagattttttttaacttttgaatattaactttgattctttttaatgtcttatttctctcgctatttttatgtcttcctttaactttttgaactgatttaatttagttatttaatgcacttgtctaccaattccaatatttctgttatttctacatctgtttttattgaatggcttttattttggttaaggatatttttctactgcttgacatgttcagtaatttttattggatgatggacattgtgcgctatgttgttgaatgtctggaatttgttgtcttcctttaaataaagtagaattttgtttttaataggcatttaaactacttgtagatcagcttttttttgtttgtttgagggctatttttaagtattgtttgggtggatctatgttagcctttattccagggctatgttagtgccactatttaggcatgagacttcttgggtctctactgaatgcctgttgtagacaataaggcctcttctatgtgattagtcagaactggaatacatctctatcctgaatgagctttgagaattgtttagcctattgcttgtagtaggtagacttctaaaatgacccccaaagacattcacctttgtgtattcccctccaattgagtttgggcaggatgtgaatatgattattcttgtaactacattactttatgtgggaaaaaggaaaattttctaagatgggcttgatttcatctggtaagccctttaaaaagagatttatctgactgattgctgagtaaaaagtccattatctgaaaagcctggttcatatatttagtccaaatgtctagttgtttatggtgtgaaggcaaacctggtccagttactatatcatggagtttttaggtgaacagttgtagtgaattaacttgtccttggagggtatcgcaatagctttaaccagaactttctttcttggacttatcctccatcatgtttccttgctttccaggctgcataaaacaattaagtggtctccaggtatttacactttatcagtaccaaggcaatattctacttcctctgcctataaacaaaaatcccacagaaattttacatataatgcagtaactaggctttttgagcttaccaaaccctattttttagtcaatctttaaaactaagggatattgaattagaagggaaggatttgaaagaggctagccaactatatttcaaaagaataaaaaccactctctttaaacttttaagttatttgaaaatattttacaccagtgaaatatagagagaataatacaatcaatttcagtatgccaaataaccaacttaagaaataaaatattatttgtacagttgaagccctgtgcagataatatttcctccaatcttatccttctctctctagaggtaccttaatgcaatgttattaattcccatgcatttcttcatgtattacttcatatccctgcatccttaaatttatctttgcatttttttttgaaattgattttaattgtcagaattctttcctggtttcctttttttttttttttttggtttaacattttgttgtgaaaataaaatgtttatattggtttagatttccattgtatgaatataacaccattatttatccagtcaactattaagaaacatagttatttcaacttttttgaagcaatgaacactcaaattaacctttggtagatatgactagtacacatatatgagagtttctgcaggaaatgccctttataattatatcacgaaataaatagagtatatgcatctttaagttactatagatggtccacaactcagaatttttgacttattatatttcgactttatgctggtgtgaaagtgatcgcattcaatagaaaccatactttgagtactcatgaagccattctgtttttcatgttcagcacaatatttaataagttacatgatattttcaacattttatcataaaacaggctttgtgttagatgatttctcccaactgcaggctaatgtgtgtgttctgagcacattttagataggctaagctaagctatgctattctataggtcgggtgtattaaatgcatttccaacttaagatattttcagtttactatgagtttatagggacgtagctgcatcataagttgaggagcatctgtagatattgtcagttgtttttcaaagcggttgtccagatttgcattcctaccataagctttctggttgttctacatctttgtaacacttggtattgtaagaattaaattgtaaataattacactggtgagaaatgctacctcattgtggtcttagtttgcatttccctggttgttagttacctttttatgtttactagccagattagctagtaatgaagaataatgaagattattctcctctggtagggtcactccagtttaatcaaactccattagggccaacatagagattcaaacatctaaagtcctaggatatgaaaaatagaaagatatgaataggaatatatgaaaaatagaaaatagaacatttttctaagtatgaaattattccctgagtcatttaagttatttctagttatcaaaacatgactcttgccaacacttttattgtgtcgttctcaattgtggcagtcttagcttcttttactctggcttttctggctgcagaaagaatgacagtaaaccttaagtcactgaagctaaagacaggctacgttatgaggaaacagaacattactctgcctaagactgactaataatagtaagatttgatgaactccaaaaagcctaggttaacaatttctgtgttctagtgctatgctaagtgatggaactaaatactttttaggatccttcttcccttgtgaggaccctatccacagagctttcacagactctttctactgccaatgaggaaatttaccaaaaaaggtccttgctatcttttctaaagaggcaatgagtaaaattgtgtcttttacaaagatatcatctgtaaactattttcagtaggaaaaaagccagaaaaattttcctgaatctatccttggtgctaattgggtatgactttgtgtgcaggggatacattttctgccctttccataatttgaatgatcatctatctagctgcattacagtatgctgcctgcagtgttctcctttgcaatagtccaagtaaataaaacatagctgatctaaatgcttccattcataattgatttgaggaatgtataacctgtagtttttttgggggggcggttagagaaattgtatgggtatctctgtttatattactttggaaatattttatttcataaatactaaaaacctgagtagaaggtcatttagttcaagtttgacaacagaaacttgtttcatatcagccttaattattacattcagtcgatttttttatgactcaaggacccacttcctaccacttcctttgatagaaaaaatatctaaatgtaagagatgaaagcataggaaagtttttcacatttagactgaattgtcttgttattcagacagtcctcacccttttgttttcacttcttagatatttgttaaaactcactagttatattgactagtagaaaccatagatgtgatttagacatgacatagaagaaaccatgacaaaccatagacatgatgctttaaaataatggccctgctggtttgatcgttgatacttctttctgatgggccctatttagatgtgtgtgtgcatgcatgttttgcacttgtcccgaggtgagtgaaaatggaagtggtgttttaaagatgaactttctgtataaaagcaagttgtaaatgtctgttctctatttctaggagcagctctttaaaatatgcttctgatcctttcttattagatgtcatgttgtacaccagcagctcatttgctgttccacagcttgggtctccagatcttaatgactcataccggctgttgtccccctacaggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggttgtgagtatgatggaggatgcatttagccacaaaagaaacttggctcttatttcagacttctaagagaaaaaaaaagagttcattataagaggtttctgtattattagtttgctggagctgtcagtaccacagatgcggtggcttaaacaacaaacatttattttctcgtagttctggaggctgaagtctgagatgcagttgtccacagggttcgtttcttctgaggcctctctccccttggcttgcagacagcgccttctgactgtgtcttcacacactcatccctctgtgcctgtctttgcctaaacttcctatttttataaggtatagcagtcatattagattagggccccctaatgacctcattcaaccatatataatcacctcttgagaaacccagtctccaaatacagtcacattgtgagattctgggggttagggcttccacatatgaattttgcagaggacacaattcagtctatcagtttcttaagcagcccaaacttgaaaggtagggtccttgggtcaaccaggcttttgaacttgggagaggagatcagtattagctcatacttcttcagttacccagctgtgccattagctactatcactgaagtaaatgcctcttaatgtttgggtctgttttgacttcattgattttcattgttttcagttagattctcttcataactcaacttccttcacaagtctgttaattttccattgtctgcacataaaccatgtttttttaaaggccctcagagaccctacagattttaacctctgtgtagccaggagaagagaactcatatatatcacaaactgtaaagatgagtaagaagttgttatttaattcaaattcagacctttcatttgccagctgatttcgggggaaaacagaagtctcagtgatgtggtctagcacatgcaccaagtccattgtaggaagaatcagaaagttgatcataagtccttccagtggattactcatatttgtcaggtttgtagctggtagaaggccctacatgcttgctttaagaccaattagtagacactcagatggtcactgaattgctttttctgtgtgccaaattatattttcttggatgaaataaatagcccttaaccctgagaaaaacacaatggccagagagcattataatttgttgacactcctcattccctcatccttgtcctctgaaaacttaaataaatgagtactcagattgaagctaaccagcaaatctctcagattccattgtttagcatagcagagtttaatgctttccatattacttaatatttccttctttggactttccatataaaattcaaatactttctatcagaatagtcatctaagagaaaatttccattagcataaagcacaaagatacatactttctgcataaaagaattatctagaaaatctcagtctctctgtgtgtacatgtatatgcatctatatctaatatctaatatatgcatgtatattatatatatcatgtatacattttttcttttttaacgtctactcccttggaatttctatagccatgtcattgcctgtggaagccttcgttggctagaaggattacaatagtaatacaataaaaaagtaggccaggcgcagtggctcacgcctgtaatcccagcactttgggaggccgaggcgggcagatcatgaggccaggagatcaagaccatcctggctaacacagtgaaaccccatctctactaaaaatacaaaaaatgagccgggcgtggtggtgggctcctttagtcccagctactcaggaggctgatgcaggagaatagcttgaacctgggaggtggaggttgcagtgagctgagatctcaccactgcattccagcctgggcaacagagcaagactctgtctcaaaaaaaaaaaaaaaaaaagtaaacatgagtatagtgttaacatgttttctcttagctcccttctgtatgtgatatcaaattatgtctctacagggaaaattttgacttatgttgtaaattttgctactctcctcaaaagctcatggcatatgccctttagacatttttgaccttcctttgggggaaacttttgcacctgcctgaagcttgaagtatatgtcaactcttggtgtctttcctaaagttatcccatgtatgtttcatggtttataaaacaagtggtggcctttttgtttagttatttgttttagtacatctgatattttcctccatctatcactgtctttgttgttttgcctatgttttagaaaaaagaggaataaaagtgcctttcatccccacccaccccatccctcttaaaccagaagtcccagcatcacactttcatggcgtgtgggtgcagctgtcctagtggctctctgacagcccagccagtcctcatcactgcgccagggcctcccgtgtcacccagcacatggaggggatcagtgctcttgagaatcacaaaagaaatcaaagaatagataaggaatcagagatgtgtaactcactgatgtttttaactcattttttttttgcccattgatattttgtagtcactatttccatctttcataatcatccctgttactgtgagtcactgttcccttcatagttactagtctattattttcctaaacttttaaatgttcctttcaaagaaagtgacatttctttctctcttttcccccctcctttctctctctcctctcctctgttttaagaagaatctaggtcagtattctctagaaatcatcatatgttttctactgtttctgtcttgctatgctatttgatgttttgtatctatttatgcaatttccaccagacttctcactctaatacacagaaattcattttgaggccaaaaaaagcctgataaattgttcattcccaaatcccattaattttattgcaaagtcatatttatacaatatatgaatgtgcctctttacaagtatttgtatttgtctgttctcagactgctaatgaagacatacccgagacttgagtaatttataaaggaaagaggtttaattgactcacagtttcacatggctgtggaggcctcacaatcatgggggaagccaaaggaggagcaaagtcacgtcttacatggtggcaagagagtgtgttcaggggaactcccctttataaagccatcagatcttgtgagacttattcactatcacgagaacagcatgggaaaaactcgcccccatgattcaattacctcccactgggtccctcccacgacacacagagattatgggagctacaattcaagatgagatttgcgtggggacacagccaaactatatcagtattttaacacaaaatttttttttcactaaaacatttaattttgtgatttttcgtctttctgtctctaatgttatttcccacctttcctttccaaggtgctctgtcttcaccgtggcttcagagcttcccctgtcctttctgtacctttttccctgttcccgcaactgctcaaaagggtctagaatcctgctgtagtttcattcttatgacttaggactttcttccttattaaaatgcaaactctccctggagcaatgccacaaggaatcacatgaagaagcatcatttttactttttctgtgcctcctggcctggaatggaagtgccaacctggacggttcattacatcagaaggatggaagagcattaatggccaggaactgatggaagcagaattatgcctgtaggaatctgtagcataaaaatgcttatcatgtgtgcagatgattagtgataacatttagaagtaaacatcttcatcactttggtggacacagtcaaaatcctaaggggcagaattcttaagcaccctctctgtgccaggggagtaccagacatcctatagctacaggcgcagagcctcagctttgagtcctcctgcagtccccagaggcctcccctgctctaccaccctgactgctggggcactgccaaccttgcagagtgcttccctggctattatctactgtctttctttgcctactgcctttctactttttgtcagtcagaagttgaaagggaaagcaaagttatttttgcttcatggtgcaggcaaatggcatcgggcataaaaagaaagtaaagagtgaatgcattacctctgtacagctggatttatcaactttgcacaagttttcctgaagagacctattggcccctgagcttttcctgatgctcccattatcagtctctttctttctctctcacctcagctgaaaccatggcagcaagaaagacatgggtggtttatctgggatttgtattttctacattaatgcttcctccagtaacgaggttaattgagagttgacagtaattgctgtatgtgagcatgaagccctaaatatgattttgtgacccatgcacctagtgcatccacttcatggtctctgttcatctcaaggatacataaaaatcatgaaacattccaatcaaagataattggaggaaagttttatttcagcataacctagaagaaatcaggcagggttgcttggatgaacatggcatgtatcatcctgatttgtgtagattcccataaatacgaagctggccttgattagtaatgctaatggccggaaaccaccaccactcccaaagccttgcaactaattttgcagggataacccatgggaggctcttcttaccatgtgcagtttatttctgaaccctgtcacccttttaaagaagcattacaaataattctatgacattatgtggtctggaagcactgaagtttattagcagcaatcagaccaagaatgtcttttgtctcctgtgagtttgttgacttttgtgttggcagataccattatggctaagagactaggcttaggcttttaaccaaaaaggggaggggaggcatgagagaagagcagaaacagcaaataaataaataaataaaatatatatatatatgagtttaatgactatgaaagtgcccctctcaggaatcttaaatgtgtctccaactgcctaccaaagcagccgtttaatgaaaaagaacaattatttatatattttatacattttaaactttctgtctttgttttatagaggcagggtttcgccctgttgcccaggctggaatgtagtgcaatgatatttcactgcagcctaaaccccctgggtttaggggtcctctcacctcagtctcccaagtagctaggactacaggcatgcaccactatgccctgctaagttaaaaaaattattttggagacaggggtcccactaaatttcccaggctggtcttgaactcctggcctcaaatgattctcctgcctcagcctcctgagtatccagattacagggacaagctaccatacccagctaattatacattttttattcattctagattgtgcatcctattcatttgtagctgcttaacttgaataatgcatgtaatctaacctcataacctcaccagtacacttttgccctggtgttggtttggttgctctagccccagtgctggtctgctgcatcgcggtatgaagatgatagccctttctgagtgggcctgaggagatcttggaggttttgatcagttctaacctgggatgggtgtccaggttattaggagcaaactggcatgtgcctgtattaacttttcggaaatttgaccttcttatctgagtttagactcaaagctgtttgttaagtaactatttttagtgttataatcatgtcttgtaaagacttagtgaagattttataggtatcaacctattctagaatcctttaaaacttgattttacttgtaatgggactgtatggtatctgcttccttaggaaacatggaaaatggatttaaaatctcaaatgcaaactcaaagaaaaagtatattgctattgttttaaacaagtaattcccaaaagtcttcgtttgttgacatagtagctaattctaagctatctttaagaggttttgagatgcatataaatttagatagtcataaacctacaacttaaaaatcgcagtttcattactgatttttaaatgaaagagattggcttaaatgggaaaccagaaaattaatattgatgactaatattaaggtctgttaatataacacataaaggaagagaatttgattctatttgagattataaataaaagcaaatgtctttccttctgttttgatattaagggggaaattaaaaaaaataaattgtttaccttattccacaaactctggattcaacttaaaaatacacattttaaaaatgatcatgaggtcaggagatcgagaccatcctggctaacacagtgaaaccccatctctactaaaaaaaaaatacaaaaaattagccgggcttggtggcgggtgcctgtagtcctagctacttgggaagctgaggcaggagaatggcgtgaacccaggaggcggagcttgcagtgagccgagatcatgccaccacactccagcctgggtgacagagcgagacttcatctcaaaaaaaaaaaaaaaaaaaaaaaaaaaaatatatatatatatatatatatatatacacacacacttaatatcttctgatcctctctttattaaattttcacacaggtacctaaagtcaagacttttctattttctttaagccttaactgatgttttaagtttctttaaatgtccttttcctttcttttcacctctgaagttaaaagtacatcagctaggtcatgttttatggtagaacccagtacactgcaggtggagttaatcaaatgcttgccccctgcactgaaataagaaatgtgaattgagttacctaagaaggaaggtttatagatgaggatttattcaagatcaataaggaaaatgagccatgttttcccaataccaggagaaagactcagaaaactgtaattaccaaaactaggtgagtggtcttacaattattttttaatagcttttcaaaagaccaaggacatcatatgtttaaatgtatgtacctgataagaaaccaggttgcttctcaatcatctcatatattcttttctcctaaatgagaaccaaagattttctgcttaggtgacctatttaatttgcacacatttatgctagctcagagtggtcagcttttttgatgcttccaagacaaatttcttaaacacaatagtcacacattaacaaaatttcacatagatgcccactttaaaatatatgacagggaaaaccgtgcatttatatgtagactgttcaaaggacagaagttcttgttaaatcagtgattatttgtgggaccatggagcctactgtgtagcaagtactgagtgctaagagtcaggatagtgttggctgagaatcgatctgtccttcaaaggtttcacagcctagggagggtggctttataagctatatcaataagtaaattaaaatagggtgtcatgagtataataatacatgtgtttaaggtgcagagaagtatccccaaagagagaggggttaatttaagtgggtgggaggtcctgaaagacttctcagaaataatgacatctaagctctgtttgaagaatgactaagaacttattggatgtataagttaatgaggtattcagttgcaagtaagagaataccctcagaaatccacctggctcactctttcacttcattcaagtctgctcaaataagctcagcaaagctgctttgaatgatctatatgaattagcctctcattattctctgttcccttaccttgctttattttatccatgatgattaccactacctggcatattatgtttattcttttatttgtgtagtgtctatcttctctgacttagttcagactctgtgagaccagggaagttgtgtgtttcatttactgctttatcccagcattaggagcagtgtctaaataattcaatattagttgagtgtaatccagccaactatggtttaagtaataaagatatttaatatctcacaagacgtggagcttgttgacaggcagtttcagggtggtattgctcagtattttcatattttgtagtttttattgagatagggtctcactgtgttgcctagactggagtgcagtggcatgatctcagctcactgcaaactccacctctcaggctcaagtgatcctcgcacctcagcatcccgagtagctgggaccacaggtgtgtgccaccatgcgtggctaatttttgtattttttgtagacatggggtttcaccatgttgcccaggctggtctcaaactcctgagctcaagcgatccaccaccttggcatcccaaagtgctgggattctaagcatcaaccaccatgcccagccagtattttcatttgagacttgtacattttctattatccacgtctgtcttcagagtattacctttttgtacttggagttgccacctaaatcctaaagagggttattaaagcaccaagcatcacatccttcacaaccatgttcaaggacagaaaaggaagaaactctagggagccctcccccagtgtatgtctcttcatcaggtgaagagattattcccagaagctccacctgcagatttcaccataggtctcattggtcagaaccatcacatagctagaaccagcagtgtgggagcctgggaaggcaagaagaggcagaaggaaatgaagttaccatgagggcttaaactaattatggtttatccttaggggctgggcatattgctacccaaacaaaatcaggagttttaaaaaatgtaataagtaacaaatttagggaataacaatatgtaaaataagtaaaaactagtaggattctaggtaatttattttttatgttagtatgaaaaatatatacagtaaagttgataagactaatcatggacattttctgttgtaaccaaaaagatatatttttcccattcattctctaccaatatcatttttagtacattcttaccagtagtatcataaacaacaactgaaatctgatatttgaagaagtccttctcaaagaaagatttcttacacatttgatgaaatggtttaatttctaaagctccatataaaatttgtcagaggtgtcccttgctttagaccacaaactcaagagattcagacaacgggttcaataagtaaaatcttccttgaacacccttccccctagaaattatcatgtcctatagatcatttcacagagttcctactctctctggggaaaaaaaaatcacagaaatatctcacaaaatgaagatattttcttcccataatcatagtcataagtaaaatatgtatttgaaatttgagatcaaaaaaaggtagaattgattttcatgaacactagacatgtgattcctgtcctcaacaatgtgacccgcaaaaccaggatcttatatatgcccttgttttggggaccagggacaagatgcaatattcttgattttaaaagaaaagaaaaaaaggattcacacttcttccttccctgcatatctcactcccccctctttccctctatctccccaacacccccatctttctctctctctctctgcctcaccctcttctctctttctctctctacctttctcctttcacctcatccctccgccctaaacattgctttctatgtagaaaaggaaactaacttattggctgtgtgggtgatcctgaaattactactgtccctgtgggttttttgaggtaactcttaactcctttagctggaccaaagtgtactgttacatcagctgataaaaaagtaatttccctttaaggaaggaactagtggaccttccacctacacaaaatttactaacttaatcgtgcccatgtgattaccattccaatgatttgcttattttaccacaaatagccagtctgggataggactttcattcattgtacctttttctaatcctcttagggaacaaaagttaaggcataattctggctattgggaaggtgacgcagaaaatcaggtgggaaggtgggaagatgaggagagggcagatggtgaggagagagagtgtagccctgccagccagctcacagtctcctaagcacccctgaagagcacattttccagaagtttcccaccagagaatgtccttttaggttaggtctgtacataggtaggctacgttggtacttgatttacccatagcaacaaatgtatactaggagtttgaattgtgttggtgaagctgttgccacgtgaggaaattgaaggaagctatgccgcagagggagtgaaaggagcccttaagccttggtctgcttttgtgcttttctggattctctgcgactttgttcatttttgaccagaaaagattggagaggaatgtgaaataagaaaaaatcctagacacaaaggagtggcatgcccaagtttacaggcatgatgggagaggaattttgtcaccttgccacttgatcctaaggacatctcccctcccctttgtttccttaaaaatcaactatgaaataagaagactgcattgatacacgcacacataactcaaaagaaagaagactccgcactcccttggccagagggtactgtgagtatgccctggcccagggggcggctattacactagataataaaattagcattgagtcaacaaaggaaaatggcccccagattcattaataaagcaacgttttggtctgaatattcagaaatgctacctgcacccaccccattagctcagagttctgaagaagacaccacatacggaagcctctgctgtcacctctgttttagttcctgcctgtgaatgagcagttccacttgcactttctgaggcttctcaccgtagcccttcccaaggtggcaaaacctacaaacaacccaagagcctgaaaaatggaataatgagagttgactttcacttacatgcttgctgtgggccaggcactgtgctaagggctatactggaacgatttatttaatcttcacatccccagaaggtaggaatttccatcattttacttcgcagaagactcttctgttttgcagttttacagatgggattcccattttatagcttgcctgcttgaggtcacacagcaagtaaatgatgctggtaaatcaaccaggctttgaaccctaacactccaactaacggagtgcttgctcttagcaaccacagttatgtgctgtataatgacgttttcatcagtgacagatgacatatacagcagtggtcccataagattataaacctatattatggactggacatggcggctcacacctgtaatcccagcactttgagaggccgaggcaggcagatcactagagcccaggagtttgacaccagcctggggaacatagtgagatcccatctctacaaaaaaaaaaaaaaaaaaaaaattagctaagtgtggtggcacacgcctgtagtcccagctacttgggaggctgagctgggaggatcccttgagcccaggaggtggaggttttagtgagctgagatggtgccactgcactccaggctgggcgatggagtgagaccttgtctcaaaaacagaacaaaaagcaaaacaactgtattaggggccagatgtggtggctcatgcttgtaatctcagtgctttgggaggctgagatgggaggattgcttgaagccaggagttcaagaccagcctggggaacaaccaaaccctgtttttacaaaacatttaaaaagtaacctgcttggtagcatgctcctgtagtccctgctacatgggagactgcagtaagactgattgcttgagcctagagattcgagctgcagtgagctgtgatcactgcattccagcctgggcaacaagagcatgactatgtctccaaaaaaaaaaagagagagagagaaaagagaaaaccaccaacaacctgcctttactatgtttaggtgtgtttaaatacacaaatagttacaattgtgttgccgttgcctgtggtattcagtagtctgtagcttaggagcaataggctacaccatctatagagcctaggtatgcagtaggctataccacctaggtttgtgtaagtacactctatgatgtttacaggatggtaaaatagcctaatgacacatttctcagaacctgtctctgttgttgaatgatgcgttactgtactccaaactttttgacaaacctaacctaattttgctcttcattatatgcctgatagacatttttatctatgtacatgaggcctgagctgaccaaaatttctaactttggagaatgtatcagaataagagtaggaggctgggtgcggtggcttacacctgtaatcccagcactttgggaggctgaggcaggcggatcacaaggtcaggagatcgagaccatcctggctaacatggtgaaaccccgtccctactaaaaaatacaaaaaattagccaggcgtggtggcgggtgcctgtagtcccagctactagggaggctgaggcaggagaatggtgtgaaccctgaaggcggggcttgcagtgagccgagatcgcgccactgcactcgcactctaggctgggagagagagtgagactctgtctcaaaaaaaaaaaaaaaaaaaaaaaaagaaagaaaataggagttgtgtagaatctggatcaaaaataactgctttatctttttccttgaggtggcttaacaaaagactatattcatttgagcttctgttgtttccctttgatacactgtttcacactgtagagccaatggttttatacagttttacggaacagcttgcaaagtgcaagttttgacaagaaaagaaaatctttcctgctttgtcttctcatttcaaatattgcatgcagatttaagctaccacatgtttacccaacgtgcttgtttctaatatgtgaaaataaggttgtatcagtagaattagctacctttaaaaaattggttgcaaaatgtatccagtatatcatctgtgaatcatccctgggcttccaagaaggcatggtttgtagctacacaactgcaaaaaactttttggcaagaagtgatccaatgcattccatagaagtagcagcatcctaaaaactgaatgacacctacaccgtgaaatattttaaaagaattcccaaaactctgcttcatcaagagtgaattttcagtcaaatctgcttttctttttaaatttataattgattcctccacccattttaaacaaggatttgaggtggtgtaagtcaaatctgtcactcaggcaaacactctagcatcctgagccctattgttcatcaaagtccttctgtaattaatcttggctgtttgggtaagtgccttctatattttggtgtaagaaaggcagagcaactttcttatgccttttatcttaaaaagggatgaaagtaaggaaaatggaaagaagccttcaatagaccttctggcaagttctgttatatattgagtgctaagtgccagtcactaagctaaccactatcatatgatttcactgactctggaagaggatcttacctaataaataagagacactgagcaacaggaagccactcatccctacagattgtgatgtcaggaagaagactggggcccattagggtgggaaaactactgccattgtggctgtggcagctggttctttctctgcctctgtcctatcgcaagaaaatgcctgccctattagatctggtcagtaatgtttgatgaaccacatttgtgcttgaagagtctcaagcaaaaaaagggtagtaagagaggagaaagaaagaaaagctcatgggggaaaaaaatcacccacatgaagtagatttacattggatccccaggttcccttcacagatcagcgtcaaagcagatgtttctccccaatcttggcaccttcctcaactgctgatactcaaagttaattagtttagtataactttgtgtctcttaattgatgaaaagtgtttttcaacaacaaaaatatctataattggtccacaattctagatggggcctaggcagttgacagggaattcaggtagaccaaatgccaagaaaaaacgctctgaagtgctctcaaacagaaagattgcagactcgtggacagtatatgtctatctttgagtcatattggttccaaagatgaccaattttttttgctaactcctcccactttatttatacagcatagatcatcataggaaaattttaaaggcaaaatacaaaaatccacaccaatttccacaataagcacttattacccttataataagaaagccccacagaaaggtattagaaaagccctcatacaactactcatgtttgggaaataaatcacaattgtgtttgtaagtgtgctcccatttagagacattcatgttctaaatgtaaatggcaaatggttcatagagaaaaacaaaaaatattgatatgttattgatacaataccaagaaacaaatatgccagcctctccaaaagttcttttcccattgcaaattatgtgtataacttgctatatattttcctagtttttaatgtatataatctaaaataaacaaaacacagaaagccatagccttcgtcctctcctagccccatagcaattccagagcagtgagatagtcatttgtgggtgtcctagtgtgctaggaagtcccgaaatattcttgtagcccaggacactctgttttgttagtctattttgagataatccttctctcagtaagtgaacttatgctaacgaaatgattatagactaaagattaaatcagacagataaataatttatgttgtgaaaaaattatcaggtggactaaaaaattgtcagattgtccacactctccctagaggcaataactgaagaagccagaagggaagccgaattctgggtgaacttgaattggatgatactagtggctagtagtcaaattactataatctgatgaattcggttgcacagtagggattgactggcttggtagaccagaatgctttcttgggtggccagagaaccctgtcctgtctacaaagctggtgatgcattattgctctttaatgcccatacacctactcactattaagatcatttttcttctgttaacatatctttcttgggtaggctgtatttcatttgattagccttcagtttccactgttacagtagtattctggtcatagtattctgttactctgctactacacccaaggcatcaaatagaggcattgacacatagtcatctaacataggatgcttctaaaaaaagcacggttgatttattaattaacttttactagattggattaaattagatttttcttacttttatcctcaggtaactgagatgtgtttagctggatgtctctcctgtgtacttatagctaccctttgaatattcatattaatgtaattttatcgaataactatagtccccttttatttaaaaaatgagaaagaaagacagcaagagtttgattattcagtgattttatggtggagaaaaggcccaaatagttttttttttccaaaagaaacttaaatcaatcctaattgatagtggttccctaacatattaaaaggtcttatgtgaggtttatggatatctgtttaattattttatttattgtcacttgacagagcgtgaaagaagccttgctttgtttgtttggagtggagttcaattctaaatggatctaactctgggcccataacaggagggttagttattagaatggtaaaatgttcaccttatgggatgatctcacctgtgtgaggcataagaccaccagatatacaaaagtttcctccctccaggccttattttcgccacaccctaccctctcacaatgcacaccaccttgccaaccagacccttcagacatcactcttcacaaaataagactgccaccactggaagccaagcccaggcaatttgggttctgtaggtgggaaagaaaatcaaacctaatagccatcattctcatgttttggtcagtggcaaaactggccagatagagatgctgaggctgtgagaagagacagaactgcaggcgtatggcaagattggtgtggtttcagcctaaagtcacgggatgacacagggtacaacctcagagaccccatctgcaaatccagagcgacaactggtcacagggatccatccatgcaagctggcattctggggaaggatttccacctcaaagatgaagtgagaatatgataggagcctattaactaaaatttgagtagggaaggaaatgtgcgaggtacaaggcaagacccaggtatcagttaggaccagcaagtattctaagtcactgctacttctctttcttatggatatgaatttcctagagggaagatgtacctggtcaaataatcctggttgaaatgcttgagattttattaatgctttttatttttatttttgagatggagtctcgctctgtcacccaggctggagtgcagtggtgtgatctcagctcactgcaagctccacctcccgggttcaagtgattctcctgcctcagcctcccgagtagctgggactacaggtgcctgccagcatgcctggctaatttttttgtattttagtacagacgggatttcaccatattggccaggctggtctcgaactccgtacctcgtgatccacctgcctcggcctcccaaagtgctgggattacaggcgtgagccaccgtgcccagctgagattttttaaatgcatttattactataaaagacaagaatgctgctaccctgtggccttgtgaggcatgttcaatccagaggaccagcttgatgatttttcaccattcatgaccattttcctttgcctttagtttcttctagaatgattaaccacatttactcgccaaaacttgagttctgactatatgcaggttcttctaggggacccagaactagctatgaaataatagtctctgacatttaatttatttattcaaccaattattaatagattcaaaagtatctagtatgtacaaaaaatgtttagagaggttgaaagtggccaggtgtggtggttcatgcctataatcccagcactttgggaggccaaggctggaggatcacttgaaaccaggagttcgtgaccagactggaaacaaagtgaaactctgtctctactcccctcgcaaaaaagttaaaagcataggggtctcactgcctgacctcacattctggtttggacattattaactttttgactctgggaaacttactaaaattaaaattttctaaagatatgttttttttcatctataaggctggataaaataatagtagctaccttaaagtagttatgattcttaaagaacatgttgcttgtgaaatctctggcccatacattgttaagactaaacgaagtcaagccagccttaataaagcactgagaaagattgcatgcatataatagtctcaaaatgatgaaactgtagtgatgaagaacaaatcaacagttgccaggagctagttaaggttgtggggagggtgtgactatcaggagttagtaccaggcctccctgggcgatagagtgagactctgtgtaaaaagaaagaaagaaagaaaaaaaaagttagtaccagggagtttctttgtaataacagaatacttctgtatctcgagcaggcagtcgtgatacaaatatatatgtgtgataccgctcccacctccaccaaaaatgagtgcgtgtcaaagctggtgaaacccgaatttggtctatagtttatagtatcgtatcaatgttaattttctggttttgaggatgtaccatggctatgtaagatgatatcgctgggggaaggatacacaggaacactgtgttatcttccaatttatgagtcttagattatttcaaaattgagggcttttttgttttgttttgttgttgttctgttttgtttttgagacagtgtctcactctgtagcccaggctggagtgcagcggtgtgatctcggtgcactgcagcctctaccttccagattcaagtgattctcctgcctcagcctcctgaatagctgagatttcagacatacaccaccacatctggctatttttttttttttttttgtatttttagtagtgatgtggtttcgccatgttggccaagctggtctcgaacttctggcctcaaatgatccacccacctcagcctcccaaagtgctgggattacaggcgggagccactcaaaatagtttaaaaatataaggcacgaaaagagatgtgacagtgtaacagagaagagatagacttgtctctgcccttatggagtttacattctactgggaagagaaaccagtaattacacagtcagttatttcatggtaactgtgctcagtgttacgaaggaaaaatgtaatgtgctatgacagcatgtgcaaagacaagggggcccaaagctggggcagctcaggagaggcttcttcttgtgggggggatatctaagctcccatttctatggtcgggtgagctgggtgggatggtgggaggcgttctagggaagggagcaacattgatggggacctggagggtgaaagagcctttggcagcttagaggaactggccgccgtgcaggaatcagagttaagtaggccggtgttacaagcacagtgttgtgggggtcaaggagagaagtatgtctgacaagaaactggggggagaaaacaagtgcaccatgatggtagcaatggataaagcttagattttgaaatgggttgttttttaatgaatttaaagctgcaattataaaacgcacaaaggaatggatacttcaagtgtgtgatgagtttgggaagccacacatagtctggtgaagagggtccctggaagaaactggaaggggactgggaagagcatttggggcttgaccacaaaggaagtttgattttttgtcctgcaggcatggaggagccattgggacttctgagctggcaagttcttcaaagtttactcagaggccaagataaagcatagatggagttaaagagaactgaaaccagtgagcctggccaagaggctactgcaggagtccaggatagggacattagagcctgaagctggggtgaagggagtggtactgggacagggagtgacaaaggagcctcatgtcagcaggcccagccaacaatagggacctcagatcctggagcatctctcctagtatttaggttggtgcaaacgtaattgtgctttttgcaatttatccctctgaggtctcttgtaggtatataaaaacatacatgtaacacatctactgtggccttgttggaaattgggaaattggaaagaatgcatgtatccgttagtgagtacttgagtaaactatggtacataatcctacaatggggttctatggagcacttaagaaccatggagtatcttcttaaaatattaagtcagaagaattgcagaagactaggtatagtatgacctaatttcatagaataatgtgtagagtgcattttacatgcatagaaaaagatcttgaaagatatacctcttcctttggcaataaagatctttgcaggtggagattgtaaagaatgtttactttttatacatttccttatagtgatttatttattacaaatatgttcatgcttcagtatatctgtctgttgcacttctacgtgaatggtgttgtcttagattggactcctgtgaccaggctttgagatggagaccacatgcagaaggaggcagcccttgggaggttcccctgttaggaagtaaggaagacagcattgggcagagagggaagctcacccatattgcagttgtaactgagacatactaggagcttttgagctgggatgacccttcagagtcatcctaaattggggcagggtctttatatccttgcgttagccagtcattgggtttggactgccttgaggagggagcatgaccttgggctagtccattccctgtagctgagggcaactcctgttgaaggatgcagctaagaatggccagcaactgatagtcctatgcactggccaatggatgccctgactctgaagagggaatctgggaaagcactacagtatccattacagttatttggtgtaagtttaaaatttatttttagaccttgcagaccttgcttaattatcttaactttgctttcactaatacaaaggtaaaagaggaaaaaatgattatctcaatgtgaaaaaaattaaatgaaattaaaaaacctttttgattaaaaaagtcttggcaattaggagtaaaaagcaatttatttgccctgataaagagtactttctccaggctcccctttctctgaaggtgtaggccctctgcgggccaggctcctctggcttaatttcctccaccacattgtgtggcctcaggccttgccttccttctccttgaccacaatccgcagagtgctctgattctcatattggtatttgcctccaggcagtcccagtttctgaatttccttctgttttcatttttcctctcttcttttttttttttccttttttttttttgtggctcctagtgatttcccttcctttcttgtgtgctcagcaatacatttaaaagtatatttgttgtaatttatttagcacctagtgtttcacagcaggaaggtttttcagtgtatctggtccacagttctgcagaaagctaaaccccgactgtcttcaccaaaggcaatttttccttttgctgcctctaatgtgactttcagttttattttttatattttatttatttcataagttcattcacctttatcctcttctcctcttgctctatcttctatcgaatctcagtttttcttctttgacctcttttctttaatggagaattatttgatcatgaattatacctattggggcaaacttttctggtttgtatcattcagctgactttttaaaatcatattcctctctatgttttttgtgttatctatgactacattccatactgtttcatttcttgtgattatgcattcttaaattggtttgttcttaccaagccagctatttgtgaaaggatagaactggagacagactagggaatggagctagggcagcttgaatttccatctattttccactactgcctttcctggagaacggcctctgtgtgggctcaactcatttctctctcctcagctcatttttatcacagctcttttggatggtgacataaagcttggtctccatcagctgagcatgagccatatattcaggcaccactcttttcttgttgaccttagtacacccacatcctgctctggcagagatgacacactagcctgtttccacgtttagcatcatcacctctgacccctaatgccaaacaggggtcagagcatttccccagtgctcccatgcatcgagacctcatgttcccagcaagggtcatttaatgtccttcagggtttgccacctgtaaagacctctctgttctgctcactaaactagagagctgcaggatcttgtttcttccatcagtctccccatgtccttatttaattttcctaacacttggcagccttttaaagagtgatgtttggattatgggtgtttcctagtgtttcatcagtttcacttctgtttgtcgttctcttaatttttggttgacttaaggaaagagagctttcagtcttgcacttgatcttgaagtccagaggattattataggatgatagaagacttaagcaggtgagggacgagctatctcatagatgatctgagaagggctgggccataagagtagcctggaaagaaggagatttcttccttacacacagaaggacaaaaatccacagggaacatacaggaggaattttaggtcgataggaagaaaaggagtaaaaaggtacttgctcctgtgggagatgtggagtctggcatgtacaaggaacagcaatagactttattcatttattcagcaaatttttatcacatccatgctatatgccaggcagtggggaaccagtaatgaacagggcaaaccaattcctgttctctgatacttcactttctcatagaagagccacagaacaaagaagaactgagcagcagcaacaatagcaagagcctgttttctgccaggttctaaaatagacaacagagccctggagggtctagtggtggcttccatgtggaggtgctatttaagctagatgtgaaagaacagagaatccagccatgtgaaaggaggggaagagcattcctggcacagagtagaaaatgctatggccctgaatcaggaaagagcttaataattttcaggaacaaacaaattactggttggacttgaaggagcaagacagaacatggcacaggccgaggttggagagaaaggaaggaaccaaatcatgtaggcatttgtaggagctgggtttgtattctatcattacttcctcagtcagtagagataatgaagaacagaaatctaggcaaatatggataaattataaatgtaccaaaatgatgatagttaaaacccacgaaaaaaagagcataacatcaacaagtgctttggcaattttctatgtggagattctggttttaagataatttgggcagaattcatagcataaaaaattaacattactcacagacttacattctaaggagaggaattccatgtcatgcttttaggaatgaatcctagaaactgattgtcctctggaacaaaggagactgtggcattttagagagccctaagcttcactatgcgtttctgaatttgaggatatggttgaggaaaattagtcagaaggaaaggacttggacactcaggattccatagatctggaaagtaggaaggcaagggctgtgctgaaggagacattcactctttgcatgggggccatcagagacgaagccagatagcatgcacaacacccagcttattctcacacccatactttctctgtttgcaaagagaaatcacaatggaaatatttctaaagattacccttctgcaacagaaagaattgactggaaagtaagttatgaaaaagaaatctggaagcaaggtaatagagccccaaacagaatttaaatcttttcctatcagtatttggtagagtctgagtactgacttatcagaatatatataggattttatccagttgaagctgcagactttaaggatgtatccatttcctcccctcttccctctgtccttccctccctcaacagtgaatgtttgagatgatgctatccagcctttatagaccaatctatagataagtgactcttctttttagccttcttcatggcgaatttctctccaacattctttgcattctaattggtcttactcaattccaaagaatttcccattaatcaataaagcttcttcttagaagtggactaaagctgaagtttcagcttctgtcagactccatgtgagagactcctttcaaaaagaggcaaactgtaaatccagttttcttttggcattaatttcctagtagttctgggggttcaaatgagacatcagtgactagctgtcactcaagtattttatctcaaagcttaaaggactggaaagtgactgtgctccttccactctcagtttaagtacagtattctgttcctggcagccaagaagcagcaggtgtaggatgaggaatagctggccattgctcctggccagagaaggtgcttcttcacaacagtggaaggtttcagtatcgcttagcctgtccaagagaaactatttttgttccatatccatgccctggtaggagagttcaaatttattttgggtttgctgatggctatactatcaggaggatatcagtgcaggaagccaagaagctaccatctgtgctgtgtttatatctaaagaattatttagaagactgattactcagttagctgggcctcctgaccttctagtattacacttagaaaggtaactaacactttcttgaaagtcacttcacttttaataacccatataattccctcaatataaggtagggatcaaagtattgaccaaagcttcacactgagtctcatgtgttgtggatgctatgaatgatcacttgtggttaacagatagtgactcctaacagtgatatgttagtaaatatttaacaatgggctctctagggaaaaataactgattcatagcatttgccagtttccatgatggaatagtaagaacaattttataaattcaaaaacatagatgaaatatagaaattcctcaaaagacaataatgaccaaaatcaactcaagcaaagtaggaagcccaaatagccctatatttattaaagaaaatgaattcacaaatctgcccaccagaaaaattgcaagtccagatggctttactagggaagtatatcaattgcataaggaataaattacactaatcttgcacaaaacccttcagaaaatagagaggaaacacttcccaactcaccttttgattccagaatttatactgttaccagaattaggtgaagacattatgagaaaagaaaattatagatcagaaatcagtatacttcatgaatagagatgaaaagaaaattctttgcaaagtatcagcagattgaatccagtaaaaacatatattatatatatatgtgtgtatatatatgtgtgtgtgtgtgtacatatatatatatatataaattatcatatatgatgaccaggaatgtaaggttggtttgactttcaaaatcaactgatataattcaccatattaacagaataaagagggaaaactgtatgattgtctcaagtatgaaacaaaaccatctgaaaaaatggaaaaattcagcacttattctttgtgtatgtatataactcccaaataaagtaagaatagaagagatttttctcaacttgataaaagacaactaaaagaagcctgcagctaatatcagacttaagtgtggaaagactgaccactttccctaagatagagatgaaggcaaggatgctcactctccatcacttctattcaacatattgctgcagatcacaggcagtgcaataaaaaaaaagaagtaaaatgcataaaattgtaagggaaaaacactgtctttatttgcagatcgtgtaagtataaaatgcaaaactatttctaaaatagctactagaactactacatgaatttagcaaaggtataagctacattgtcaatattcaaaaatcagttcattcttataaactaacaaaaaagaatgtaaaaaatgtaatactctccacagtagcatcacaaaacatgaaatatttatggacaggttcagcaaaatatgtgcagtatctgtgcattgaaaaccacaaacattgctgagagaaattaaagaagacccaagttaggggatacaaatgatcttcatggattggaaaattcaatattgttaaaatgttagctctccccaaacagtcaccatgagaattctagcaggatatttgtgtaaattaataattggagattctaacatttaaatggaaatgcaaaggacttaaagcagtcataacaatttggaaaggaagaacacagtgggagcctatgataagcagaattccaacatgatgccaagattccatcccctgctgcaccagtgtgtacaatccccttctgtagagtatgagagagacctgtgaatatgatgggttgtcactctcttgattaggttatgttatatggcaaaggtgaagagatttgcatcagtggctccatccaagactgaagtggcttggtgcctgtgtttggacacccagaccaaatgtaaacctttggtcctcaccctccagaaacacatgtgcctttaccacccctcaggttaaggcaaacacacatttatcgcacagtctaccttcggggtcagactgggggaggaggtccacaaatgccctgaggcatactcatgactatgtgggcagggaattccaggctcacagttactccaggtgtgatctcgaaaggaagaggtgcatgctccgcataggcaagccacttggccacgggatgtcttcactccatgggaagggaggaggctcaaggtggctgaagtagagcctccccaagcagaacatctcaaacttatatgtgcataagatcttattgaaatgcaggatcagagcagatcagagtgagacctgggatcctgcatatttaaaagctttcaggtgacatgagtgctgccgacccactttgaatagcaaggctggaatcatggggcggggtagtactgctgtgatgcctggcagtgcatccctggcattggagcacatgatcagccctaattggtttggtgtcacttgtgaaatctatccagcaaaagaagtgaaaacagaatggctatctttaattaagtgtttactatctgtcactaatatctttaggtgtgataagtcatgtaattcattggtaaccactccttgccaagtaccagcttagaaacgctagccagttgcttaaagacgttcttctgatctcatagcatcccttattttcaaccttttatctgtcccagttacccaagccattgtgctacaaaattcctaggatcctcaagttttcctaaaccctctttttcctaaatcctcattttcacggacctcaggacagcctgggaaaacatcctggttggttctactacaaaatcttgttattagatctctgtggggtcctcctgattcatggcagtcttccttttaaatattttatggacttcctagtacgttatccacagcagtgccccaaatccactctttgtgctcagctctatttccaactgtcagcaaaagtgcttgcatttcactttaaagggaagaatgcttaatctgtgtttataatcctaatccctttcttttccttggctttgcttatcagttgttccctgtctttctatctccttttactctgacttttagccaatcaaaatactgcctggatctcctgttttgtaagatcatatacaccctcctaatccctgttacatgtctcaggcagccagcctcctttgccttccctcactgcccactgccatgaaacaggagtcaccttttactgcctctacctgccacctacaaccactttaatctcttgcattctggccttttcttccaccgacctacgaaaccaccaatttgaagtggtattaaactatttattatttttattaataaaatatgggagcatgaatgagatataaaatgaagtcaaaattgtttctaatatttatgctgtatttttccattttgtagcattttttattttgaggcatcactctacagagacttttatctcttcctgtgggatggttccctttctaggccacattttttgacatttacaaaaacacacactttttcttttaaattcagtgctgaaggttaagaccttgggccattcattattttatctgaacttcttttctcactattatttggaagaagggtaaaataatacattgagtactctactctcttttgatgattatgttgctcttgggccaaaacaaacctttggaacctagatgaacttctaagttattccaagagaattaggaatcttcctttaccctccatggacccagcttctcagtgcagctaaagcccttgcttagtctgtataaattaatacatttgctggaaatgtgactttaggagattttatagcagtggtttcaatgctgctagtggtgaagtggaaatttgagaatgtgaagattagtttaaaccacatgatgggttcaaggaaaagggacatagctggcagtttcctgaatgtgtgctaactctagatagtgggtaatgggatccgaaaaaaccaccagtgaacttttaaaccctcttgagaggaatcaaaccagcacaattagccctgaaacggagctgtacacgaaaacaggcctcttctctctccctcagaaaccaatccctttgcctgaaagaacaccattcggagatcagagagagaggaggcaccttaccttttactgctaatggaatgaagctagacctgtgtttccaatcattagctggtttactgagctgtctttcatcatagattccaaattctgttggattctttcaactattgttaaccaataaattgtatgttgtggatagtcgatgaacttgaaataaaagatttctttttccttccagtttgttgtagcagtgttctggatcatttatgcctatgacagagagatgatatacccgaagctgctggataattttatcccagggtggctgaatcacggaatggtgagtggattaaaacaaacggctttcttttattttaaaaaatctattaaatagctatgatctgctatttagaccttccatagaatttgcctaaaaagccatgaaatcttggaaggttataatgggagattaaaattagagaatactgtaatatttactgaatataaatagaaacttcttcccatggaatggagtcattattcaaacgatgtagtagatgaatccacagattattaaggttggtgtgtcagtggtgttaaataatataattagccaattctgggatgaatttaatttctgtgccattagaaggcttgtcctcagagcccaaggatggattcccatctacacagccaccaccagccctccgctccacctgcgcctcacatcgtctggattttgtttgaagtaactattgcagctggacagtttccctcagatgggcagcaaggctgtgactttctttcagagatctgctgcaggcatttggaagtgtcttttgcaatggaattgtttgcctcgtagggttcttcccaagttagggtgttcgcctgtggctttgaggccttttccttcttctcagtctaattctttctggtgctttagccatgatgttgccctcactagtttcaaatccagtgctttggatggtttccacatcattttacaacatttgaggatatattttctgcagtgaaattttgtttcatcttccctttcagtttttggaattgagcactactttgttattaactaagaagcatgcattttggttacagcagtttttagaatatgtcccagggtgttcctggtgaaaagggcagcccatcacaagaaattataggggaaggaagagctggaaatcatgagtcttgagtacaaaataacagtttcccttctgcccccaattttggtatatttgaagaaaagtggtgtgtctaacaaacaaacatcactgtactgaagggttttgatcaattctttcttaagccaattcatcaaaagtggcacatctcagagaattggatttttttttagttcaattagagccacactcttgaaggattaacatggcacctctggtctatttccaaacatatcagctgggtcttgtcagttcaatttagccatccacggggcctggcatggttactatggccttctccaactttttccttttcttgaatgtgaaaagcatgtcgtaactccatggctttgcaatctcctgccccaaatgcccttctcagtctttcctgacaaattcctgctagcttagttcctatcttctttaagaagccattcctaactccccaagcaaagttagctattccgttacttgtgcttgcacagcactttcatatctctattatgcatgtctgtatccccacaaaaatgttaagctcctagtgcaaaacagcctttgaattccaagcacttcgcccagttgtctggcatacagtaggatcaatacatatttattaaattgatgaatgaattcgctatagccaatttccataattctttgccagttacatagctactattattttttttgtgccaggcactctacagtgattgtatcattaaattttcacagtggcgctacaaataaggaatgatcgcaattacaaatgaagaaactgaatctcagaaaccttatataatttgcccaaatgacgtagctcaggatggtagaagtgggatttgaacccaggcctatctggcctcaaatgtgtggccacattttatctgaacaagcaaaacattaattgattcttgataaaaacagttacattgtatagcttttataacagtaagttaacaaaatgtaagaggaacatcttcagggtattttgaagcttagtttcaaactgtttagcgtatttcagctgtctaagataaaccagtcaataattaggtacgtatttttaagaaaaagacattatgaaattcctgatctccaagagctgagttgtaaatggagataggctttgtaaatcatcacttcaaacattacaccaaaaaacattgtcatgtgctcaatcaggagcaggctctggccaaaaggcaagcatattcttgtgcaaatagtatcctttgtgatatctccaaatatgaggaagagtaatatcacctagataactctaattagagtgtccaaattgtgagtattaaagggagactcttgaagttgctgcctccagttgaatgtgaaatgatgtcagttaccttgttctgacattacgagagactttgctgacaacaaataattgcatcatgtgctatagaattaaagtctcggccactttggcttattgttaacaggcctgaactgcacaatattaccttcatgccagagaatgaatcacagcctttgtggatcctggttctaaatttttaatgttttgaacaaatggcttatgaagcatgtatccagccattagaactttgacttgcctctcttaattttaccttgattcactttgatgtcttaaaactcttactcctggagacagatactacttagaaacacaaggaggaattgaatgacacaaatatttaggaaagagaaaagataaattagttaatatgtcaaatcctctgagagataatatgagttcaatagattctttcacaatgaattttgtgtcctaatagtgataaatgaccagttctttggttttcctcatgttccaattgatagttccagaattactgagaaaaaagaagttgcgcatggtggctgatgtgtattttgcaatattaaacaatttacattacttgaattctgtatctgtgcaactatagatacaaaatggataaaccatgatgctgatcctttagactagcaattaaaatatgaacattaaatgctggaattatgaataattttcataaaatgtgtaataaaatgacatttcaaataaatgagcattttcttgtttaaataatatttaaagttttaataactattaatttgtacttgcttttaattctaattggtttttaatatttaatttaaaaatagcatttttaaatatatggaaataagtccattccaaatttctttttttttaattttttaaattatactttaagttttagggtatatgtgcacaacgtgcaggtttgttacatatgtatacatgtgccatgttggtgtgctgcacccattaactcttcatttaacattaggtatatctcctaatgctatccctctcccctccccccaccccacaacaggccccagtgtgtgatgttctccttcctgtgtccacgtgttctcatcgttcaattcccacctatgagtgagaacatgcggtgtttggttttttgtccttgcgatagtttgctgagaatgatagtttccagcttcatccatattcctacaaaggacatgaactcaatccattccaaatttcttaccagcctggataacttggtgaaaccctgtctcttaaaaaaaaaaattagctggatgtggtggtatgaacatgtagtcctagctactcaggtggctgaggtggggggattgcttgagcccatgagatcaaggctatagtgaaccatgatcatgctactgcactccagcctgagtgacaggagtgagaccctgtctcaagaacaaaaaaattctcacatgtattttaatgtatgtattttattgaaaattcaaattgcataaattttgattattttattttcaattgatcttttagattattactatcagtagagcgaacattttgtgaaactttccattataatagcatatttagtaattttgctgacatgaaggcaagaaaaatatagttttagaatatttatattcatatattaaatattttaatatttatatttatggcttaaaaatatatatgttttactacttatccaatcacatattttctattttgttttataaaactacatgtgacaatgtaggaggataaaacattttatttagcacttcattagctttatttgtagctttttaaaaaaatgtatatacttattttaattttcaatgggtaacacatacatatgcatgaaatttaaatgtttccctgcctcctttgtataccagctacttaattcttttttcctttacttgtacctttgaaaattaattttaacatacatgtaattaacatagttacagggtacagagtgatatttcaaaatatgtatataatgtgtaatggccaaatcagggtaattagcatatatattttctcaaacatttattatttctctatgttgagaacattcaaaatcctctcttctagctttttgaaaataacagtaaattattgttaacctatattcattctgtattgctatagaacactggaatttattcctcctatctagctataattgtgtctctgctaaccagcctctccatactctcccctcctggctacccttcccaacctctaataaccacaattctactcactacttctatgagctcatcatttttagctccatcttattccagatcttagaggaaaagctttcagcttttgtctctttagtatgttagctgtgggtttgtcatatatggcctttattgtattaaggtatattccatctatacctaatttgttgagagttgttattgtaaatgatatttaattttatcaaatactttttctgtgtctattgagataatcatttgggttttgttcttcattttgtttatgagatgtatcaaatttattcatttgtgtatgttgaatcatcctttcatctctgggataaatataaacttttggatgtgctgttggatttggtttggtagtattttgttgaggatttttgcatctatgctcatcagagatattggcctatagtttaaattttttggttctgtccttgtctgattttggcatcatggtaatgctggcatcatagaatgagttaggaataatgccctcccctttaattttttggaatattttcagaagtatttgtgttagttcttctttgtaagtttggtacaatctagcagtaaactgttctgtcctgggctttacattgttcggatactttttattacttattcaatctcattgcttgttattggtctattcaggttttctgttttctcctggctcaatgttgataggttatatgtgtccaggaatttatccacttcctctaggtttttcaatttgttggtacacagttgttcataataatctgttatgatcctttgtatttcttgatctgcagtcaagtgctgtaccccggagctgtacccctcctgatccttcgtatttctatggtatcagttgtaatgtctccttttctgattttatttatttgagtcttctctcttttttcttagtctacctaatggtatgtcagttttgcttatcttttccaaaaaaacaagtttttttttttttgttgatcttttgaaattttttgtctctatttcaattctgttctggtatttattatttctttccttctattaattttaggttttgtttgttcttgcttttctagttccttgaggtgcatctttagattgtctatttgccatcttttctttttagtacttcattaactttaattgtaaattttctttgtttatttgaaatctgatttctcagaaatcaccactaaagaatttattcatgtaactagacaccacctgttccccaaaaacctattgaaataaaaaaaaatccattcagatgaaaaaggaagaaaaagaaataaagaacaaaaaaacaatgaaggaagcctgcaggacaaatgggacaacattaaggaaacaaatattcccattatagaaatttcagatgaataagagatgggaaaaggcataggaaacctattcaatgaaataatagctgaaaactttccaagtgttgggagagatatgaacatccagatacagaaagctgaaaaatcaacaagtagataaaccaaaaaaggttctctctgaagcaaattatagtcaaattgtagtcttttatccctcatccacctcccaccctttcccttgagtccccaaagtccattttatcattcttatgcctttgcatcctcatagcttagctcccactcatgattgagaacataatgatgtttgattttccattctcgagttacttcacttagaatgatggtttccaattccatccaggttgctgcaaatgccagtattttattcctttttatggctgcgtagtattcaatagtgtgtgtatatatatataatatatataatatatatataatatatatatttaatatatatatttaatatatataatatatattaaatatataatatatatttaatatatataatatatatatttaatatatatattatatatatataaaatcacattttctttatccactcgttgattgatgggcatttggaaaggttctatatttttgaaattgcaaattttgctgctgtaaacatgcatgtgcaagtatctttttcatataacaacttcttttcctctgagtagatacccgggagtgggatttctgtatcaaatggtagatctactttttgttattttaggaaactccacactgttttccatagtggttgtactagtttacattaccaccaacagtgtaaaagtgttcccttttcaccacatccctgccaacatctattattatttgatttttcgattatagccaccttcacaggagtcagatggtattgcattgtggttttgatttgcatttcccggattattagtaatgttgagcattttttcctatgtttgttggccatttgtatatcctcctttgagaattgtccattcatatccttagcccactttttgatgggattgtttgatttttttttcttgctgatttgtttgagatccttgtacattctggatattggtcctttgtcagaagtatagattgtgaagattttctcccattctgtgcattgtctgtttactctgttgattgtttcttttgctgtgcagaagctttttagtttgattaagtcccatctatttatctttgtttttgttgcatttgcttttgggttcttggtcacgaagcctttgcctaagccaatgtctagaagggttttgctgatgagccaacctctagaatggctccaatgagatgatcatgtaattatttatttttaattctgttcacatggtgcatcacatttattgacttgcaaatgttaaaccatcccttcatccctggtataaatcccacttgatcatggtggattatctttttcacacgttgttggattcagttagctagtattttattgaggatttttgcatctatgttcatcaggaatattggtctgtagttttcttttgttgttatgccctttcctggttttggtattagggtgatactggcttcatagaatgatttagggaggattccctctttctctatcttttggaatagtgtataatagaattggtaccaattcttctttgaatggctgatagaatttagctgtaagtctgtctggccctggactttttttgttggtagctttttattaccatttcaatctcgcttcttgttattggtccatttagagtttctatttcttcctggtttaatctagggaggttgtatatttccaggaatttatccatctcctctaggttttctagtttatgtgcataaaggtgttcaccgtagccttgaatgatcgtttgtgtttctgtggtatcagttgtaatgtctcccatttcatttctaattgagcttatttggatcttctctcttctttcttggttaatctcgctaatggtctatcaatttttttatctttataaagagtcaactttttgtttcatttatcttttgtattttttttttacttcaacttcatttagtttttttttgacagagtttcaccctgttgcccaggctagagtgcagtggtacaatcttggttcactgcaacctccgcctcctgggttcaagcagttctcatgcctcagcctcctgagtagctaggattacaggcgtgcaccaccacacctgtctaatttgtgtattgtgtatttttagtagagacagtgttttgccatgttggccagactggtcttgaactcctgacctcaagtgatccacccaccttggcctcccaaagtgctgggattaaagacgtgagctgctgcgcctagacagccaccatggcctacctcatttaattctgctgagatcttggttatttcttttcttcggttgggtttggatttggtttgttcttgtttctctagttcctagagatgtgaccttagattgtctatttgcactctttcagactttttgatgtaggcatttaatgctatgaactttcctcttagcactgcttttgctgtatcccagaggtttggataggttgtgtcactattattgttcagttcaaagaattttttgatttccaccttgatttcattgttgagccaatgatcattcaggagcaacttctttaattttcatatatttgcatggttttgagggttccttttggagttgatttccaattttattccactgtggcctgagagagtacttgatataatttagattttcttaaatttgttgagacttgttttgtggcctatcacatggtctatcttggagaatatttcatgtactgatgaataaaatgaatattctgcaattgttgggtagaatgttctgtaaatatctgtgaagtccatttgttctagggtataggttaagtccattgtttctctgttgactttctgtgttgatgaccagtctagtgctgtcagtggagtattgaagtcccgcactattattgtgttgttgtctatctcacttcttaggtctagtagtaattgttttataaatttgggaactccagtgttagatacatatatatttaggattttgatatttccctgttgaactagtccttttatcgttatataatttccctctttaaagcaactgctgttgctttaaagtctgttttgtctgatataagaaaagctactcctggccaggcatggtggctcacgcctgtaatcccagcactttgggaggccaaggcgggtggatcacgtggtcaggagtttgagaccagcctggccaagatagtgaaaccccatctctattaaaaatgcaaaaattagccaggcgtggtggcaggcacctgtaatcccggctacttgggaggctgaggcaggagaatcacttgaacccaggaggtggaagttgcagtgagcagagaccataccattgcactccagcctgggtgacagagtgagactccgtctcaaaaaaaaaaaaaaaaaaaaaagaaaagctactcctgctcacttttagtgtccatttgcatggaatgtcttttcctacccctttaccttaagtttatgtgagtctttgtgtgtcaggtgagtctcctgaagacaccagatacttggttggttaattcttatccattctgccattttgtgtctgtcttttaagtagaggatttaggccatttacattcaatgttattattgagatgtgaggtactattcacttggttggttaattcttatccattctgccattttgtgtcttttaagtagaggatttaggtcatttaccttcaatgttattattgagatatgagctattatgctattcatcatgctatttgttgcctgaataccttgtttttttcattgtgttattgttttataggtactgtaagatttatgctttaatgaaattctaatttagtgtatttcgaggatttatttcaagatttagagctccttttagcagttcttatagtgctggcttggtattggcagattctctcagcatttgtttgtctgagaaagactatatttccttcatttatgaagcttagttttgctggatacaaaattcttggctgataattgtgttaaggaggctaaagataggaccccactaccttctagcttgcagggtttctgctgagaaatctgcggttaatctgataagttttcctttgtaggttacctgatgcttttgcctcacagctcttaagattctttcctttgtgttgattttagataacctgatgactatatgcctagactgtgatctttttgtgatgaatttcccagatgttctttgagctacttgtatttggatgtccagatctctagcaaggccagggaagttttgctcgattatttcctcaaacatgttttccagatatttggatttcccttcttcttcaggaacaccaattattcttaggtctggtcatttaacacaatcccaaacttcttggagcctttattcatttttttaaattctttttttatttgtctttgttgagttgggtttattcaaatgccttgtctttgagctctgaagttgtttcttctacttgttcagttctattactgagactttccagtgcattttgcatttctctaagtgtgatttcttcatttctagaagttgtgattattttttatttatgctatttcactggagatttttccattcatatcctgtatcaatttttgatttcttttaagttggattccacctttctctggtgtgtccttgattagcttaataattgaccttctgaattctttttctggcaattcggggatttcatcttggcttggatccattgctggtgagctactgtgatcttttggtggtgctaaataaccttgttttgtcatgttaccagaattgtttttctggttccttctcatttgagtaaactatgtcagacggaagatctgggattcaaggctgctgttcagattctttggtccctcagggtgctcccgtgatgtggtgctgtaccccttcccctaaggagggggcttcctgagaatcgaactgcagtgattgttatttatcttctggatctagccacccagtggagctgccaggctctggcttggtactgggaagtgtctgcagagtcctgtgatgttatctgtctccaggtccctcagccgtggatcccagcacctgctctggtggaggtagcagggaagagaagtggactccatgagggttcttggctgtatttttgtgcactggttttgtgttggttggcctccagccaggaggtggcgctatgaagagtgcatcagctgcgggagtatagggaggatataaacttaccctagggtcgcctttgggtaagtattcaagtttctcaggtggtggggccgggctatagatctctcaagagattgttttttgtcttgggcttccaggacgggtagagaaagactatcaggctgggacagagttcagcatgtctgagctcagactcttcttcggcagggcttgctccagctgctgtgggagattgggggtgtagttcccaggccaagggggttatgttcccgggggggttatagctgtctctgctgtgtgacacaggtcaccagggaagtgagggaaagccatcagccacaggcctcacttagctcccatgcagcctgctgcatgaaaagctggtctcgctcccacctcccaccatgccacccccaacagcacacagtttatttccaggcagctggtgagcagtgctgagaacttgccccaggctacaagcctcccagctgagaaagcaagccaactcacagttcctcagctgtcccacagggcctgcagcggcaatccgcctccttcaaagggtctgtggtttctcttggctttcctggtatgttcctgcagtagttcttggagcaagttcatgatgtgagtctccacacatggctttgtctgagtgggagctgcaggttagtcctgcctcttatctgccattttttcccccgcattctccctaaatggattattttaaaagaactgccttcaagttcagaaactcttctgcctgatctagtctattattgaagttctcaattttatttttatttcactcactgagttattcagttctaacatttctgtttcgttctttttaatgatatctatttttaaaaatttctcattcagattatgaattgtttttctgatttcattgaatctatttgtgttctctcgtatcttcccaggtttccttaagattgttattttgcattttttcaggtgattttagattggttttcctttggggtctgttacttagagaattgttgtgttcttttgaaggtatcacgtttccttacttttccatatttcttgtttccctatgttgatatccatgcgtctggtgacacattgcctcttctgattttatggagtagctttcatagggaaaaatgtttttctgtatatgtatacgtatcataaatatacagttgggtaaggtgctttggctttggttcagtatgggggcagtaatgtagtctctgatttcttcagctataatcagcatcattggtgtctgtgagtacctcagtggcctgtgctgtggttgcttgtagaggctattgcacggctttgctgagagcagggacaccaggcagatcagtttgggggctccggcagtagggagcatgggtgtatggcaggtctaccactggagtgggcaggttctctgacaacagtgggcctgggtggcttcatcactggaggggtcagggtcactggtgatggcagcagccctggacagctggtccttgggtccctgagggatgcacttgagcatgaaaccgatctgctgctggaggggctggggtcgccagtggtggcatatcttggccaggctggttctttggcacctggagggcatgtgtgggtgtgcagcagttttgctctggagggagcaggttgccatcagtggtgggcctggtcaggcggatccacagtcctatgggaggggcgtctgctctgctactgcaaatgttggggttgctggtggcagcagcagcaggcttcaggcaggtagctcttggattctgaggagtgcgtgcattgcctccctcttttccgtgggcagccttcccactgtattagactgcctgttttctagggtgtggaaatactgtgtgtgctcagattctggggtcttggctgcacagctgctatcatgactctgcatccctctgggtggatgtggtgggatgtcccagggaccccaaggatgtggagatttaggggtttttgggccccagggcaagatgcacactggtggtggctctgctctcaacatgatgatgtgctgtggcagcctgtgtcctgcgggcatgggacccagcttgatttcctctatggaacaatgcaatcacatggtttccaggtagctccctatactgagctcagggcctgtcagggctgggggctctcctcttattaggactacaggcatccagcatggaaatgtggactgctggggatcttcaccttacctttttcctgtgcttgaggtctctctgggctctgagccgatcctagccagatgctttgcttccgtgtctatgctgctgtcccaagtctccatccccagaggggctttgtcacttctttgctgaattccagtgttctcccctagactctctgttcaacatgtgactggaggaggtgaatgctgagtacctctagtcagccatcttgatgatgtcttctgtaacttttcactatttctgcaaatggttatgatactgtaggcctggctgcctgtgctataaatgggggagtaggtctctttgttggagtttgtaaggatcactccgttatggccccagaaatcacactgggagagacataagaaattaaaggatctgttatatatactcacaggacttagggacaagaggcatggcaatccccaccacatagggcccatataggagctctggggagtgggctcaaccaggtagatggggaggggagagagagagaaaacccatggataagtgcctttattgggggcttgagtagagtacacaaacaaaaggtgtgaggggatttcactgatgtgtttgaatgtcactagaccactgtcaggagagggctaatgggaacttgtgacaagtaccagcattatcacactggtgcacctggtcacctggttggagtgcttgtaacctgctggtgggggatgttgagggattgggaaaatatgaatttttaaacatttacagtatacagtcattgcctgttgagatctgtataattaaaagaattccaagaaagaatgcacacttttcttgtgtgcagaatcacattcattatttgaagagtctctacatagtttctaggaatctacagcccaggaccacagaactgagatatagttaagtgtatcacgacaccatttcagaacacgtcatcaactcggtcttgaatttgcagcattcaactgcccagcacaaaattagtgagaaaacaggcataagaaagcttacaggatctgaaatccacagggctttcgtttttgatttacactaaagttttagaagttagacatgattatcatgaaaggagaatgtcatatcccttcctttctattgtctactttttttttctcagcaaccaatcctagaatttatttgaagaggagaagaaatgagtaaatcgatgaattagaaaagtaacgcaatctttttgtataaatactaagttatctccaggatctatgaaaatatcaaaagagagaattattgttttaatttattgtaattaaaaatataagcatatacaatatagcacatttaaatggagctggctcaatatctaaaatcaaaaatcgttctctccttatagcctatttaactttatattctcagcaacttgcagcacatgacaaacattaggcattcaataaatgttggtgattgaaagaatgtttatgcatgtgcttttgaaacttggaagaatgtcacatttacatttctatccttccaccgtctttctgtcctcagtccactgatgatcagatgaaagaaaagcacaggtggtgttagcaaatgaatcagaatttccaaactgtaatgcaggtggccatggacagttgtaggagagagttctccatggcctgcaacatgtggacctggactttgatataattcaatctaacaaacatgtattgtaaatctatgatctgcaaatcaccctgatagatattgtgaggctgcaggatgagaaaaacacaaaacagatgcagttttaaaggttggaaatggcatatttgagatagaagaaggcaagtaggaaaacagctccgcaagccaacagcatagtccccaaagggccattttcagtttgacaaggagaagcactgtcgttattctggcctgtttcctcattgcaaaaatagaaccatgaacctttctcttctgctgataataattttaaagcattgtcagtgaagtaaatatatactgaaagcaataaataaataaatatttaaactccagaaagattgctgagcttcagtgatgctataacaggaaataacaacaatcagatagtgcctcggcttactgaagaactaattcatgtttataaagtgctttcagaatgcaaagcactgaagaaggttaggatattattattattaccaaagatctttaagcagacaagatcttggtattcttataatcacagcaggagttgttcatttcccatgtaatttatgaggagaaaaaaataataaaccccacccctcttcacacttgatttgtcagttgttcttgttatatgaaactgatcctcaagggaaccttaatttaggcaacgatttattctcttcaatattattttgacatttggtaattactacagattttgtgcatctgtctttcccagaagagaaggcattaaatgccacttggatgatcattggttttgcaggaactcagatttgatgttattcttttggtagatagcatgacttatggtaagtttccagctctgggatacacagattgtgcctttcattactcatggagtctgtgccacactgatattagatatttcataaaaataagctattggttgaaagaagaatatcttaaatatttcatatgaaaaaaaactggccttttccaattttccacacgtattctaaagtaactaagatatctggaaattttcaaaaatgaaagtaagaaactggaacagagatcagaaattccttaggaacctctctctaggactctcaaatggacctcccaaagaaaacaaataagacccccaaaaaccaggaacaaggagagttacatcaacaatgagtcagatgctttcagaactgcttcatgctattcctgtacataagcttttttcttatcaaattttatggatgatgatagcttcttccattgtaaattttcatctgtgatcattagttctaacaagtccagtcctcccatgttagattttgcagatttaaattttaatatgaagatttgattattttgtttattcagatcagtaataaatttcaaggcatttacttttggctattgccaatgatattttttatttgttattttaaccagaatattataaactggaaaaaatgtattatttttaagatgatgtctgaatgaattgtgaactactttgtgagatagaaagacaaggaaaactggagggagaaaggggagacagggagagaccaggatggagaaggaagaaagatagaggaaaagagaaaaagaaggatagtatcatgaatgagaagatgtgagacggccatagaaaagaggaagacaggataagaagttggaaaagggggagaccagaggagaaagagggttaaaaatgttctagcataaagaaagcagaatggcagagtcaaatcatacacttctccatggctacttaaggtttagggattaattttttctctctttctctcactctctctctctctttttttttcttttttttctttttaaagacagagtctcactttgttgcacagcccaggctgaagtgcattggtgcagtcatagctcactttaacctcaaactcttagtcttaagggatcctcctaccccagcctcctgagaagctcaaactacaggcacaccccaccatgcatggctaatttttaatgtttaaaattttttgtagagccaggttctcactatgttgcctaggctgatctcaaatttctggactcaagcaatcctcctgcctcagcctcccaaagtgctgagattacaggcataagccactgcacctggccttttttctctttagtgcctggtatagtgcctggtatattataggtactcaataatcatttgatgaatcagtagatgttaatggatcaagctagcctccttctggttccttgagcaccccaggtacacttctcttcttggactgtgtccccagagatttgcttagttcacttctctacctcctcctcacctttttagtaatacctaccccgagcagccaattaggaactgcagctaaccccatactccccactcactgaaatcccctaaccctgctcccccttcccatggcactaatcatccttgatatataatgtggttttgcttatatgttatatttatggtttattgtctatcttcccttgctagaatggaatttccatagggtaggggtctttatttcagttgctgatttatcccaaatacctagaacaatgcctgtacaaaatggacaatgaatatttgttgcatgagtgaatcatccttatcaatatatgtccatgttttctcttgttctctttttctctcattcattctctcctccccttcataatagttgacagagaatacaacctcaaagcatttacttattttctaacttgtatttaacgtcactcttcaatttcagctgcactgcagcaaaatcctgcacacatgacctgctgttcccagaaagggtctttttgtgcatattatattgccatttttgcctgagaaggcctggactgatgtccaaagaacattccagaacactgcagagctacaggtcagcctggctcaaatttgttgaaaagctcttctacatattaattgttttatctgggtattagttattctctctctaaggaaataatcggacaatggctttttttttttttttttggagacggagtctcgctctgtcgccaggctggagtgcgatggcgcaatcttggctcactgaaacctccaactccctggttcaagtgattcccctgcctcagcctcccaagtagctgggattacaggcatgcaccaccacacacagctaatttttgtatttttagtagagagggggtttcaccatgttggccaggatggcctcaatctcctgacctcatgatccgcttgacttggcctcccaaagtgctggggttacaggcgtgagacaccacgcccggtcagacaatggctttttaaggcaatttcatgccatcacaaatccctctggagaactaatttgccatgctagggtagaattcaaggctaatgctattatttggcttgtactctgcccttgttgttgctttgtttaaatgatgagtaggcccagcaatagtattagttcatcaaaaagtctataagttatattcagatagtttgaggtcagcaaaacccagagtgtggtttacacaagtgctttctcccctaatccttaaatccatagatatttcaaagtaaacttaattcatatgttttccattcatttgcccttaggtctttatgtttaggggagggggtggtggaaggcaggaaggtactgttctaggaactggcttccttcttcactgccacagacagatcattcattagccacagacctggtttcttggcagaagtccatacctgtatcctttccagttccctgttaattgaagctccaacctcagcacacatcattgttgctgccaaagaaagtaaagtggaaagaggctgcattttctatcatagaaccacagaatcctagaatcctaaacttgtgattctaaagatcatctggttcatctaccatgtgaaccttaaatcacctcgacagtatcctggctaattacctttcaccctctgattaagcatctccagtgatggagcttcaatagccaatagctttaggaaagactctcagaaggaactgagtcttgttttctgcagcccaaatttctccagtcccttcatccattcagcaagatttaaaaccagtcccctgtgttcccctcatgttctctttccacgaagatttcactctctcccatgatttcaggttctgcactacgtgtgtccttccctggtctgtgcttcctgatccagctaccccgtgggcatcacattctgcctctgatacaaggaccttgagataaaccaaactgactgcttaagctaacccctcctttaaatcttgttatttgtcttgtgttgccatttcaaaaatggcaagatgcatctcaaagctcctcttcctatcacatcccccacagttaggtgacagatcctatcagctgcacctccaaaataggtcccggatcggccccagcttcctcatgtccaccatgtctgctttagtttaagatttggtcgtctctcagctgaactgaggcagcagcctcgtctctcatctcctggcctctgccctctttcttcaccagtcccttttccatgttgcttccaagtttacctttctccagatcatggagatagcaagaatgtgtttatggcctcccatcctcatcttatctttatgcttctttatccgggtcttgtggaaagatggtcagctaaagagaagctaggacaagagtgtggcaacccccaatagaaaatattcaatctcggctgagtgcaatggctcacgcctgtagtcccagtactttgggaggccgaggtgggcggatcacaaggtcaagagatggagaccattctggccgacatggtgaaacccggtctctactaaaaatacaaaaattcgctgggtgtggtggtgcacgcctgtagtcccacctacttgggaggctgaggcaggatgctaacttgaatctgggaggtggaggttgcagtgagctgagattgtgccactgcactccagcctggcgacagagcgagactccatctcaaaaaaaaaaaaaaaattcaatctcatatatttttcatgaccctttgattctgaatctgatctactgaatttgtccccaaactacctggtccttgagggatactgaggtgctggctgacttccctgagcccatttatgcctcttcttaaggtgcagcttgtccaggaggtcctcagcatcctccctgccccctttaagctgtggctaacacagcactccagccacactgtacagcccctgcacactgcgctcctgagctgagtggttgcagagcccttgtctcccattcagaactctgcttatcaactccgagtgtgctcatgcatgcatcacctctccaatgacatcacttgctcatgcatgcattgcttctcccctgcctatcccttatttatgagcctctttatccagcaggtacctctcctgtagcatctgttgtgctgtatttgtagtttgttgctacattttttggaagtggttgtcctttgtgggcaggcacatggtcttagcatcctctgcatattccattatctggctcggtggcacataataggtctcaaaaatgttctttgaaagaatgcatgaatgaatggttgagggaatgaacttctatcacatttccttattctccaagtctagtaacactttctggaaaggaaatacaattattttctctaagtgaacctaagccggtacctatgatcatttaattttctacatccttcagtgagccattctagtctttcagtgattcatcatagaaccttatagaacccttgtcaagctgattgatttataattttcaggatccatattcttctttcaaacaaacagcacagctatatctgatggcctccaagtgcccagcctaataacttgcccaagcgctcacagcccatgagagccaggctgggagtggaccattcaggggctgccctatctgtacctgtgtgccgtggtacctgccctctctgtacctgtctccatggagccttgtaaacatctagttagagatgctgctaaatttaaattgtcattatatttcaccaaacatatttcattaagtcactgataaacattcctggcatttttgattattttccttttcattcaagcaaggatgtttttctcctattgtttttaccatctctatatctgtatccaggaactgagcttacagctaatgatctaattcagatatgtgtaaacctgggtataataattagcccagattggtggaaacgtttcccctttacgcaacccatttcatccttatcaagtacattaattcattggctctggtaatatagctaattaccctgtatattcaggtgctgctgctgatattgctgctatctccatgtgctgggataaacagactgttgttagtaaacattccttctgatacctaccttccgccatcactacgcacgtactaatatgtcttttttgctctgttctttttcccacaacagtttaacctaaaaagggccacttcatttccttaggctgcacttctaatgaatgcagacatttgaaagggtcctgaaccggataacctttcgagttttctccagttttattattctgtgaagacagtttggtgtaaatgatttaagaggttagtcagaatggagttctctgttcaaatgatcttcttaaatttctgtactgagctctactcataggaaacgtggagcttgttgtgggattcacaaggttgcccttgcaagtacagaataccgtgcctgccacacagtaggtccaataaataaaacaaaattaaacaaagttaatttaaacaaaattaaagcctccctagagctaatgattttaacttattaccatataataactagcaagttagtgtcaatctcaatctaaattttcaaggaaaactgccccggtagaaatattgtatttttattagcactgaatttgtactcctaacaaaaaattaatgaaattccttaaaagctgatataaaatgtaaattacttatccttggacaaagaattcagatcttccttatttattgttaagaattcccccttcatcatacctatttgaaagatcttggcttaaactgagaatttgactgctaatattcacacatatggcaaatatgaactaatcagaccacagatattttgctgcattccatggtgtctcatttatttgtttaatttgcagctatagcaactagattccaccactttgggcttttacacagaactacagtatgatcagcttggttgaagtttggcactcgacactctgctcaattgaagacatatgcacaaaatcacttaccacattttttaacctgtttttcacactgggtaggcctgtaatatttgcataaaaatatgaaaagcaaccttctgcagggagagaaggcaattaaaagatgttgcgacctttctttctgcagcatttcaaagcttaaagttttcttggcacgcttttcaaacgcccatctgactttgaagcaggctgcctctccacagaaagcttgctccagcaatgactaaaggattgacctggtgccatgcatgctgctctgcacaagaaggacatttggaaatgaccttgaagcgaagttttgccaagttgatgaaatacgggccttcaagaagtgccatttctcaagcgatgtacagaagggtatccgcagcattgtcaaaaattaccccttaatttggtgttggatgaacatgaatttttaacctccataaggaatgatacttgctcttgattttattagttgcattttgtaacaggttggaaaaattaggtaatggagaactttggcataccacttttgtttcttttaggtgatttttaaaaaacatttgctgaaggagaggttgatgctcaaagggtacagtgataaatggagagacgggagtttaaaatgaaggataagccgcaaatgaggatgaagttaatggatagagaaaagatgggaggaagaggtatctctctttactcgtaagctgcccatcgatatgatttagactctaggagaggggcgtttctttcctcagtaggcacactcatagagtaaactgttgccgctgtttaaacatgttaattgatgttgacaccagttgttgctatacagttttccattttactgagcgatgtatttatgttgctgcataatgtcgcctgattgcacttctcatgctggtgaagttggctgacatttcaggctctggataacatgaagctgtgctttaaccttatttggaagtcagggttagagtggcactggaaggtctccttcagcttcccttcctgtgacctgcctactataaccctggcaaggctgagacagtccaagtttggggcagtcaaggtgggacagcagaagatttcagggtacaagtcatctattctcttatgccagctctcagatttgtatataaaatctgattctacacttcttttaacaaataataaataaataaataggaccatccaacccctctagagctctctaaggagactgtagaagacttgtggccactctcattttaaagattctaataatctccacaaagtaatcctgggaaacatacatctgtaagaccagggaaacatactggcaatagcaacttcccagaacattcctttttacactgcctgggatttttcaataagaaatttggcatttctgtaaatttaaagtgtattcagtaaaattaatgcgtttttttcttaaaagctcaagccttccagactcatcattttgtagttaaaaaagtaagccatgcaactgagataaaagtcaaagttatagattataactgtttgcacaactgttcacatttttaactttttttattttttggagactttttaagagtctcactgtgtcatccaggctggaatacacagtggcactatcatggctcaccacacccttaaactgcagggctcaagcaatcctcctgcctcagccccccaagtagctgggaccacagatgtggaccaccacccctggctacttttttaaaaatttttttgtagagacaatgggctcactatgtttcccaagctagagacaatggcctcattatgtttcccaggctggtctcgaactcctggcctcaagcgatcctcctgcctcagccttcctgaagtcctaggattacatgcatgagctaccacacccagcccctgctcacattttatatagtaacttattttaagaatagtaaagtatttgcaaaatagttttttaatacagtaatttattatatattgaaatcaagcttgatgatatttcattaggttttgctgagtgtcatatgctaagttatttgcttatgaatttttctccaattgcctgtatttggtaagtttgcatggaaagttctgacaggaaactcagaaatatttcattgttttaccctactatcttttttgatgtgtcttaaagttgatttgctttaaattgcagtatcatcctttttttctgtacctaaatgtttttaactgaagaacacaatttccctcaaaaccctcatccctaatttagagccctcttatattaatatgagtcattttaaatgtatttcctgaaacacttctcaacttcgtaaataaaaaagagatatatcttagtccattcaggctactataacaaaatagcacaattgggtggcttataaacaacataaatttatttatcatagttctagagcctgggaagtccaagagctgggtgccagcatggttgggttctgatgaggatcctcttccagattacagacttccagcttcttgctgtgtcctcacatggtggaaggaacaagtaatctctctggagcctcttttaaaagcccaccaatcccattcattgaggattccaccccagtgacctaatcacttcccaaagggccatctcctaatgctataaccttagaggttagggtttcaacatatgaattttgaggggacagaaacattcagcccatagcaggatgagaaaaagaaaggaaagtacaacaaagaacatcaaccataaggaacaccatgacttctgatatttaatatcatggatcacagattgtaggagtcgagaaacagaataaaaagacaaggcccaggcccagtgagcttttgatgcttgaggctcctcatgcccttgctctcccactgacctcagtgctcagcactggctttcttctcctggtgatattttccatttatcttttggtgtaaacattttagagatgagagaagtagggagcttatcattatttagtctgatcagacaatatcttcacttttaagttatgttcagaatttcattgtcctgttctttttaagaatcatatgagattatttttgtgtatgtgaataaactatgaagcattttcttacaaaaaacttcattcagtgtcctggcacagatcctccagttgaacaggggccttctttccaaagccccaggtaaggactttctcaacctgtattctaacatgatgggatgttgtcttctttgctttcctatcttatcattgcaaactctcaaacattttctacattatcatcatttatatttatactagcacacatgtttgaaagcgatatgatccccattgaaaactcttttcctttaaaagtcaatcccatttctagaggtcttgacaatgctttcttctttccatgccattgaagttgcattaatgttggtcaaccctggatggctcgggtctcatactcagaggttctgatggattcagtctgggataagactgagacactatctatttttttttaatgctcccttacatagctcccttacacgtttgaagatctttgaatttgttggtctcacaagcatccctggggttcaaaaaatgtgggtattggaagaacacaaagtgagggaagctgtcctggtgatatctagatgtgagctgaatggagcttatggcaaagagacaaacctgagttaatctgcataatcacgcacacttaactctaatgggttagttatagggtggtatctctgcctcagtttctattgcaataaaatactggcatcatctcaagattctcagaaaatttaattaatattaatatttaatataagattaaaagcatactacaagtttcaattagcattaatcctttaaaatatggagttaaatgatctgtaactaattaaagactgcagttaacaggggacatgagttttttctgggttatatgaaacaaaatataaatcttttatataactcaatttcctacagaaaaaaaacttacttgtcagtgggattttaaagttttattttattttcttggatctcattacttttccatgaatcctataagcagaattacaatgaggtgagtcatagacttaacacttttttggagtttcttctgccaaagcagcttgaaatatagaggattttcaaaaactgtgtttggggaacatgggaaggtatgggaaagaaaggaagggtgggagtctaggaggaaaggaggaagaagggaaagaaagggaaagggagaggaaggaaggacacaaaacattttactttagattacatttaaaaaattttaatgacatttataaaggtaaaactttcctggtatctcatttgcatgtttcagacaaccctgaggtgcaaatgaatttgggtttcaaaagttcattcatgagccagttatttggaactggaaacatgtttccccacgaaagttttgttatataagtggtagttcatttttgaggctagttcccaaactctcctcattctgttttgaagctgaattatcatgcatttacaatgataaacagtagattatacagttgaaaacttgtagatgtaaaaaacataaaagtgataaaatcaattgtttaattgctttaaacttttaacttcagtgctggtgctggagggaaaacagatttaatttgaggagtctgaggatgttcaagacatctaaggttgatatttgagagcatctgtcagagaagcagcagccattctctcgggagggcctctgccgccatgcatgtgcttcaatctggtcactaaaaagccacatccttagactgaaggaataagtcctcaacaaaaatgccttcttttcttcctaggccaggcatggtggctcacgcctgcaatcccagcactttgggaggccaagacaggtgcatcacttaaggtcaggagttcaagcccagcctggccaacatggtgaaaccccatctctactaagaatacaaaaattagccgggtgtggtggcacatgcctgtagtcccagcttctcgggaggctgatgcaggggaatcgcttaaacccaggaggtggaggttgcaatgagccaagatcgtactacttgcactccagcctgggcaacagagcgagactccatctcaagaaaaaaaaaaaaaagccttatttttttcctgtaaccagtatcaatggagcacatattatggctagtgctcctcactatttatgctagcaggcaaaacagaaagaactcctgtccttgtgagtttataatctagtgaaggagacaaatatccaaataactgcacaagtagatgacctatgatccatccatttttataaaaagttgttgtatgaacattcaagtccaaacaaatttacaaggaataatgatgacacacagagggtggatctggagagtggagtacataaatctttaagtaactgctaggggccagccacttccatatgctgtcacatttgttccctaagtagccctgagggggaggaatcatcaccaccattccacaggtgaggagctgagactcaaaggagttgaggaatctgtccatgatggtgcaaccaagagcctgagttcaaatcaagtgtgtccagctccaggcactttctgcccatctaaactgcctgctctgcaaaaccactctgaagagattttctattattttactcaatatgagtgtatccatgcaataatctctttctaaaatttagtgatagaagccatattgcctcacctgatactgatatgttcctttctgttaataagagctgtttccacttctcctctgacacggttagtgcctttaagccgtagccagcctatctgtggcttccaatacagttttctgtctttcattcctaccatatattttgtctgattcttcattttgtcttgactttcaccaccctgagccttttattgcaagctaccttgaccttttgagaagtagtgagaatatatagaaaagaaatagacttctgtggtgtaaattccacaaagctctctttttatatcctccacatgacctagaacagggccttgcacttagaagtgaacaataactattggttgttaaatgatcatagcaatagcaattctgaaggacagttctgcttattttaaggacaaccaagaagttgatggctctggctttatatgtgaacttcatcataaaatgtacttactgctttcctattccttaatagagatttgtctcttgtattttcttctgtttaccactcataaatggaatgtgaaggacaatgatcacagctcacttgcgtcacattcctccctcttgctgtgctaagcccttttagatagtatttattgaatcctcacaacctgattattatcccatttcatggaagggcatactgaaggttagagaatttcaggggtttaggaggaaagtgaggaaataagctttctcctgatgattcagcaagaaataggaaaaaaataggggaagaaaaaggatatatatttcagtatagatgagagatacaaattgctttaagtataatcagtaaaatgtaggagaggctggagaaagtcacaaatgatttatgagggcatgattcttcctgcttatcccctgtatattagtccactctcacactgctataaaaatactactggagactagataatttataaaggaaagagatttaattgacttacagttctgtatggctgggtaggtctcaggaaacttacaatcatggcagaaaaggaagcaggcgtgtcttacatggcggcaggtgagaaagagcaagcatgtgaaggaagaactgtcaaacactcacaaaaccattagatctcatgagaactcactcactatcacgagaatagcatggggcaaactgcccccatgatcccatcaccacccacgagttccctccctcgacacgtaggggttatggggattacaattccagatgagatttgggtggggacacagagccaaaccaaatcgccctattatgttgatgagcacggaaaagtcctctgcaaactgctgtttttaaatatgagacattctcttgtcaggtgatcataacttgggttgacttatacatttctcgaatccatctatttatttggataatttcaagttgagtagtttatgtgtggataaaaacctaaaggtcttctctatggtttctctggcctggcttgtgtttttgggagtcccccaagatgctgtaaccccagtacccctggagaacctgaacgtgtgcttgatgtctccacgtcacggcaggtggcccccagcatgctgcctgtcatcactgtccccgatgctgtcccgcagcagcaccccaaggctctctgggcacatctgcagctctctagaccagaaccataaagaaacaaggttctctctgtctagtcccactggaaagagggagaagccccattgtgagcagtactacgggggagtccctagaaagtgggcctcacccaaagaatgaagaggagtcatagtaagagatttacccattcatggagattggcccaacacatatttatttaaccccttgtttgtgggattgttctggatactgactgtgttcctcttgagaaagaacagccaataaaagaggggaaattaaagctccttggaagggtggagaagtgaagaactctgggaccactctaaaggctgacggtgggagtttagggtggctatggtgatttagggagcaatttctgtttcatgctgagtctagggaacttggaatatttacatatagctggaagaggaggtaaaggtggagtatagctggaggtgtggttagagaaataagcaggagttcagatcctggagactcctccataccaaaaactagtttaggttttaccctctaggaaataagaagcaaggctaagttgtgtgagtacaatgattagtttacacactggagaaatgggaaacaaaggaaacgtgactcagtgttatcctgatagctttggggagttgttgaagagttttaaacaaggggaagatggggtcagatgaacattttagaaggcttccttctccagggctgcggggaaacgttgacaagcacaggctggatttaggaaggaatagaagaaggctgagagtggaaccttggcgactggccaccctgagggagcacgggggaggacacaacacagggaagctgggagggagccctcgccagggagggagaatatcttagggaggaggagtgcagggtagctgaggagagcacttccagaaggaggcagggctggcaacgtcctgggcacacggaggtctgaccagacaaggacagtggctggcacaggtgctcccgagtgccaaagtgaccacaagaaaagccgccagaagaaaagaggagccttgcctggaaaacaaaaagcaattaaacatcttgtcatgtggcatgtttttaggggaaagatgatggatggcttcatcttttacttgatcccgaagcaagggcagattgagaagcagagtctgagggacagatgattttcccctctggccttggctccttctgaccttctattttctcccagtgaaagaggtgctgtttctggcctgtggccttatttagcaggctcagaactttttcccagcttcatgataatggcctttggtgctctttctactgcttaatgtactgtcatccagaataatccttttctatattgatctgaatggtaatctgtaaataaaaaggagaaatcataggagaacttgcagaaaaatgggaaaaagtagttacttgttttgcacatttctggaggggaggagagagaatctttaaaataatctcccatttgtgccttctcatttgtcagcacatcaaaagcaacaaaagcaacacacacacacacacacacacacacacacacacacacacacacaccccaatttgataagttggaaaactggctgcacgacttagagtatatgtctttctttaaaattttctgaaatctgatgtggatatttaagagctttcagaaatttccataggcatgccattagagataagccatttgattctgaggggattcaaaaagggaaatgtactttatctaaagagatgaaattggactcaacttggagaaatggttctctgaccagatgtcatttaaaggcattggactttgggctccaggcgttgactgtttctcaagataaatatgcatctaggaaccaagaagggcattttcaaggattgctgtgagttggtattataatgtgctaagcacacccctgacgtctttggaggtctgagcatacaaatcagacataaatgcttctcagttccttctcataatttctctgatcttactggcaataaaaaaaagaaaaaaaaactcttcaggagcataaaatgttattgaatttgcagcagtcgtcatggttacctgcatagtttcattgctttattaatgtgtaattcctcttatttctggaaatatcattatagtgaaacataatagtctgcagcctcttagcaagtttctctgtgtatctcagagatcctgacaatggctgtgatgaatgtgtgtgtggtttccgggtcacttgcatgctgatgatccagcaactgggacatcattgtttaggaaaagacaacttgaagctaatgactcttgagaatcccttgaaagttcaaatgtttctcgacacaaaagtgctttttttttttttcctgtaggacagtaatccaaggctttactctttttctaactaaaataatttatgtttttgtacatcaaaactttttaaagcaattatttttacttactaaagtcactttgaagtgctcaggaaactttttctgatcaattctttttaaaatgatctttattaaatttgtttcttgtatcatagaagggcttttgggagacactgttagtagaggttttgagcaagtttttctaagtgtattctcccactactcaagaagaagctaaataaaatagttcattaacttatctctcaggccaactgcttagggcatactgatccttatactcatttctctttttcttgggcactcaaccagaatatatttttcagcatcccctgcagttggttctggccatgaaaatcatgagacaatggaatgtgagtggacattatgtaataatttgcagatctgtcccataaacacctcccacagatcctctagtcccttatttccaggttggttggtaagtctgccagcctagatccttgaataattgggtagaacagagcctcactgtaggtcaggaacatctgttgttagagaaaggagacaaaccctctgagatgtgagggttgtgtattacatcagctggtattgccctaactgttgcattgcttgtcaagcatttcttctaagtgggccatatgatctttgggagatagatcatatttttcatccacgagtatctcccataacttctttcatagcctttaaaaaagaagttggtgttgtataccccaggactttcctatcaatgtcctgtgataatgttgctgttttggaagagtcctggagacttgaatggctacagcaatagtggatattttgaaaattatcagaccctgtgacctatgtgcaaagagagccaaaggaaaggaaattaatcttttctggatacttctgtgtaccaagtactatgttcagtcctctatttactctctataattgatcttctatgaacagctatcattccattttacagatttttaaggtgtcatatactttaaataacttcttcatagctaggaggtggcgagggaaaatgcaaacaaaagtttgcctagaaccaaacccagccagcctttctactttgctgttttccatggcgtatgctcagttaatgtctgctgatcaccatctccaggacagaatctgacagctagtaataattggaaacatatgcagacaacgtttgattatctgtggtgttgggaatagatgctctcattagttgttagaaaaattataaaactgacattgttgagttttacattctatcttaagatatcagaacagctgttttaacagataccaaaataacagtcgtttaaaatcgatggtctggaggttggcaggccagttcttcctcatgaggtcatctagggcctgaggctctttcatctggtggcttgtggatcttctgaggttgttcctcatctgcatagtggcagatggcctaccacaccacgtctgcatttaagccattaggaaagaggggatgagagggaagggcacatttctttccagttgagggcatgacccaaaaattgcacacatcacttttgctcccaaaagttgcagggttgcacggacatctaactgcaagtgagtctaagaaacgtcgtctgtaagtgccagtatgtctattcttgtggaaaaaggagaaaagagagattgtgggacaaatagcagcctttgccataccttctttcctgtcccaatctttgataaacctacaaataagaaagatccaaaactgcagtagcagaaaagggaaggaaatgaatcatggaaactaggtaattcagaaattgaaggtctcctttctccttaacctcttccagtgcatatgctaaaagaatcaacagttcgtttcttgcattaaattgctttaaaataagctataactattaaatcagtattcgttgaataaaatgattgcaatgaattgagaatatttgaacaaagactagatgttaaatcatattaaatgattagaattaattttgttaggtttgacatgtgattaaattacaaagcaaaacctcatctggtagagacatttactaagatatacataagtgaaatgatatgatgtctgaatttgctttaaaatactcaagcaaaagatgggggggtgatgaatagttgaaattaaatcgggaaaaatgttagttgttgaagctggatgatgggttcatgggggtttattatgctattctttctacttttatgtgtatttgaaatattccataataaaaagttaaataaatacttgttccaagaaacaaaaataatttttggctgtgccctgattttcatatgagctcatttctgtactccagttaagtgctttcttaagtttccagtgtattatttattctgcatgcatatacccagaaaacttattttcatctaaataattcattaacaatttgcttttgagtcaactaagcaagattttggtgagtggccgcttcatccagtgatagaagggatgtaaaaagcaagtaagataaggcccctctcaacaagtttaaagtcgactcaggcaaataagacagtgccttagataaatctaatttaagagaagtatacaagaaggcttaaatgttaggagatcacatcaaattagaaggatcaggaagagtttcctggattagatattataagctttaaaggaagggtaggcttttgacagatggaagtggtggggagagtaggaccaccaggagaaaggctccaagccaaagaacatgtgatagtttcctggtgacaggaaagaatgatatggttttgagtgtgggtatctggatgtctcattagagtaaatcaggaagtaaagaggatctgactgagaaaattgatactttttataaggatgtatagttttgagacactggtgcatctcaagatgagatgttcatctcaaaatacagtattggagcacagagaaaggttagcgtggatagtcagctgctgaatttgaaagttgaagctgtaggtagagtatgagtttactactgaagagaatagagaaaatatttttaagccagttttattggagtagaaaatggaaattatgacaacatcattgtgaaaatgacataatgatttcagttcacattaaagatactatgagtcactggtgtaacaacagctgtattccctgcccacccccactactgaattctcagtacttccttatccacacagtgcccccatatctctactttatttctcctttctccctcactctaagcttctccagagttgtcaacccagaatgtttccactgcttgacttccattcatctttcaaccgactctgaatcagaattcctttaccacgccactgtaactgttagttatcagtgaccgccgtgttgaccaattccatgaacactttttactcctcagttcccttgactctctgagtaatgcttgacctatcaggcaagtcccactttcttggaactctctcttcctggcctctggttttgcttttccgtttctttgtaggctcctcctctcctggacatttacgtattgtgttgcctcaggaccattgctggactctgcctctcttcctacaatctcttctggagggatttcttcctactccacagtttcatcccacaaaagtcaacaaagcacccacatttatatctcatttgagttctaaacctaccgagtatctcgtggatttcccatagacatttcctatgtaatacatccatactgaaatttggactcccacatccctcccaaacctatttcccgtctcagtaaatatcagtcatcgccatctaccttgctgctcaagacagtaaagtaaatcatttagtttgcagagagtccatgggacaattctatcaggaagcccaagcagatactactttattatgaaatattctttgaaccccagactgttcccaaagtggctgaagtttgtagtccttaaaaagaaaagttcccaaactgagtacagtggcttgtgcctgtagtcccagctatttgggaggctgaggtgggaggattgcttgagccctggagttcgagactgtagtgagctatgatcataccactgcactccagcctaggtgacaaagtgagactgtttcaaaaaaaaaaaaatcttaaaaattaaaaaggtaaatctttctgatgtaacttcattgcttcatagctgtttgatttaggcaccagtgctagctttaaatttaaatctgtggttgcctttgcgctatatatttttaaaggatattgtgggctacttatactaagaagttaagctctttgagtctgaccacacttggttacagacaggactatcctccgtgggtcccacaagtagaagggaccctacgaataatctgagagatgcagatgttgctcttctatccatcagattagaaatccaccagtgtggacatctccaaaacctttactatgcccaacctttattaacgcttaattctcctctttgttacggacctggggatcctttccttcctatcctactaggtcttgagaaaatgaaattaaagtaggcttgcattttattcaatctggaaaggcacaatgatttggtggaaagatagcctgcttctagttccacctcaggaactagcaagttagttgtaaacctgatgagtagagccatccttacgttttttctgtaccttcttccacatcaaacacatcagaacaacgaactctgcttgagtatttgctttgtgccagacactgccctaaataacagatgagggaactgaggcttagaaagttagtaaatggcacaaagatacccagttaatgcaaacccacaatttaaatccaggctattcaagtctactcttaccaactctcttatatcgtgttgccgagaaacgacttctggatttcttcttcctctcattcctactgtgccattgatgtaagaggtaccatcaatttaatttaataacagttttcaggaaataaagtaagcactaccaaatcaagtgtagttatagtgggcctgccttttaaaattctaaccaagtttttttccttcttggtaattccttttttacttcatgtccctgaagctaaaatcctcagggacagctaatcacaaaaaaacaggcagattcttggctattgacttctaaaattgggtcatgcaactcataaaagatagccaggagccagggttggtttttgatttggtttggtttgaattataagacagaatttgttaaagataaacttaaaaaaattctttaatgtttcctttgcatatcaaggactaaagcctgacaattctcacatcaacagtagagtttggggagaattaaggatgatgtcagagaagcttcttgtcccaaaagagattatgttttagctgctggcgggaggagaatctgcagtttaggtgctgaaggaccctgagaaggttctgcattccctcgtgcccctggaatgggagatcactgaaaccccagaagtgttttgagaaatcccagcatatggggaacctggatttgatttctagagcttcacttcccgggagaggaagcaagcagcatcacagaggagtggaaggccgcaatcactagcggaggtgtcccagcaacatggaaaatattttaagattcatgtcccaagaggctgccctgagagagtcagaagggccttgataacctgatgagggaacatcattagtaaatttgatgtgcattctctgtgctggaggctgtggaaacagaaacaatgtctgcagcaaaagcagtgtgggtagaagtctccatcaaagatgagaaggtaatgaaccagatacctcccctatgatgccatgatacatatgggccttcttagaattactatcccaggaaaagataaggaaagttagaactctaatttgatcatgtttaaattctgaatatgactgcaaaataactgaacaagatttaatctcttggaaatggctgtagtttcagcagctgaattactgaaggtcacatagctagacagtcctgtggccaggattctagtccaggcagtctgacttcacagtccattctctaaacctccacactgttttgtactgttctatactctactatctccatgtttcccacagccagatggaatagtggctcgagaccttaagttaaattacattcaagaaagataaagggtgattacaaaattcaccttttgactttccacattaatttcaagatgcatgtaaatttcagtaaaatgttttagactggaagaagttgaagatatattcacctctctccatctctactaccagtgcctaatctatgtcttacctagactgtgccctctaaactggggagattaggcttctctatgtacttaggagcaagaaaactaggaccaatggatggaagctttaaaaacagaattctgtatagaatcagagagagtttctcacagtctcagatatccagagataaaatgaatatccttggttggatccatgagccatatcccttgagatgctgtatcatggatgagacacctacaacaaagaagggaccttatgaagaagaattcgacagaagacatggctggatgattttagccttttacgtctcttccaattttgaaattctgccactttagaatggaggttgtgaaaaccaaattgccttgtgtttgcagagtgggaagtgagaaaataaaaacagtaggtataaagtactcttttagagatggctaccactgagggaagcagagttttattgtataacatggtgggactgagggaaaattttaacactgggaaaaattgagcagatttgtagatagaagaaggaagggaattagtttaaaaatgcaaaactaaaggttagagagggccctgttccagtatccactgttgtataatgtacttcctcaaaacttactggctttaaacaataatcactttgttatagcttaggattgtgttggtctggaattgaggcaatgctcagcaggatgattcttctgttccacatgtggatgacagaggtgactctgtggtctttggctgacattgtcttgtgcccttggtgggaatggctggaagtctgtgctcagctagaactgttgaccagagtgcctacatgtggcctccacagcctcttagggtactctgactttttttggcagcttgtagttcccagagcagtactccaggaggtgaattccaccagcctcttagggtagtctgactttttattggcagcttatagttcccagagcagtattccaggtgaaactaccaggcttcataagccctagcctcagaaggccagagcatcacttctgctgcttcttattggtcatcagtcaagtccctaaggccagctcagattcaagcataagaactagatgcacctctcagtggaaggagtagcaaagaatgtatagccatctttcatcacccatacagacaattgatagaacgaggtcctgaacaatgtgcggagtccaaattgagagcaaaggtagagtgattatctttagaatgggggagggacatgtccacctcagagataaggacaaagaaaaggagttccagaaggtggaaacagaaattttgagatgaagatgagggaaaggagaaggagtcatttctacagttaagtaatccaagcctatctagtagaagaggagtttcgcaaaataaaaattatgctacccaccatccatgtcttttacctcggggttgtttcctcattctgataattttgttgtcactgattttaccagacatgtcttccacagacttctgtctgaagacactgtctgcaagatttttggctgacttgttcaatgctctttgtgtaccaaacacatgtagcacaccaaactctggtgtagtccagggcagtggggcaggtaaattggcttccctggaaaatatgtccatctatgtgccttattcccagttcgtgcttttaagggatggagcacaccagccatgaactaaggctggagtagcaaaacatgaaatctgctttctacaaattatccagataatctcttccaatccccttctggaggaaaaacagagctgtatgagggtgacagtctggcaggtattcaaagctgcagtgaccatggcttggctcctgttgtatccacagagctgtttgattgggttaatttatacagtttttcctgtatgaatccttttgataagtatctttagaagcttctaattcattttaaaggaatgtttctctttggcttcatgtctcattcttttcacattatatattctggtgataaatgatggatccataaatacattacctttgctcagtcagtgttttctgttgttgatgtaaagtacacaaattggatttgtttcaggatagctgaatttggaatatgacattttgccaagtcagcatcacacttgcccatacaacacagatgtggattttgcagttgttttgtttttaaaattgtatatgtctgtggtgctattgattaatgtaatattgcattaatgtgctattacaacactctagggcattcatgaggtctttcagccagcagcaaagaattccccaaacaaaagcttttaataaaatacagattgcagggcaaagaaaagtatcaaccgtgagaatttatggatagcagaagtgcttgaggaatcaacttttgatggccttgccaatggaaataccgtgtaattgttatattatttcatttccctccaaatcattaaagatcatctatatatctattcatttgttgaatctgtgtttttaaatgaccaaggtattatgactgtgttgatccatgacttctctttttcttattaagtttccacttgctccagtgcttgtatagacacactgtcagatccaaaaggtcagcgaaggctgacacaaccacatgtgtgacatggcataaactgcagaaattaaaattgaatccgtcactgtccattgtaatagctggcaggcaactttccacaatgcagtgttgatgtaattctggcatggagtcattctggatctattttaagtaacaactacttttttccttctcaaggtagttcttaatctttaaccattacattttctctatcacaaaaatctggaataatatttttctaaatcaattaactgatgtaaaatttaagtgaataaaaatatcattggtataatatactcacctttgtaaatataggtgccactgccagcctgctaacagaaagacaaatccaactccactcattttcagatttcagaggttggtggtagtattttcaaatatccatttgataagagaagcagaggcagatctttgcttttttggcatatgtctaccatagccttacagtggatttaaagtacagaaagtaatagttcttttaaccctctacaacttgtgagatcagaaagaaagtaaaaagatacaaaaacaaaacaaaaaagcatagaggtctttaatttaaagaaagtttttctgtaaccaaattttatgagtcagcatttttatatcaataatttacggcaataattatgagatcattaagttcaagcatgcagaaacccatttcatggtctttggtaatagggctgatggaggccaacttaaatgagctaggccagtgattataataatatgccttcagaagtccaactagtgttgatgtttagagtggagataaaatagaaggcatttctcttatatttcagtgcctttagatctggacattttttaatgggccctgcaaagtaaatgccaattaagatgtcataagtaatataaattcaagagatattaaggtgctgtccctgtatctataagagtggtacatggagcatgttgaggaacaagtgaggggagttgtatcacaccctccagatatcttctttttgtgaatgcagttcttttcccctcctttgccccagttgcaatgacttaagacttagattccattccatgagtgtcttgctaaaaccaccagatagaataccttccatgtcccaactatacagtcctcttgtgtttttctggtgtttgtattcccatagttgcaaataaaaagtatatttttagttttagaattttcctttccattaaaaaaaaatccctgaagatttgtggcaccactgttatttctgttaatgtcattgcttccatagcagcaagctaagactttgtaagaaactgtgtttacagaaagcaattatctaagtgaacattatagctacatgcagcaaactttcaatttagatttcccgtaaccattacaatacacacacacacacacacacacacacccctactccttcccatttgtgtcataaatacagtgtcatcagctatatcctcatatccaggagcaaggtggaactagttctttgggcttccatagcagaatgaaaactcaggcaactcacattcttggtcatagaaggtgagttcttccctgatctcagaatccaaatggtagtagaatataaaatcaatgagtttgtgctggtccttagggtagatttcaggaaaaattagaaaggaaatgaagaaaataaattgttgggtttttttcacagtacattttgccaagcataaaacataacattgacagacataattcattttgcctaaaaggtttgttgccctcagaatttcagtcagtagagtcatgtctttaatttaggatatttcagagttgctttaccatcttctaggtgagagattttagtggccattctatgaagagatgaaaagagataaagggtaatttctaattggctgtaactcagtatgaaatgagaccagaatgccatctaaagcgtgctaaggaatgcactgtagaggcttttgcttcatgtgagtaagactggcctccttgaatgttccagtgtgccttggtgttactaattttctctgacaaaaatgaattctgaaatctttctgatgaacactgcccatgtcctattgcacgggtaaaaggtaaataggaaataaaattatctttctatagtattttcaagcaacactctttattaaataatctaacttagcaacttgtggccacagaactctgtagccattgggtagaagtacaagcaaaataagagccatgggccactttctcccttcctgctgagagcttacatttgcatggagaacacagccatgaattcagaataaaataaatacatacaaataaaagaaggaaagtgacacatatgcagccaactctgttatataatcaggggcaggaagggtcagtgatgctaggtcttgttagactgtcaaggctcaattcttatgagacattttaaggaatggaaggctgtaatttagtgaggaggaagaatagcatttgtcagatacatccagcaaaatagtggcatcataaaatcaagcaacgctgcagaaattaaaaattaaacttaccatattcatactgcataaaagcaaccccataaaactgtctaatctcacacttcatccatcaaaagcctttctaaaccattttagatattttccccccagctattctaaaattcactttccttatctggaaaatgatctcctaggatccttaaaaaaaatctccatttataattcaggaaaattgccacagccgacagaaatgaaggtggtggagtgctcagggaagctgcagagagaagcgattgctgagaggagatgaagaaagatcaccaccctgggtcctgcagtagccaaatggcagcatctagacatagaggacaagcaggagaaaggctgaggggttttgcctctggagcctgatgtattactagcagggacccctgagtgtctctctgcactgggaaaactgttagttaacctagaaggttggctgaagccacctcacccctgcagttcctgcaataaagaaaacacagcccttgctctgatcctttaacaagaagcaaatgtatatcgttgtgatccatttaccacgtactgaatttaccaaacatctattctatataggtattgaacaggatactaaaatcatggtcacccattatatcattgtggtaggcagactcatgtcccccaaaggagtcctaatccccggaacttgtgaatacgttatgttacatggcaaaggggaattaaggttgtagatgagatgcaaattgctaatgagctaactttaagataaggagattatcctggattatctcagggggcctattgtaatcacgagggtcctttaaatgtgtaaaagggaggcagaagagtcaatgtcagagtaatatgatgtaaaaaaaacttcactggccattgctggttctgaagatggaggagggggcaatgaaccaaggaatgtggacccactctagatctgggaagtgcaagaaaatggattctcccttagagcttccagaaggagcagagccctgacggctcccttgttttagcccagtgagacccatgtcagactcctgaccttggaattgtgagataataaatatgtattgttgtaggcccccaagttcatggtaattggtaatagcagccatagaaaactagtacaatcatactgttgatttcttttgtaagaatgtcagaaattgccttgttcattagcttgcttatttcttaccatctcccttcacactcaagaacgtctcttctaggagggcaaggccttccttgcctgtcgtgttcactgctgtatcccacaagccaggagcagagcgtcaaatacactagttgatacagtttggctgtgtccccacccaaatctcaccttgaattgtagttcccataatccccacgtgtcatgggagggacctggtgggaggtaatttaatcatgggggcagttaccctcatgctgttcttgtgatagtgagtgagttcttttgagatctgacgagtttataaggggcttttcccccttctgctcattcttctcctcctgccaccatgtgaagaaggacatgtttgcttccacttctgccatgattgtaagtttatttaggccaacccagccatgctgaattatgagtcaaacctttttcctttataagttacccagtcttgagtatgtctttattagcagcatgagaatggactaatacactggtcttagtaaatgcttcttgagtgtcaagtgaataattgtatacctaagggaatgaccagaaatcatgattctctccccagagcttccacaaggtagaaacataggaaatagcaaaggaaagatgaaaagtagcaagaggtcaggaacctgaaggagtagtagatgtacagaacacagtaaagtttcagaaaatttgaattagaaaacaaagtgtaaaccctctgtgtacttgaaagagccctgtgatgctgaagaaggtaacattgtagaaaggctgcttgtatacaggaaggagactagtggggtcaaccacagaatactcagttcctttcttaggtagacttactaaagtgccgtaaatcagtttttgtcaggagacaataaaaaatgaaattaacctagagaaaatacgtagagagaaaccaacatggcagagaaactgggtggaacatttattaagtcaaatcaatatggcaaaattgtgtcttctgctatgactttcaaggccttttgactaaaaatattaacatacagccttccacatagatcacaaagaagaaaagtcttaaattttttgaacaccaaaaaggtagaagccaatgtgttttatgaagttttttcctcctaattttttagggggcagacagatttttaaccctatctttgcttgcttttggatgcttccctcatcaacaaaatttagtaagcattttgcacatattaacttatttagttttatctgtgaggtaggcaccagatatccctctctatattgatggggaaactgagcctttgttaaagctaagtgacttacctaaggtgacagagtgagtgagtggtgaagtatggattgaaacccaggcagtttgactcaagagtttactctcttagctgctcttccaccaccagacactggtgggctctgagataaaccagaagcacaccagatccagtcgtttgctgtgggagatttatattctagtagaggaggcatataataaataagaattgcattgatgtgtattgcggctggtgctatgaaggagacatggaccacaggatcctgagagtgaattctagtgtgggctaacccatttgcaggaaccacagagccccaccacattgcaaatttcctagtttatactctgtaccaagagcaaatgaatatttaatgtgaaaatatcccataagtccttcatatgtgaacattaggttaagtggagattgatgagaaggagtctaaacaatttttaaaagttccaacaattggccaggtgtggtggctcatgcctgtaatcccagcactttgggaggctgagacggatggatcactcgaggtcaggagttcgagaccagtctggccaagatggtgaaatcctgtctctactaaaaatgcaaaaattagctggatgtggtggcacacgcttgtaagcccagttattcgggaggctgaggcaggggaattgcttgaacccaggatgtggaggttgcagtgcgctgagatcacaccactgcactcctgtgtgggcaacagagcgagaccctgtctcaaaaaaaaaaaaaaattccaacgtaagtttatttctaaatttttcctttcctgtggtatcctacttgttctgaatgtcctttgtgtaacccagggtttctcagcctcagcattattgactatttgggaccggataattcttgttgggtggggcctgggggctgttctgtgcattgtagaatgtttagcaacatccctggcctcttcttaccagtaacaacccctctttctacaatttgtgacaggcaaaaatgtctcaagacattgctgaatgtcccccagagagcaaaattgccctaggttgaaaaatgcttgcaacccaccaacaattcaaattccacctattcttgaagaccagttttaattgcctcatgcttcgagcccattcttctctccaccttctcaaaaacccacaactacactatatagacagtctttaaagctcagcagatagcattttctgaaatcagccaacccttctttaccccagcctccctgcaggatgggaaggagcacacaatgtgaggaaattaatcaggacttcaagctccctctgcatcacctgtggtagtacaagatttgtttggggttttctacctcactcttagaacagggtctaaggcaatgacttccagacacgttttaagcaagtgactgaccagaccatgaattcctgaataggaattcctgttggtgaaaatgtctcattaatttatagtagcacttcattcaggccttcaaactgaatcataaaatgaaaactcggtgcctcagggtgccacactcttcaggagagaggtaaaacgtatgagtgtagaagagcttcgagtgtgtgtgtctgtgggcagtgagtcccttgaatttggctcctattcagaccaaaacataggagccttttcctcctatcaagtagcagcatggtgggctgacaaacagaaagcagagtgaatttgaaaggcatatatgcccagcataacatctcgtcttctaagacagcaacataagatttctgattttaaaccaaggcagagttaatctgcaaagcctgtgcttattgtgagagatatgacagagggagaaaaaaatggaaccacaatgcagacatctctggatcaacttctgaaaaagcattgtgatcctcaatcttaacaaatatcaaaatggacccctaaatagccccttgaatactctgaagttgttcttagcgcttgtgttttctttttggcagtaaaattacagagaaagtggaaatcgttttaatgtgctaaggattttgatgcagtatcatttaaaatataattgtatgtgtttagttacattgttgcttcattttattaatctacaaataattattgttagctattaaatggcaatcactgtgccagatgctggatatataaagataaataaatatcctgttgctgacttcaaggatcttaccatcgttgaagtgagaaacaggcaaggaagctgacaatcatgaagcaggtttctaagtgctttgactgcacattggatagtataataaatgaggggcagcatctaactcaaacatgaaggttgggagaggagcacaagtgcacaagtgtctggaaagttctttctttttctttcttcttttttttttttttttttttttttttgagatggagtcttgctctgtcacccaggctggagtgcagtggcacaatctcagctcactgcaacctctgcctcctgggttcaagcgatcgtcctccctcagcctcccaagtagctgagattacaggcacccaccaccacgcctgactaatttttacatttttagtagagacagggtttcaccttgttgtccaggctggtcccaaactcctgacctcaggtgacccacctgcctcaggctcccaaagtgctgggattacaggggtgagccactatgcctggcctgggaagttctttctgagaagacaacaatctatgagaacaagttaaaaaattaaaatttattaaatatagttcacttgagactttaatatgtctattttgataattcttatggctctccatataaataatgcaagatggactataatcaaatagaaagctggaatgctagagaaacagatctttcatgagtttctgaataattgccacaacactgaacaaaagtataataaaacatatgcttgatttttcctattaagagactttgccaaagcctagtaaaatactcttgataacttgcctcataaagtaacagaagggaaatgcctccgtgttttcctacatttaatgccatcaagatatgttactgccaaaacatgcagatagtcctgcctggactgaatttagggtgaccagtcgagtctggaatgctcattgctctcaacgtgcagcagaaagagaactggacttgagatcagaaaaccttaatgcaagtcccactctgtcattcactcactgtgacattttacacaagtcatttaacctttctgaacctcagttacctcttctgtaagatggagcttcccaggatggctatgaggattaaatgaaatctaggttattattattaggcctctttgctaattagctgttgggtgagtggatcttcttgtgcaacaatacaaggtcatactttaacctaagcaccattgcagaatatgtgatggggtaaatagaggttttctcccttgtcttcctgccttcccatgccatccaaatcctcctcattgtggccagaatttgatccttatgaaacacagattagtcctatcacttctcagggaactcttcagtgcctactcatcactgtctggatgaaacccaacatcttggtgccatggtcccttctgttctgggtgtgatttttactcaccttcctccccctgcacacctatgcttcaccagcctctccatgcctgttctctccctttcccctccatgtcttggcacctgctgctccctcatattggaatagctgtgctcctgtttctccctacaaactcatcccaactggttcttcagcatgcacctcaaattgtaagcctttcctatgtgctttccatggtgtacaaatataccgtggtgtgggaaatttcccaccctcaatggccattgtccatttacttgtctttctccttcattgacctgggacttcttgggggcagagattgggttcattgcacttcatatccctttgcttcactctcagcctggaacattgtaggtgctccgtaggtcttgttgaattaatgaattgatcaatcactgactgattcataattggctaatatgcacaccaactgattaaacataagataaaataaatagtatttatgatgtcagaatgcaaattcttcattctttaaacatttccaccccaaaagtggaaaaaggtatggatgagctgtgaatcctgatactcatgaggtcactaaataatagtgttttttggcaaagactggtgctagcctaactcagcatccactttctcctttctccagaacaatagactcttatttttatctgggtatgtggccaccaacaataaaacacacaaacaaaaaacagtattttccagtgcaccttgcagatagatattgcaaaccactaagttctggcaaataaaatagaagtggaagtgttttgtggaactatcaagaggactgtttaacgagagctgactcatcaaggaggagccctccttcaccagtgtctactttttctctttcttcgggcctggatttgagatatttagatatggctgctgagtcccagcagcactttggaccatgagatgacctagaagatcctagcacccatgtgctaggatatcaaagcaaaaagatgcaatgggttggttctctgatggcactattaatcctgtagtcccagcctctagacttctttacataagagagtaatgaatgaacactctaaggcagtggttagtaaacctttttttgtaaaaggccagaaaataaacattttaggctttttagtccatacagtctcagacacaactcctcagctctgctgtcataattcaaaagcagccacagacaatacataaacgaatgagtgactatgttagaataaaattttaattacaaaaacaggtggctggctggatttgattcatagactgtagcctactgatccctgctctgaggcactgtgattttgagtccttgtgatatatatagctaaatctcaccctaatgaacacatcttattggtgagatgaaacttttgatttgaaggagagaaactgtcaagactcttgtttcattttaaaaagggtttccttcagtagaccctttctcccttaattgatccttattttattatacaaagttctgacatttctgtttccagactcttgattattaagaccggatgatcgagggcttttctaagtttctcagttccattatgttcagtttggaggattccagcagaatataaatgggacagtcatcaggtatatggacagggaggatggaggacaaaaggcaaggcctgtaggaactgaatgaagaacaccatgctgagaactcctaaaatgtgtttgaattatatgacaaaactttcaggctgcctggatgatagcttactgtactctgttaccagggagattgtacaagctgaattgatgtttagcagcaggacaagagctactcttggagattcttttcagcagagactttacttgttgctgctaggatgtcttggcttttctggtttaacttatcctgtgaatgcagaacaacatagtacagatcaggaatggcaaattgatttctccttccatgcaaactccaactgatggttagtacatagctggaactttgtattgagagagattatgtggctgcgtccaggttttaactgaagtggtctacgcttccctacagtgtcttccccagctgcgtgaggacagtgaggggagaggaggaatctcaaacaggttgcctctcttgatatagactcaagtgacaaggaagctattagggcaccatcatttaaataatctctaatctggttcttcattttacacatggctgtaatattaaggctgggaaatgtaaaataagtcacacagggttctatgactagttagcagcaaaaccactgttagaaagtcaacagtagtattcttcattacacaatacttgacatattcaattgagaagtttttatacttttcattaatttttcataatttatttctaacatagaatagaaccagcttgttggtgttccaacaaccaaacttctagagctcttgttgctggcattttaccagcctgatccttcagactccatttaattttgtgagccccagtcaccttccaatcactgtgtttttttgttgttgtgttaatgatgttcagggtcagtttctatagcctacaatcaaaaacttggattgatatgatggttgcataatattccaaagagtacagtcattaaattgtgattataaattattgagggatggaagtctgccttagtacaccccactcatggtaagatattcaattatcatttgttgaattgaattgaaatttctcacctattctaaatatgtattcttttaaacattatttaacaaacgtctttatggttatatctttccacatttttttttgagacagagtctcgctctgtcgcccaggctggagtggagtggtgtgatctctgctccctgcagcctccacctcccaggtccaatcaattctcttcccttagcctcccaggtagctgggattacaggcacctgccaccacacctggctaagttttgtatttttagtagagacagggtctcaccatgttggccaggctcatctggaacttctcatctcaagtgatctgcccaccttggcctcccaaagtgcggggattacaggcgtaagccaccacacccgaccactttccacatagttttgattacttaggataaattctcaagggtgggattactgatcacgtggtaggataatgtttatggctcaatatgtattaccaacctactttccagaagggctatattgatttacaatgccccatgccatgcttgagatcaccagtttccctataaccctgtcagcactcatgcaatagaaggaagtacaacagctcattgttattttagcgtgaatgttttctcatttgcgtgttgctaattgcatcgtctcatttgcgaattcacttacttgtcttttgcaacctaaatgaactccataaagaatgaagatattaacttatactgactgttaatattgtcctcacttggggtttgttcttttatttagttgtgggatatttggggaacatctttactctcgtttgaagagaatcctgtttaacttcttccaaaaccttgaactctgaaaatttccaacgttgtgaaaatgcttgggtcacctgccctagctgccagcattaattaaccaaaggaaggcatcttacccactactgtcagctaatctgggaaacactttagatacctttccctacatgccaggatcgctttccatggtcaaaaatagaataaaatatcatatgtttcccatcgttactgttcttttccaaataggaaattcgttgctatttaagccaaatctccagcccaacttgctgtccctgaagcaagggtttgacatatccctttacaaatctttagatttcttgcttccactaaaccagcttctaatggtttaaagtatccgggtggtatcctccaccacaaaaacttgagtgtagatagaacataaaccattcttatgatacaagatggcgattcttaaaaatgggcgtcacagcacaaaggaagcccttggcaaaaaggtaaaaatgaaggacgcttcattcattctcaacattttgaaaattgtgtcttttattatcttcctgaacctctgctactttctgacccctgattccatagttttctctttaaccaattttcagctttagttttccctcaggtaacgcagagcaattcaacatttttataatcctttcagaaattgttgctttaatcctcttctctcaaacctcactcctagaccctggctgaaacatcttttggttctgaggaaacctctgtgaactgaaaatatactgaaaactggtcctgtattcgttgttcaaaattaattaaatagaagagttactttccaaaatagcagaactcattagagcatcagaactcagatacacacttatatgaaagggaacacatactggttgacatagagctgaagagtagcaaatgccatatctgtaaagatcagaataagtgttctaatgtaataaagcagatgggaaacattaaatcagaagtcaagagatggaccctagccccaggttgctgctaattagctaatgaccttcaggctcagtttgaggctcaggttccttatctataaaactgcagtcaggccaggtgtggtggtgcatgcctgtggtcccagctacttgggaggctgaggtgggaggatcacttgagcctaagaggtcgaggctgccgtgatctatgattgtgccactgcactcttgcccgggtgacagattgagctcctatctctaaaaacaaaacaaaacaaaacaaaacaaaactggagtcaattggtgattttcaagccttggagttgtttttagcaacgcaactcagttttcaaatgaaaaatataacaaaagaacagatgcctgtagaactcctctgattggaataagggccagtggcctagaatcccaccctcttaactctctcttccactactcagggcttcaagaaagcctcagattattcattatcatgattgttgatacatgaacaggcccagtttttttcctgttctaaaattctctactctcccatggttaaaatatagattatgcttttagattgagtaggttagattagcagagtagcatggaaaacttgtccctgtgcccaggcctgggcattttggggtgtcaccagacagggaagccatgacctctgtctgccttcactacacaacggcattgctatgtcatggcgttttcagaatgtgaataatgacccaactgttctttttgccagatgcttcctttgtcctgtgaactgtgctgcagatcctcccaccttacctcgaattctcaccaccaacctcatcttgagctgctcatgccaacccacttgagacacaccaatctagcttagggggcagggggcagggggcaggtcacaggacctttgctgcttcctctgctggagcttgtcaaagctggccccttctcttatttcaggttccagcttgtatgtcaccttctgagagaagtcttctttgaccatcctaactaaagataccctggacgtcctgttttattgaattcataacatttattactatgtacatatgtatttagtcagtttgttatatttatgtttacttgaatccctctacacgcactgaaatgtgaacccatagagaagagagatcttatctgtcttgtccctcccccagcatccagaaaagtgcctggtccagagtagatgctttgtgagtaacttgtgaatgaaagaatgaacacgagacgttgatattataatctctatcatacagatgcagaaaccgagactcagagtggtttaattgccaactctgaagcttcatcacgggtaagcaactgattctagattcaaactcaagtttgacctaagagcaaatcttgactctgctatttggcctctctaagtggaaccattttcaactgtcatcaatgtttacatctacctgagaggatgctaataagataatgattacaatgacaatgaaaattgtgataccaataactgcttacacttcgagtgtttattgggcctctccttgatcacatgcagagcacacaccacctcagctggcagcacatttattactggttacctctaattttttaaaagttctttcttatcttgagctaaaatctaccactatgcatctttcacccactgatctcagtgtatccctctataacaaacacagtgaatctcttctagctgccaagtagagaaagtacgtggcctaagaatggacttggggtctggatatcactagtttttattgttgttgttgttgttgttgttgtttaaccgatttgcaaatacctagtaagtcaagcattcccaggtgggtaatttacaagacaatttacctgccacgggtgctttaatgagtattattattgtagtttcatcttaattaatagtgatattctttttcttagctagtagataagcacactcttattaaggaaattgggttgtcaccactggctttgagtaattcgttttgtctatgcaagctgtcttcatacgaaaaaggttttcatactatatccagtcccccctccaacttgaatgtgataaggattgatcaggaggaaccaggtaaaacctctgagctccttaaaaccaaggcccaatacaaacctgttcaattttgtggtctctggcttcaacttttggcttttgagagcattttagtccaaactacactgtggtctctgtggtctttgctggtggcaactggggatcttgtatggctcataacttttatctaggtccaaattttctgttctgttccacacaaagaaatagagaaaaatatgatacagcagctaatatttagtatgtactgtgagccaagaattgttctaaatcttttacttggattattgcatttaatagctatattatattctgggaaaatagcataggccctcttttcttgtaatacatttcatgcattttcttcatttcatccttaatttcaatttcctactttatgatattctatcttcctcagtgatatgactgattcaatgcaataattcatgtaacgtgcttacagcagtgcctcggagagacttaacactcaagaaatcctagctgttgtgattactgtatttctttcttgatgctgaacagatcagtatttttggatctagattcacagtggagcatgcagttttctggcttaaatcaacacactgtactacagtcgacaggatgataaggtagaaatagcaacatgctgcagggcaagagatctggggtcaggctttagctctgcactttaataggctgcgaacaccccagcagttcctcgactcctgagagctttgattcctcatttatacatgagatatatgaacctggtgatctctgagatcccttacctcatgtgaaccttccttgacagaatgtgaatttcaccataatgaggattatgtttctgtagtctcagctcacgtagtacgttaaagagaccccaaagcaccatagtggaagattcttcaggaaatgcttggttagtaaggaacatcaggaaaggaccctccaggactcccttctgtctgttcccccatagcactcactagtaggtgaagccatcagtaactaatggggttaggaattatcgggaacggcagtgtgaaatgcaccattggtagtatctggttttttttttgttgttgttgttgttttatgtcaattcgttctgattcttattgcaagggaagtagtgtggcgtgataagaaaagtgctggccccagagtccagagcctgtgaatttcatttcagctctgccactgtctggttttctagcaaatgacattgaccttccctgggccttagttttcgcagttgacaaactagaggattgctaaaaatttctggcagtttaaaaactctctgctaccaatttctttatagaaggacaatactcatatgaaatcctattgacagaaaagcattttgtctcccctttctctttttttttgccaagtgtaaagagagttggtgtggaaaaatatattctcctgtgaaaaggttcattcagccttttcttaatagatcaagtggttggtatttcggctggcttctgaaatacattacaaatcacaatctggaaaaagttccaaagcagctccaagccttcctgctgaatttggatacatctttaagtcttactctgcagctcatccttaacaactgacaaaatatttactttgctcagtacagaaaagggtaacattttccaaaatattaaactaggttggattcagaacacagacaatgaggcaaaaagctggacctctgttcgaagcagtatcattgaatcattttccagagtgccatgagaaacagccttggtggatgtttgtgctccacagtaattctgaaaaaggcagaagccagccagcctctgtctagcagacccactggtgtgctgagcagtgattctcaaagtgtagtccctgtgccagcagcatcagcatctactggcaactggttagagatgcagattctcacaatccatcccagacctacaaaatcagaacgttccaaaatgtggcctcccaatctgtgctgtaacgagtcctccaggtaaacaaggaaagtttgtttccttgtttcctggtactgaggaaagtttgcaaaccattggtttaggcctgtgaaggctacaggtgtttattaccttgcaattggaagtttgaaaaaaggacaagactagtaactcaagtttttgttaatgaattaattttttttcaaatgtaaataatttgaaatttggaggtgttgctttttgaaatgctgtcccctctaagtctttgtccctctcttcccatctccctccccagccccacttcatgcttacggcaacagggtctgaattatatttgtctgtttttaagacagtgaaaatgcactgcaatttggtttaatgtacttgaatgtagctagtaattttgataaaaatttaattgcatttttttaaacagactctcacttgaagttcctctatgatgaaaaggtggacaaaaattgaataactacaatttataatgttctgttctatcaatgagccttctttttaacagaataactattttttataaataaattgtgatttattttaaattaaattactggaaatcagtctagtcaccagctttaattaagaaatagactaccatcataagggctgtagtgttgattttaaaattgcaaataatttttaggggaaattatgatagccctcataagacctcctcctcctcccgaacgtctcctgcctgccctgcctcttctgtgttacgtgcctggccactgcaggaatctgagctgtgacctttgtcctgcagtctcgtgcttggtgatgtcatccggtcccagggtttcaactcctgcatctgttgatttggaaggcacacaaatctgtaactagagggtgatttcgctcctgagttgtagccaatgtcaccaactgcttcaatgtctttccagcgccttaagaccacacatccaaaccggaactcctcatcttttaccctccctttcctcttcccaacatccctatttcctttaatgggcatttcccacccatgacctgccattaagttgagggcaggaaaccaggaatagtaggaggttctggggtttggaactatgtgggtctggattcaaatccaggttggccacctcttggtcaagtgccattaggcaactcacttctcagatcttcagcttcttcatttgtaaacagagaattgtttggagaaataagagaagaaaagtatattaaaatttggttgtgtaatgtattatccaaaccagagcatattgacagtgaatgtggctattgttaataattattccatgaccctccaaaaaagacaaaatcttaagctgcaccaagcaaaacaggatgtgtgttcattctacgtgtttagtgctatgagtaatgtagtaggtcctcaataaatacatgttccctttcccttccttcctgttataacaatgtttgtcttcagtattttctgaatctgcctgtggtttccatccctcctacccctacagctgtcctcagtccctgacattaagaccattgtaatgttctcccaaccaggttccttgccttccatttttcccgtctaatagattccatgtacgtttgccagattaatcttctgaaaccacatctcttaaaccattctctgcctcaagaccccttaatgagtgcccattgcccgcttaataaagttaaaactctacagcatggtatttaaaagtcttcctgcttggagtccagtagctttcctccgacttaattccaagcactgtcctttgtctataccaggttcttggcaaactctaccatttcccaacagccttgccttccctgactgctggagtcttccctcctgtctctgcctgttcaaatccactgtcctttctgctgaagtgtggcctcttccagaaaggcttcccttgtctgcccagtgagaagctctcccccaccctaaattatcttaacaatgttttattcatatccctctcttttttatattgtagttgatcaggttcatgtcttagacatcccacaaggaaggggaatgggaggcagttcaagcctctttgcctcagataattcacacatgagaggaattcagaaaatgcttgttgaacaatgaataaatgactgactgaaagtcatttttgccttcaataattaaatactgccattgctttatctttaagtaagcaaaacttcgtaaaacataaggcaggtattcttatttattttgcttcgtttaagaactaggagattgaagtctttactattattgacagtaaagattctaaaactacaaatgactttttcctgcatcttcatgttgatgttattagctttatttgcctaaaagaggcagcttatttaataattagaaaaaaaaccctgtagctccaagaagcgaattttacatatcataaagtaaaagtcagaacctgcttacaactcaggtattggaaaacacagtttgtctcattgactgcctgtccccaaactccaaactgtatggggcaactttgtcttgcttttcccttgtttctgtttcaattttagaggcgaatttgtatatattttaatgtaagatggctctactctctcttttggcatatttgtttttataattgttttatagtcaataacacatatactttttttaaatagcacatctgtgactaagggaataggttttagcaaatttaaaaaacaaaaaaaattgctccagatctctttaagagaaagctgctcatttgcaaagagatcatttgtaattgccggtgaatcttgtgtaatgatgatagagaaaaccagtcatcattgttctctgacttctgtttcaacatttatccacttgtttgtcttacaaaagtgctcaggtataatgacaagagtcacatctgttcaggcttgccttaaaatggcagttacacattccattcttcttaactatatatatatatttttttttttttgagatggagtctcactctgtcaccaggctggagtgcagtgggatgatctcggctcactgcaacttctgcctccagggttcaagcaattgtcctgcgtcagcctccaagtagctgcgactacaggcgtgccccaccgtgcccagctaatttttgtatttttttttttagtagagatggggtttcaccgtgttggccaggatggtcttgatctcttgacctcgtgatccacccgccttggcctcccaaagtgctgggattacagacctgagccaccacacccgtcctcttcttaactttttaattcaagagatctttttctttgcattacataattccccaaataattctgttagctgctgcaaatatttttaccagactttcatctcagtgtgtgtttttggaagtgaaaatatagacagttaatttttattgaatttaaaataggtaggcctcagaattagcataattttgtgaaaattgtgtagaatctacttaggtggccattaaaaatgaatggagttagcaaggggtagctaattcccatcctctctcagggaactctgggatgtcaaggcaggccaccaaggatcttatttttatgaagaacctagtgccctaaagcaagcttgtccaacctgtggcccgcagccgacatgcagcccaggacagctttgaatgctacccaacacaaatttataaactttcttaaaacattgagtttttgtctttttttttttttttttttttagttcatcagctatcgttagtgtttagtatagtttatgtgtgacccaaggcaattcttcttcttccaatgtggcccagagaagccaaaagattggacacccatgtcctaaagaagataattcactgtctgaacttctatcatcaaattaagtctcttgaacaaaggtaaaagacttcttggaagtcagaaggttgtcccagaaagcaagaattttacctgtagccagtcagtcaccctgtcaacaaatgcttagttatgtcctgggccctggacaaagtgttgagaatgggattggaaacagcccagcagggtcctgtgtggagtatgctgtctggtggagaggagccattacagctgccccgtgcccctgccccgtgcccctccttcatccccatttggccctattggcatcagaggaagacttcggaaagcactaaggagagataatcttaaagtgtcctccagcctggggcctggaaaattctaaattcttggatctaagagattgtaaaattgaaaaaacaaaagcacaaaaacaggcttttagggcctaaaatattccaataaccttgcagagtcttatcctccaaatataggccaaaagagcttgatctctttggagtaattttttttttcaacatggaaagccctgactgatattttagggttctttcaacagggttcttttgatgcaaaaacgaagatttagtggccataggggttgggtcttggaggacctaggggtgggctggcagcatctactatcagggtgcacatgcacagggacccaggacaggccaggaggagctggggccatcgaaggaccgagctgcaggaagaatggaagagcatgggttgtcacctcatggtccttaatgtgactcagcaattcccccagagcttgctgcattcctctttatctgttaggtatctattatctacctcccttaacctcctctctttctattttatctttctctgtagtgagttcaaacactttaaagcctgaaactctttcttcaagtaacatcttatatttaaagctgataaaaactgaactgcaaagtggcagtaggctcagcccctcccactcggacctcccctcatccctgcaccagtccctgtgttacctccaaaagaaccccaaaagcagcttggaatatgctttgaaaaatctctgccctgccctcttagatttggttctctcatagtttactgttctccgtgacctacaatgaccactttaggcccccaaggggctgtattttgtttttttcgcatcaggcctctttacatacagactggactattcttgaatgaagcgcccacctctgaccagtcagttgtggccaaggcgaagatggagttaagttgtacaaaatgtggctaggtaaggctacctctacagcggggactgagaaagacggtggccctctgcaggactgtgtgtgggacaggcaccatgactgccatgtgtgggtggagcaagtgtcccaacaccaaaactaggagagtctacaggcaggcaacagcatcaaacagccacagacccacataagggagagaacagctgaggagcaggaaagaggatttgagtcgccattagagggtgggaccacatttacttggacaaacgagagggactcagagggcttcgactctgggactattgaaagctcaaaaccaaatgaagaaaagattgtcacaaaagtgatgaattggccccaagatgggtgtggtctggggaacagggaaaataaaagtaaccttcatctgctcctttgtgtaggtgtggagctcgcttttaaaaaatgtgttcttttcatttccaagatgtcaagtataaaacgccaactcactttaaatttaagagttcaattcttattctcttaaaaggcaaaggttgcttttgtggccacatgagacactgctttgaaggatgcctggctaagatctttttggcagtgccggatcatgccattgccatgatagaaacccagatttggggccagtaggaggaactgtgactctccaagccaaaggaggcagaatatggccctaagtgggccctgtgcttcagtaggggcaaggcctgactccaggagtacccttggacttggccttaaggcagtgtgaagacagcagctctgtttcttgcaatttgaacaaagcacatgaaacaatttgtacttactactcatatatgaagacttttgcctccaaaatggaattggtttggagacttaagttgtaattctggctttgacactaccttagtgtgtaattgtattccacttttttaaccttttagtttcttttttggtgaaagacatattcacttctaatatatcccaaattgggaatcccagcaaagcattcctacaacctgttgtccattcccttctagcctctctggagttctatcacaaacagataggtgcagcttgttgggaaaagtgtattattttatcatgtaatggacattttcacatttgcaatttaatgctttccaactcaccagaacatgtagaccatcattaatgctaccacaccctcatttaccaggagactgctatgatgtcattgcttgtgtctcaaatgagttaaaccaccatgacagtgacaactcatcattcttctttcagcagataataccatccccacagaccacactccacagaaaaagatgatcaaggcaatgccctttagttgtttttttcttaatccttttgtaataatttcatttttaatgcctctcgtttctggactctcagaacaaaaaaaaaaaaaaaaaaaaggatctttgaccagagtcaaggaggaaatctgtgggtttctgtggtactatttcatatgcaacctgtcccatttacaaggcttcatcattcagtgagagaaaatgacattacatcagattcgatgggacatttcatggtcttattgtcttattttaaaagtaattaaaaatgtgatcctgagctcatagaactttcctaacttataattgactagcgctaatatctcatcttctttccatttaccctcaaacgtggagattggcttctataagtctaaaatagcaacccgattaggtttaaaatctaattaaattctaacctgtgaaagtttaagatcctttaatggtttgctaatgtccctagcagtttcccaatggaaggtatgatattgctattgatacatgaaatgattttaggggcatagtggggaatgattttactacttatacaaacttatgcttattttactatgtgttagtaaaaatttaaatacatattaaagtaaaactataacatgtaagatagttaagttataacatactatcttatatgttatagtttatattatagcttacatattatcatattagtataatatattataatttaaaaatactgattacctgttaaatgataatatttagtgtttgttgaattaaataagatatactattaaagttaacttcacacttttcttttttacactcttttttcttttataataatcatattagtataatcatattacaactataatatgattaatattagtataatattaactgttataaattaagaatatcctatgcattaataagacaaatatatcattatatttttgcattttaataataatatatatgtatcaaaccatggatattattacttagatggtcagtaaaattagtgagtcaacctagaattcattttcaaaatactataatagcataagttgttcttagatataggaaagctcacgaagacagtaagagaataactaaaatttgagaactattaatcaacagaggaaagtctgactcctcaacttgtctccagttttacaccttgcccctctttatttcagcctttcagaaccatttgttgctccttaaatgtacaattaactttcacacctcccattcttgaattaaaatgttggcttaatcacatcacatgtggatgaccttgggaaagtcagttacactctttggctttagtttcctcatctaacaaataggcataaaaataaatgaaccgccacccagcaaaactttcttaaagttactggatatcatatagtattgtgtaaactgtagtaaattatacagatataagagattataatactttatcttaacatctctcacagtgcatagcaagtgttcattacataggtgttagagaataaatgaatgcataccactgatgttcaggtttgaaatggcatttatttcattaagcaagcattcacagaatggcagtacctaatgccgaaatagtggaggaaggattttttccttcaagatagtgaaggagactaacacctaaagaggtaattacaaataaggtattatgctaatttttaaaatagacataagatgaggcgcattgacttagctgggaaagcttcccagaagaggtgatactgaagctgcatcttacaagatggggaggaactatctcgtgaacagagtgaaaaagggctctcttggctgagggagcatgggcatagctatagaccagtaacgtccagcagaaatataatgcaagccacaaatgcaatgcaaaccagattaaacagaagttcaaagaaagtgtgaagttagctgtaatagtatatcttatttaattcaacaaatactaaatgttaccatctaacagatagccagtattttaaaattataaagatattttacatgctttattttgtgctcaaataaatcttcaaaatctggcatttacacttacagcacatgtcagtttaggctaatcatatttcaagggcttaatagctacatgcatgttgtagctactgtgtttgatagcatacgtatagatgatggaggaaaagcccagaatactaaataaaccatgagttctttgatatgcctctggcacagattctaggtggagactggtggaagatgaaagggaaatgtagtcagatatcagagcatgaaggcctcagataccaagtcaggggatctctccatttaatcataaaggcattgtggagcctttgccacctttgaaagattttatatagatcagatttgaggttttgaaagattcctctggcaaatgtgtgaaggatcaattgtgggggccacagtgcaaagaaagttggaggtatttctcaatctgttctgtttctctgtgtttaatggaattttcatataaaccccagcaattagtagacaggcagcccttctgaattagcagtgtttcctgagtttttaattctactccagaacttcatgagaattaagggtatggtggaagcagagctaagaatatcaggtgttaagacagaaagtctggcatgtggacaccctgaggctcaggcggagcagcccatgaagtgcggttcttagtcaaatagactctgtcctccaccaaaccatggtgcacaggcagtacaccatcaccaaatgcatgtgtgcaggccagctgtccctgattgtaaggtatacatcaaagggaactatccaccatcccccaaacaccttctttgccaagatgcttcttacccctaaactctagataataatccttcctttgaggtaaaaattgatttttctagcccatcttttctaaagaggcaaatgtcttgagtaggttacatgtttttatcaccataacctgctaataactgagttatttgcttccctttccctttatggcagaatacaagcttcccaaattcatttttctccccaaaattgcctacttcacagggtcctttcttcttccttttattttgcctttctgccaattttgctccatggcaccatattagctccattggcctataatccaaaattctgcctatcagtacatgtttatgtgtggaaggtggtgcaaatggacatagacacttaaagcgatgtcctttcagagtcacactggccatgcctcctgtttcttctgttctgggagctcccaggcctatgctagtccccctgagccaaataatgacaactggcatgtgcatgaagcagtcagcaagcttggaggccaccaccagagggaggtattgccctctctggtggagttgatatccatgagtctcacttctggacccctgggatctgcccccactccaggcaccacccaaccctcttgtcccggatgtccagaaaggggttgaagcatgaggggattcttatggccatcaccttgggggcacggaccatcagggtggctctgcctcgcactgcagacattttttaaatctgaaatttaaaacccaaattttttaatctaaaattttttacattttaaaaccaagtcctgagattatatgaccttgggtgattattttgctcaaattagaacccaggaaatttggaaatatttggtggtttgacgagataaagaagaagggggaaaatgaaccctgcttatgtattgttaaaaggcaaaccatagacaagttaaatttaacagactttgattgagtaaagaatgatttgttaaccagagagcccccaaaccagagtaggttcagagagactctggccctgccacgtggtcaaagaagatttatggaccaaaaaaaaaaaagaaaagaaaagaaaagaaaaagaaagctgatgtgtagaaaacagaagtgaggtatagaaatagccagattggttacactttagcattcatcttatttgaatgtggtttgaatagttggccacgtttgattggcctaaactcagtgattggtagaaaagtaggttacaatctgtttacacattcagataggttacagttcactatgtgcagaaaactctttaggctgaatttcaagtatgtaagcagtagctttaggctaaacttaatttaacagtatgaatggggaattgccttcactttgctgtgccacatgtaaataattgttatttttttctctagcatgcacatagtttgccaagttagtaaattattagaaagtcttttcttctttcttttaaaaaaagaacctgtactttgggtgagatgccgctgggaagccagctccgttgcctctctggcatctgtccatggtgcttgaacggcaggcaatgatactctgaaaactacaaagacccccctaaacacacctctgcccatctaggtcgggggttggtggtcggcggggggactatgttgctgtgaggagaggaagacttggactttgacagtttttcccactgttaagtaaaaccttaggcaattagccttttcaaaggtaaaagatttctttttataatctcttgttacacaaacacacacacacttataaaagaagaaaaagtaatgttgctcaggaaaattgcaacaatgagattgactcctgttgcttttgtcaattgccttctttcagaaatagattagagtgatgagtgagaatgccataaatatcctaagggagttccccaaagaaaagagaaaatccttcagagttcccccacctggttgggagcatcagatgtctttcaggagctttgcttcaaaagagaagaaaacattgattgagagctgactaggaattgtctttctttgggaaaaagaaatagttcagttattggagaaataagtaggaaggggaaaaaagtacccatccatccagtgttgtctcgctggggcttccctttttttaactgagattttcaagtgttctttctggaatcgggtgagtgaggattcctcacacagatgctgattaggatatttctgtcagaaaagaatggatcagaattagactcaggaacctaaaccaacaccattgataataagatggaacaaaaatgcttggacctttaatttagaaagtggcctttcatgactcatggtggatatcccatgatacataacatgagcaaacgctacttgggagatgaggatgaaatgaactccaatcagattgtcttggaatgtggcaaagggattattccctctgagttaaatgcacttcccttcctggggcgggggtggagaggcctaatcattactacatagccctgcatgcatgcatgtatttattcattcattcatctgtcattcattgaaggcccactgaaagttagatgatgtggtaggaggtagggatttaaagatgaacaacagatgacaagctgaaattctagtggcagagtggaaaatggtgacatacaacctaaggtggtaggctatgccccgggtgctgtggaaactcagaagacaggatttttcatcaaatgagatgctttgaggactttattccatgcaagttttttttttcctaaatagaatttagtatttcctttcatcattgctggtctctgtgaggacatacgtgtttctgtaacactggaagaaggaaaaacatctgaaatttgtatagataccttttcgctttgtggcatgtggtcatattttatagaataatggcagggaaggtatgtgggaaatgtacatatctacaggacttttctgacctgaagctaaacctgtgcatgagaaggggagtacatcaaagaagcttctggaatggaaaatggtggcctttttctgctaaatgcctccctggcatgccatgttcccaggctccccatctcactctcttctcccctgattcatttgtaggggaagaagaaaagtctaggttcctggctgaggcccctataacaaagataaataaacaacagaaaaggataccgttgtatttaggttttacgtgacatggatgccttcctaaggtaaaggaagacctgaagaaacagggaaaccatgtattttttatgctaggtttaacacagaagtggatagttatgaagtataattggactaaaaagtgtgatctactgataataaactggaggaaatcctgttttttccaattcttctcttcaaagataaagatgcttctttcctctggatctagggagggcacctctccaatgagggtctcccaagctttgcttcaaagaaggtagggcagggaagggaggagatgagaagaccttcctacttctgccattttcccaaattccttcagcttaaaatattttcgggtatatatactgaaccccatcacatttttattttcttgtatttaataagccccaaaaatgtgaggttttatttgaccaggatatctggtttctgtttcctttaatcctgggaagccttcttgggccttacgagttgtgccagttctcatgagttgagcgcatacggctggtgtccctcctggtgaccttcgcagccatctgggctggggcctgtgtctgtccggctcagcccagcggggcagggcctctgccgtgagtttgcagatgcctcattcggactccgagtctgtgactcacgccatctgttggtaatttgtcgttgttctggagtcaggagttttcaaaggattcagtctttggtgtcccttcacaggtgcactgcctgtgattttctgacaccctcttgccatccggcctatggccagagcccagcactgagtcaagctactgtggatataatgatgttgttctttgcactttagagagcttcacaccaagttcctgcccccttctgagcgagtcacactctttatgggacttgtttgaagtccagccaagctggcaaccgtggggttccacttttacaacctctagcaacagtaggctccagtcctttgtgtcaccgtgccatctgcttagcttttttcctcttcaaactgtaagcaaaatgagctacctaaaccaaaaaacgccaccccccaactaaaacacatttgcatcaagtcaacctaaatgacactgctttgtttgctctaaaccacatgtataaaagaatttccatacttccttaagaaatttttttcaccaaaaaaatagacaaccatagtagcaattatattttttctacacaccaggcactgtgctacatgttttatgttcatgattccattttattctcacagaaacccagtgaaggaggtattatcactatcttggtttttttgcatgtaaggaaattggggctcagacaagttaaataacttacaatgagtatgctaccggtaagcaaggcatctaaatctaaaccccactgcctggctctacagcacaagagtttaactgttttgtatactgcacccactccttgatattaataatctaatgcattgaagttcaatgcctttaattaatttttcagtccttaaacatagtgtcacacatccattagcaatccccatctatctatccaacagatatttttgagcatctactgtgtgccatgtaccatgctggacccttgtctcttgaagcttataatgtagttgaggctacaatttattctataatgtctcatgaagaagtcttgtctcatgaagcttataatgtagttgaggctacaatttattcatttaataaacctttataaggaacatacggtatgcaggcattatgctagggactggggctatgaagtcaagaaagataccatctctctcaactaatatatgataaactcacgattaaacttgaaatcagaaaagcaggatatttagtatgtattaccaatatttagtatgcatgtcctggccaaatcattgaacttctctctcccctagtttcttcacctattcagtagataacatgtaaggttaccaccaactttggaaaaacaatttctactctaaccgaacctagctttgaagtaacttttctattagaaatgtaggagaagagaaaagagctgagtctgggttcatgagagaagcaggaaaaagaaattatgaagtatatcagccaggaagcttttggctacaagtgagagaaaacatgaccaaaagcttgaaaacgtagaagtctgttttctcccataaaaagaagtcaaagggtaagtgtttctggtgttacttccattgctcaacagtgtcaccaaagacccattttatttatttatttattttttatttttttgagatggaatctcactctgtcacctaggctggagtgcagtggcacgatctcagctcactgcaacctttgcctcctggtttcaagccattctcctgcatcagcctcccgagtaactgggactacaggcgcctaccaccatgcctggctaatttttgtatttttagtagagacggggtttcaccatgttggccaggctggtctcgaactcctgacctcaggtggtctgcccacctcgggctcccaaagtcctgggattacaggcgtgagccaccgcacccggccccattttgttttcaggcttcctatcaccacccttagtgttggccttttgtgctcaaagttatggtctcctgtccacaaaatggctcctgttgtgcccagaattattttctcataacaacaacccaggcagaaaggaatccattatagagaaagactttcttcatactatggcatttgtttttgttttagttttcactctagaaagggagccctcccccagccaacttttccttttatctcattggctacaactgggtcatatgttgagcctaagccaatcataacttgtcctttgggtctgggggaggggttctgcattctctgaggtcatgggatctctaccagcttaaaaaaaaattatgtttcatttgaaaggaagaaagtgaatagacaattaacagtgtctgtcatagagttggttggaagcagacacgctagcaatggccatttggccctagaaaagctggaatgtttgaaggaactgtaatgagtgggaatgcctaacaagtaaatgctagaaaagatagatcctggagcaaaacctttattatctaaaaagattttgtccctaaaagggaaaagtaggggataagattgccactaagagactcctataaaatctgtatgactagcttgtatttgaaatggaagagaaccagttacaacttccctttcatcttgaatccagacactgtagacataattaccaggatagattgacactggggcagcctaaaagaacctcagtcatccaaaagtctttattgaactggccaccatgaaacaaagatgactaagacacagtccactcatggcagaatttttaggtattgatgaatttccagctgtaattgcagcataatacgtgctttgccaagggtgtgcacagagtacagttggagcactggggagagactggcaacactgcttggagtggggcaggtggtgatgaggggaggatgtatagcggaaatgacatttggtgtggcccctgaaggaataaaagaggcattcagaattgaaatgtaagaaaagggcaatcaagtccagtggaatctcgtaacagaagtgaaagtcctctgaatatttctgagcagatattaatgggaaaaccttcacgacccacagaacccatgctaacactgccactcagaaatcttgtgctcacttcctttgttgggtgagactgtggctgtggcttcagaacgaggagatggtggatgcttgtatctggctgcttgttgatgagctgaggcgccaccactggctggaacagcagcccctgaagaatgtaggaaggaccatgtgttctatctcccacctctttcaccacacgatcttgtttccctctcatcttcctgcttccacatccatgtttataagtctaccttactcagtaaacttctcccccttcacattaagacatgtgttattgcatcttggtctttcctgtgccgtatcacaagacctgacccatggcccgtgttcaaaatgtggattttggacaattggatgatcaaataaatgaagtgagaagttgggcagagggtggcctatgtgttggccacatggacaattagaactcatctcatattctcctggcttcattatattaaccgtatctggctcaggatgtttacctgactggaacttgtgaaatgtggcaacaggcagaaaagcagaggccaaatagctccctgtaattagatgtatttaacactagaggttccaggtagaatttcactattacctaaagcccatctaaaatggacaaagagaataaatgaaccaagagcaaacatttattgaaaccaattatgaaagagagtatgacataggcgatgaaggaacagactcttcagccagacctcctgggtttaaatctcagctgcattgcttcctggctgttttactttgggcaagtcacttaacccctctatgcctcagtttcctcatctacagaataggaatgaaaatagtgaatgcctctaaggattgttgtaagggtgaaatgagtataggtggtgtagtttcatattacaataggccctggcgaatacagaatactgtacaagtgctgactacttgagtttcagaacaaccctagaaattaagtataacttttatatgttacatatgatgaaagtttagcttggagaagttacatgtggcaagtctattgatcttaacatggcaagataatagctgggattttctataaggattttctcaatttctacataaaacatataaaccacagccaccctgttctgcctaggataatgaagttatgacatcatagaccgagcacatcatccaatctttgctccttccctctggaccaatggctagtggaattttcccaacaattaaagctatcactggtaagggagcatttgtttgggtttggggtttttgatttttaaaaaatttccaatctgtcatgaaccaaaatctgtaccaaatataataaaaaattactagaaaaataaattttttaaaaaaccagacaatattcagggccaacattttttattggattcaatgggaaagtggctttaaaaatccttcaagtgcttactctcaattcccgtacttatctttctgtgaatttataccaatggccggccaccagtctgcagaccatactctatgagtatctgacttaaaggacttccatgaagagttagttactcctcagatggaaatgatacacattcccgtttgctcttagcttgtggagaagttctcagatttctatagattttcctttacaaacattgacctgatgtttgtgaggctacctggagaatctctatccatcagcagagggtattagaaaagtggtctgaaaaaaaaaaatcaacaacaacaaataaaaccataaaacacagcctttacagttaatcctgtgctgggctcaaggtaaatgttagtcacttttaacaaaggctcaagacagccctggaagtccttgacaaggaaagaaacaagccctgggagtccttgagaaacgctgtttcagcgaacaactattccaaacccctatgtgaaaaccctgaccctggtgagcaagactgaaccattttagacttgcgtggagcccttttgccccttggcctgtatccctgactcaaaccagactttcctgacaacttttccctcaggtccaaactcagacttggctgtcatcatcttgccacttctgggatgaagcattaagagacagaaagaaagtagctagggaaagagttcatttccatgccgctctactgttaaacttcctatcaaaagcttcactttgtacttcattttatttaacaaatacttccactgtgctcactgtgtgtcaggcactgttctaaggaatttgcaaacatcaactcattataatactcaggaaaaccctgtgggtgggttctgtttttctccctattttataggtgagggaactgaagcacagagcatttaagcaatgcaagtcgagcatccctaatctgaaaacctaaaatctgaaatgctcgctcccaaacccaaaactttttgagaactgataagacaccccaagtggaaaacttcacatggagatacctaacacaaactttgttttatgcacaaaattgtttaaaatatcatgtaaagttaccttcaggctgtgtgtataaggcatatgtaaaaaataaatgaatttcatgtttagatttgggtcccatcgccaagatattaggtgtatgtaaatattccaaaattcaaactgcttatggtcccaagcattttggataagggatactcaacctgtgtatccctaagtcacacagctgtgttttgatctctgtcgacacgtctccccctccaggataaagaggaaaagcagtagggagaagggcttagaatgagcacgagcaatagcaatgtaaggagaagttatcctcaggccaggagaagcaagaacgcagccaaatttcagaaacaacaagggattctagtcactggcaagagaaaacaaactgaagactgagtggcagggttgctgtgtaatatgaggaaaatagaacccaagccactatatttcatgaccaagctcaaattagcggacgtgataacccttctataataacaaccataataataaaatagctatgctttttgaaactctactgtatggcagtttttatatgtaactttgtttaatccccacaactatatggggaagggggcattatccccatttttcagatgaaaaagttaatcaaagtacaaagaggtaaaatcacatgaccataatctcacagctagttattggcagagccagtatcgacatccatttctgtctaactctaaaccatgggttgttttgatgcagccacgttgttagagttagtgacccagtgccattataggggtgcttaggagaatcctaaatccatatgctgagtcaccacatgcccaagaagtctcagaaagatggcacctacagataaacctaaattagtttttttaagcttggaaaatccaagaaagataaacttagcacccattagcctgacacaaaacacttccattttttacaaatagtaatgtttcatgcatctctgcaggaagtgcatgcgacatcatggctgcggatatgcccccatggagagcccttgctggtcctggggtatttgtctctcttatcccaggttgcgtgtggttgtagaaggtgaagtgctgttactgagactagcgcctatctgatggcctatatgaatgacccactagagttattgggttctgccaacattatttccatcctagatctacaaaatgtttgtgggcagatagagctggttcctgagatcaggctagacggtgtttttcatactccacaaggcttatataaattcactatcttccttttagaaaaaaatccttggtccaacttcttttcagtacttgataaataatcagttgatgatgtgggaacatttgcagctgggtatgtaggtgctaaagccttattacatgcagagttggaattataataagacattcaccacttatctaaaacaattcaagaggacaataaaagataaataattctagaatgcatcatcaggagtgatattctttctatgccaaatgagattatgaaaataacactaatagaagtttcaaaaaaaggaagcctgtacattcttggaattagcaaggtgcttcccataattatacacttgcttggaaccctagccttttatttttttcattgaatagcctcccagttaaaaataacccaataaagtatcatagactacaaaatgcccggaatctttttaccaggtgacatctcatctttcaagatatctgatcttaagtcaccccaaattaacttgtacattttatttggcagtagacagtggtaacataggtattgttaaagtattgatataggacagtggaggaaggagactttcgatgaattgatcaagaagaaaaagaactctgtgttgccacctggttatggttcagaagtattgccctgaactgccatactaccactgagggtgaaataggaaaacatatcccaacattatcaagcacacacctctatgggaagactgcatatgtggcactcatacctcatctcccctcctgctgccaatacagacatagctaatccatcacaacactctttcctgccaggcctagatttgccatcaaaatccttctcacctcagtgcttcaggcaggtcctttcaagccatgacagctgggtcatgagttgaaacctgtttactttctatgatcagcactagtaacgcaaagatgagtacacatgacacctgccctcaaatagctggcagattattgagggaatcatacccagcagcagttataatattgtgagataaaatgatagaatgtatatgttaaatggtactggaagacagaaggaggaataactattcctgaaggaggtaaggagtgtttcccggaggaaatgaacacagacgagattggcaggatgtgggagttcccttatcaatcaaggtagacaaggggtggaggtaaatggcatggactttgcaggtgcttccccagcctaggggctgagtggaggaatagcaagaggttggggggcagcctcaggtcaagaccttgacctctttgattgctaggtaagatgttaagggtttttcttgcagaaaaaatcccagtctaaggtatgtaaaccccttgggggccatgagattattccaagggctgcatgaattcacagcacactgagtaggctctgataacgtactaaatggatcacatgggtatgggctttaataatgtcactgctgagaatgcactatatacttgtagcagatgatatagcaaagagaaggctttcaccttcaatggtttgctctgaagtttcataaacaaaacactgtgagcatcaaggtatagtctggagagctgatttaactgcaaagaggtgctgtctgtgcaggctctttagagaaatcttgggatctcagtgtcttatcaggtgttttgtgatatgttacaatatcaagttaattcctctttttttgaaaaatgtataaattcagcttggggttcacaagctccaagctatgttaccactaaagcctttctcacaacccaaagcacttgaacttaccttcactctctgagaggtcattatatttaaatagctactctaagaaggaaatatgctcagtccttcatttgaacaacagtttaaccttcaaagtagaaaaacaaaacaaatctgtaatatccctgtcactaaatcagcatcattaaggatcagcagccattgtctcttttagttggagaacggtgggtcacccatctcgaagcccagttaatgaacaagggtttattcagtaaaacattgaacattacccaagttaatattataataatctcttatattagtagagtatagttggcaaaacactttctctcacatacattatatcatttgatgcttacaataaccattcaaggtagatggaaggtattattcagtttatttcagtggaaagtcctaccactatccaaagtctgaatttcttttttaacaaatacagaagtatacaaaaagaaaaagcaacacagcttccagagaagattttgagtgtgtagagtttcatggtgatttgattttttcccctgaggctctgcactaaatttactgcttctttcattttattgataccataatggaatttgatacactctaattcagaaactgaaatgtttattcatttcatatgtcagtacaaaaatccaatcaagaataaatattgcccctcccaaagctacagtcatacagaatgataattgctttgaaaagaaataaacaagtttgggatgagggtgctgaagcagtcccaaaagtggggctcttcatccagctttttcctacagaatcatttcagtgtttctatcctgtaaggaaaaacactggaaacttgatgttttttgctctcatttattgaacactttccttgggagcctgcaaacatcatctgtaatccttacagcaacgcatagttggtgaattccttcagcagaggtattttatgaggcggtatagcttatcagctaaaagcagaggctttcaagacatatgggtgtgtgttcaggtcacaaagatcggggtttagggcacggttgtcccatcttttggcttccctgggccacattggaagaagaattgtcttgggccgcacataaaatacactaacactaacaatagctgttgagcttaaaaaaaagttgcaaaacaaatctcctcacgttttaagaaagtttagaaattcgctttgggtcacattcaaagccatcctgggctgcaggtgggacaagcttggtttagggcctcacttctgctcctaattgactcaacttaggtaaactaccgaagccctctaagtttcattcagtttcctcttacagttaattaggaattgtattcatttgttttcacactgctgataaagacatacctgagactgggcaatttacaaaaaaaaaaaagaggtttaatggacttacagttccacgtggctaggaaggcctcacaatcatcgtggaaggcaaggaggagcaagtcacatcttacatgggtggcagcaggcaaaaagagagcctgtgcagggaaactcccccttataaacccatcagatctcatgagacccattcactatcacaagaacagcacaggaaagacctgcccccatgattcaatcacctcccactgggtccctcccacaacacatggcaatttaagatgagatttaggtggagacacagccaaaccacatcaggaattaaatgagacaatctgcttgagccattcaccacagaaatttgcattgaatgataagtaaatgtttgtgtgtggagttcataaaataatagccaacatttactgagcacttacataccgtgtaatgttctgtgtgttttacatataaaaactcatgtaatcctcttgacagccagtgagagaatgcaaaaggtttagccaactatgaacaaaagaactaactgtgaaattagaaggaataatgtcctcatttcacaccaattgctagttcaggggttcccaaaacactctcggcttcaaaaatagaacagaaaaaaaggactcacagaacccactggaagctgttatattcatggctatggtttatgacaggaaaaggatacagaataatgtcagccaagggaagaggctcatacagcagagcctggaaggggctcagatgtgcttccagttgttctgtccccatggagttatagggcattaactcctctctgtgatgctgtgtgataatatggatgaaatattgtcaaccagggaagctcacctgggctttggtgtccaagattttttttttttagacagcatctcactctgtcgccaggctggagtgcaatggcacaatcttggctcaccacaacctccgcctcctgggttcaggcgattcccctgcttcagcctcccaagtaactgggactacaagtgcacgccaccatgcccagctaattttttgtattttagtagagacggggcttccccatgttagccaggatggtcttgatctcctaacctcataatccacccgcctcagcctcccaaagtgtatccaagatttttagggggacttgatcacatacttcccatattgctgacttttagtttccagttatttctggaggcagaactaatacctcttggtttaaagaccccgtcataaatcactgttagactgtctggtggctaaagccctaataaacaaagacacttctaccagccaggactttctaagggcctagtgggtaccttccagtagccaagggaaatggccagacatctctttgggtaagtttattcttcactgttaatattattcccatttgatagaggaagaaactgaagcacagaaaggttaagaaacttgcctaagaactccttgctggtacgtgagagagccaggattctaaaccaggcagccttcctctgggatctctaaacatttctccttgctgcctaaaaataggttcattgactctgctgaaatcagactgactgctggtaaatgttaggacctggtttgaatctgggtggatctgattcaggaggtcttcatctttccattttcctctggtttttccttacaaaaacatgagagcctcactgaacaccgtctaaaaggctcttgcgtctcatggatgaagtactaataacccatattgggttctgcctctggcaaactgagccatgctgagcatcagtatctatctcaaaagtacttgtttgtggtctcctgggagtgtcttatgactattgagagtcaatggagtttttatgagcctcgaaaataatattatccatggggctaataattctgcattatttctgcagggaaaaaaacagaaaactcctaccagtacataccaatatctgcaagtaaagttaaaaacaagggaggatattgatagtcatgtgccctaagtatggaaatagagctagggtttgccgctgtttgcatagagtacgtcacaatggaacacataagggccttccttcctcccatatttttgaaggcacagttttatgtttcaggaggctgtctccagtaccctcaaatatagggtgtaattagagacaccaagctatagcttgttgctttaaagactatgtctcagttgctcatcagggctcgctggttttgccagtagtgggaggagatcaacaccttcatcaccagcaccctcagagaacagcttttctgggtaaccactgcaaacagagagggatcactgatgaaacccaaaggggcgggcatctcccacccacagatcagctttgctgatgtaaaaggccagctcatcctgagccacgagtcaagctctatgagttccgttacctgaatacttgttgaatcaaggcaaaaaataggtgtgcttcatcctccacttcctatccaacctcatcagttaggtgaatttctccttcatcagaatctcagagtaaggcatgagcaaccatatttttaaaagtcccacaggagatcctgaagcacagcaaatgtcaagaatataatagatcagaaattatgccattttaaacatttttcaaaaaaattgaaacaaaacaaccctgtcacctaatactagttttcagcatcgtgggcaggttcattctttagagggaaatgaaatgaccaacccccacttatatttaattttggtttgtaagaggggctgtttgtgttaattaaaagtaaagtatataattatataggatgaatatgttaaaaattagggtaagtttaccacaaagtaatttgattgtcacttgtaaatacattgcagtttttacagtgttttcacctgagatgttaatgaccacagcagaagaaaatcctaaagctacatccaggtatagagttgtcctttgacttgtacaccttctgtggggacaaaaggttggtttgaagctctttcctcaatacactgtcagtaacatagtgacggaatgatcagttattaagtattcctcgacgacgacgatattggatatccaggctgggttttaagtcctttcatgttgtaggaaagaaacaagcttgggttactgaagttattatgaacctagtagggggatgcatggacataaaaccagccaggcacctcacagccaggcctcgtggaggggtgaacattgttcattgtcgcagccaggacaggacagtagctcctttcatctgacagtagttctggaaagccaataacaacttagatagcctcccaagttcaacacttagctctccaatctctgctcctttttcttccagaatggacttcctactgcactaccagtacatggtttctccactgttacagacgacccctctcctgatagtttgcgttactcagagcctctactgtcttctggcttctgcctacttccttcttgtgtcttttgcttcaaccccccctatgtttgctgatgccctatgtgtgtttcatatgtaaagcctctaaaagaaagaatgtgattggggtcaccagtcataattccgtattatgcacctccattgggcatgtagtgaatcaaggaggtcaccctaggggccactacctgcctgcagaaggctgtctttggatcaagccctggctccttgtccagctggctttgaccaggaaagtggaatactgagatgtacagccgtggcaagcaatgcacaagaaatctagaaaaaggaaactgcatgtgtggcaggcaccatggggcctctaagcatggtggcctgcccggagcaaggcagaccactttggcatccctgctggttgagcccaggcgtggtcccctgtcttggcctagcaggtgcatgggccctagggctcagtcactcttctccatgattgtgatcacttgtgtcttctttccttctcaaggctggccctggaataggaagcagctctttatgttattccacacctttcttctgtggaatctcctggaagaattacatgatttttacgttttaaatgttttcatgccacttactctgatctgagcatgggataactaaaatgccaatgggcaagttataaatttcaaagatttcctatgagtagtttatattgaaatctaaacatttttaataaaaaatatatccacatgtaaatctccagaacctatgaaaataacctattatggcaaaagagtgattattaacatatgtggcataaaggcacaattaagttcaggatcttgagaggagtttattctggattacctgggtgggccccaaatgccatcacaggtgtccttgtataagaaaggcagagagaagttagacacacattgagcaggggcagaggcaggatgaccacagagacagagattggagtgacgccgctacaagccaaggacttccagcagcctctagatcaagcttgtccaacccacagcccatgggccacttgcggcccaggacagctttgaatgcaccccaacacaaatttgtatgctttcttaaaatattatgacgggttgtttttttgcgatttattttttatcatcagcaatcattagtgtattttatgtgtggcctaagacaatcatttttccaatgtggcccaaggaagccaaaagattagacacctctgctctagatgctggaagaggcaatcaagaattctccccctggagacttcggagggactgcagccctgccaccaccttaatttcatgtttttatcttccagaactgtgacagaatacattgattgttgttgttgtttttgagatggagtcttgctctgtcacccaggctggagtgcagtggcgcaatctcggctcactgagacctgtgcctcctgggtgtaagcaattcttttgcctcagcctcctgagaagctgggattacaggcgtgcgccaccacgcccggctaattttgtatttttagtagagatggggtttctccatgttggccaggctggtctcgaactcccggcctcaggtggtccgcctgcctcagcctcccaaagtgctgggattacaggagtgagccaccgtgcccggccgattgttgttttaaatgacccaagctgtagttatctttagaacagccctaagaaatcaattcacatactttcttaactgacccatggaagtctccagagctcttatcttgaaaacaaacacacctgacactgtttgcaaactagattggactcttcaaattttggcctggggtagagggtaacaccttgaccaagccttctgaggtcactgggctgtaagctctgggagaacagcactgtgctgcctattatgggtgcataatacctatttgctgaatgaataaataaattcactggcctgctgtttttttcaggttctgtttacctagattcctctggccccagatggtactgcactttcaagctgcaacttttctggccattttggagtcccatcctggtccttggccttttaccattctttccactgttcttcctcccaccatctacatctacacgctggataagaaagacaatctgccctcccttttgtttgctttaaatgaagcaaactattgtttcccagataaattccattacatcttctctccattgatatgctccatttcttcatctccaaagcttaatcaaactccatcccccagatagtaagtcttcttttggaattttcatgccgctttgtccctttcgcgtatcacttatttgtctcttggaaagcagatatttatgtgagtaccatccattctgccagacttgagggtggtcttaccattgggtccatttttctcttgctttttcatcttgttttgttttgtttttattttgaggcagtgtttcactcttgttgcccaggctggagtgcaatggcacgatctcagctcactgcaacctccacctcccatgttcaagcgattctcccgcctcagtctcccgagtagctgggattacagatgtgtgccaccacacccagctaatttttttaatttttagtagatatggggtttcaccatgttggccaggctggtctcaaactcctgacctcaggtgatccacccaccttggcctcccaaagtgctgggattacagacgtgagggtccatatttctcttaacgcacagtacagaaacaggcagcagtataggaatccaaaatactgggtaattgaataaatggaaaatgaggatggggggaggccaagagtggggaaatttttcataaattccttaatatactatgaagttaagaaggtacataaaattcctctgaaacaacattaggggccctgttgaactggttgtgggctaacccgaacatgtatgagtaaggtcagaatggttagatgtctacgtttggttagatcgttttctgttttgccccataacaaatcaccacaaatttagcagcttaaaacaacgcacatttatcatttcacgatttctgtagatcaggatttcagacaggcctagctaggtcttctgttttagaggttctcaaagtacaatcaaaataccagccaggattggcatcttatctgagggattgaccggggaaagatctgcttccaagtgcacatggctgttggcaggtttcagctcttcaaaggctgttggattgagggcctcagtttctagctggcttttggccagaggatgccccttcagttcttgctatgtcggcctccccacatggctgtttgcttcatcaaagccaagggaggacactcgctagcaaaacagaagccacaatcatttctagcctaaatgtagaagcgacatcctatcactttcacaatgttctgtaggttagaagcaagtcactaggccagccgcactcgagggcatgaataccgagcacttggaatcattgaaaaacatcttacaatctggtctgtcacacctggtaacaaccataggcatttcctaagtattgaatgggtcatgttctaaaaatttcttgctcagttggaactaagaactcagtatgattttctttatacaaacaatgaagttaggtttctgaccttaccacctaaataagacccattttacctaaaatatatcaaatatcatgctaaccaaatccctctaaccaacatttatttattccattgttattctgtgaaaaatggtttccaaatttcaagttggagtcctggcacaaatgtttcagttaatttgtcttcagcatagccatgcagggaagttaggagctttatacctccgccatcagtaactcattaactgtttcccacagtgcatataaatagattattcctaaacaaaatatgtatcatgagctgatggtcaccaaggatgcatttactgtgtagttattctatgaagtcctcggtttttgcactgaaaatctaaatgtttaaacaaggagagtaaatcattttcagtttttcagaatgtgtaattcaaggaagcatttcaaaccgtcttcaaattcttaaaactaaacagaaacttccactccaacaacacttaatcccctatcacgaagttactggtcttggtttgtttacattgaatctcatgggttagtaaaaacgccacctcctttccctacagcacaatatgaaagaatctccctattaggctggcagtagaaattcttttgaatttttagattcatcaaagactgaccctttctctttttgaagtcttctctcgcttcctagctatcagggagtgctttgaactcagctcccacggaccgtttcctcttcaaaggcttgctcccttctgtgcagggagaaagcgccttttcaaagtggtgggttcctgccttttgtgggtctgttggagtacacagcaataaacaaaaataataataagcagcagtagcagttcttggtaattacagagagatctggggaaaatgtggaaagcaaagaaagccactttgcaacatgacttagaggaaagggtgttaaacatgcttgattctcagttgtactgaagctttctgtaacctgcaagaagcagggaggggcatctaaagtggtccctcctcaggtggacattttggcccaggtgggcatcctggaggcatcatgacaaatttaaaacaacttaagttatttaaatgagactcttccctggacacttgaacagttagatcccaccgcgaggcaaagtcctagacatcctgggggtgtctctgctttgttttatctgcaaacacaacccgaagcatgaacttctttttcttcttttccatcttttgttttgttttgtttttagatattgactcatggactattgagttgattctgttcccccctacccccgcaagtcactgacttagataatatacaattgtagctctaatgaagtgtttattattttgtttcctaaggaagatattactagagttgtgatgctttgtgaggcacttaaaaatagcctcttcttggccaggcacagtggttcacgcttgtattcctagcaagcgtggtggccaagacaggcagattgcttcagcccaggagtttgagaccagcctgggcaacatggcaaaaccccgtctctacaaataataatagtagtaataattagccaggcatggtggtgtgtggtagtgggactactacagctgtagtcccagctgtcgggaggctgaggtgggaggatcacctgagccccaggaggttaaggctgcagtgagcccatgatcattctgctgcactccagcctgagtgacagtgagaacctgtctcaaaagattctcctcattctagaagtttctgattctgtaatcttaggtaaactctcacataagaacatcatccagcatgactgcatagaagagccccttactttgcttcgtaatacacaacagttcaggtatggaacagcaggggcctgcagttagcaacaataattgagccaccctcttctctgtaactgaaaatggttctttcagttatgaggtatattgttctgctaaggctgccataacaaaagaccacagactaggtggcttaaacaacagaaatttgttttcccacgtatctggaggctggaagcccaagatcaaggtgttggcaggtttggtttctcctgaggcctcgattcttggctggcggatggtgttttctcctcctgtcctcatgtggcctcttctttgtgtaagcatgcccctggtgtctctgtcttgtcctataaagttaccagccctattgcattagggccccactcttatgaccttgcctaagcttaattgcttttttaaaggttctagctccaaatatagtcactgtgggggttaatgcttcaccatatgaattttggggaacacaattcagttcataatatggggtcacccacattatccatgggtggattggaggtcataaatattttctgaaaatgtgtatatgagagtatatgcctatatggatttttctggagagagggatcacactctatggaaatttgaggggattctaaaagataggaaatataaatttatattaacttaattatttttctaggtgtgatgttatatgctaatcctttcacaaagagtctgtcatcctataaccctgttgctcttttctctctcaattttgagatactctgttttgcagaatatctgttttacaaatcattaatctttcaaaagattaaggagtggttgaagaacatgttttcctatcctgagttgtctaaaattatgacatagttattttcattattgtacagttttggagtcttcctttacaaatggtggcttaggtgcttgagcaaatatataaaactttataaatcaaatttctgagctagataaacagaatccaaattcaaaagtaactgagataaattttagggcaaaaataaattagaataaacagaagtaaacttcccaacataggcagtgttgtttaagtctatgtaatgtgtagaggaaagcagtgaaaacaactggctgggaaatggacactatgattaaaatctaaggaaaattaggatttcttaagtggaaaaagaaaatcaatgatactttaaaagttcctccaacctcttgttttctctccttcccttctaagtctacagttttatttatgtcatatcataggctggtttctggggctacaacttttactgtacattatgctactgacttcttaaactcgaacgttggctgttcatttgccatcagtaaattttattttgtcaggtttagacatttttcttgcacagtgattttcaaatgtttctttagttattgaaccctaaatccaaacaaaatcttccatggacatcgagcagataaaaatggaaccgttacagctgaaatagggtgggaaaggatcttactgaaataaacatatactatcaatatggcatttgcctaatccagtgtatactttatatatatgattccccacttcattggcagtttgtagcaaattcttattttctttgtttggcactctctagattttgacacattagaagaaaaaataaagttatattattttaaaaacagtccaaattagctggaagatacttattttctctgactcttgtaaaaatgtcagtagggtaaaaatgtcaataggggatgcaaaaattaagacaacatacatgtccttttcttcattttatgacaatggtgaggaggaggctagaaatcttaaatgatataattggctttggaagcatttttaagctttagtctcatttgtccataaagcatgcagctagagtcacagaatctacacatttaagatatcttatggctttccagtgaatggctatttctgaaggaatcacgtcaaagctcccatgtcatttttgctgaagtcactgtgtcaattgcaaaggcagctggcgctcccactgcctccgtccatgcccgatggctttcatggagcactccaagatcctgtggtctcatccattcctggagtcaagaacacctgaatcactaaaataaaatgaggtttgaaatgtggtgtttactatttagagtgatcttaaatatttacaagtagcataactttgtaaaaaaaacaaaaacaaaacaaaaacaaaaaaaaattgttattcagggaccttctcgaacaaatgaggaaatctttaaaaatcaaattaaacttctgaaattagtacaaataaacgcttgtgaatctttaggattttcagtggaaatacacagtgaatttttgtatgtgtatatgtgtttgaacggttatagttaagcatttatatttttacagaaggctttatgcctgctttttttggtttcttgtttgtttggtttggttttggttctttgttttgttttattttagttctcacaacatttccaaccctaaatggctcagcaaataaagttgccgtgttttatgttatttgcctcaggtcatgcagaggtttttagccagggtgtttttaatctgctgttttaacctgtcagcgcatcattgttgggtcttgggtcatctgtgaagttctaggtgctgtgctaagggccttggagacagaaatataagtcatgagttctaattctcacttttttcaatactatatgtggaggatggagacagttctaaaagtatgcacttgagtgagaggctgagacccccctaaagtttgtcacttcctgccaccctcaggctcagcatatccctgcacagtggctagttctttttctaactgggatttcaaaagttaaagaggaggaagggaaaggaacagaaactaataactactgaatgcctgttataagccaacctgatgcccagagtcctccaattgaatccatggtatcaacagtatttgaatctaggtatccctactgacaaaggccggacatttctcactagaattaaccatttctataaaatgctaaagaagggcagtccccagtttcctcacctgtaaaatgaagacaaaagccttccaccctgtctcatctgtcactaaatgggagactattgattgtggctgaacaaattcaaatgagctcatgttcattcagcctcttcatgaattttgtgaacaatcaccagcatattataattcaaatcatcagtagaattgtttgtactgattcagcaatgctgattgtatgtgattccaatgcaaaaatttcttcttagccactgctaacactaaagagagcaatatcttccattcttacccatatccttttgcaaaactcacaaaatttttgtttaaagatttttcttcttgcaaatgcttctgactgcagcctctgccagctaatggaggtattttatgggctttattggcagagagagaatcaaggaggggcatgaagtagaatagagaaagaaaccaaggaaggaactagcacagttgaggcaaagagacattttgaagagtataaatgaaagcttaacttgaaaataatttgaggaacaattgtgaaaaaagtcttatattctagacccaccccctgtcaaaactgaggttgaaatttggtcccctctgtgttggtgttggaagatgtggtctaatgggaggtgtttgggttatggggatggaccctcatgaatagatggatgtcctcgtgcaggaatggattagttaccatgagagcagtcagactctttttaacaatctgctctcatgggaaccacatccaaaccatagcagaggtcaacagagaccttggcaaaaccatttccagcagatgatgggggcagaagacaaaagggcagtggatcctcttagcccatatatccaatctaaactcttgggtctagaatttgacttcctctctcttcatgtgatctctttgcacacatccacttccacttctgctttctgccatgagtgaaggcagcatgaggtccttatcagatgcagctacccaattttggactttccagccaccagaattgtgagccaaataaacctcttttctttataaaatactcagccttgggtattatgttatagcaacacaaaacagactaagacaacctgcatttgccagaacatcaatagacattttttagtcctaattttgccttttcagcagcattacatgccatagaccactctctccttttattttcttccccttgtcttccctgatactacactttctggttttcctttcatctctttggctactttctctactatgcattgcgggctcatctcttctgccatctagccattaaacatggagtccttcaaggttttttcttgggccctgttttggtcttaatatatatgtatgcctttcttttaaatgagcgtattcacaattatagctgcatttatcacctagctaagaattcttttacaagctccagactctcattaagttgaacatcaaaaagttttctcattccttgcgtgctcataaccaaaattgggaacgtacccccaaacttagttcactgctagtgttccctgttcagttttaccagccagaaacccaaagggaagtcaggaatgactctcaatgtttcatatgagcaattagttgggcagtggatagggagcactaggagagcagtagcggggcacaatagctgatcataaatttagttttggacttactgcatttgagttgcctaaaagttttagtatcataagatttgaatgtagtgacctggaagccaagggaaaaattctgtagcgtatgtggccaaagctgcattggagaagggagtaatgaagacagtgagggtcttgtgcttcttgtgcttcttttttttttttttttttttttttgagacggagtctcactctgtcacccaggctgaagtgcagtggtgcgatctcggctcactgcaagctccgcctcctggattcacagcattctcctccttcagcctcccaagtagctgggactacaggtgcccaccaccacgcctggttaattttttgtatttttagtagagatggagtttcaccatggtcttgatctcttgacctcgtgatccgcccgcgtcggcctcctgccgactgtaaagggctgggattacaggcatgagccaccgcatctggcgggtcttctgcttcttaaagacacctccccctatcccatccaacttcttcagttcagtatatattgttgtgtttggtgtttattaaataattggaatttgaatctattctctgctttcctttggaaaccagtaaattttattcattcagtttttcatttatccatgataatagattccctgttgggtccacttagttccaagataactcaaaaacctgtggggtgctgtggtcgcaagaaagaatcaggaaaagaccatagctcaagcaataaaatgataacacaaacattgactgagcacttaccttgtgccaggtactgtagtgactgttttacatacattgcctggtttacttcagcaccacaccattaggtatttattcctttttaagcccattttatagctgtgagaattgaggcttaaataagttaaatgtcttccccaaggtcacaaagctagtgagtgcaaagctagaattccaacccaggtgtaacttcagtaaccactgggcttcccatcccacaactgcaaaagcctgcaattcattgaacagtatattttgcttaaagaagccctaattccccttcacccccccgccatccctttgctcattaaaattaacaaacaaaaagaatgtctttctctttggtttcagctctttagctggtgggaagaggaggagaaattaaaagtaaggagactcccagagtttcaaacccacaagcaaacagcctggagatgacttgagtcatcttccacaaacatctgatgttgcagaggaatggggaaggaagaaggaaagcatgagtagctctttttttttctcttttgagacagagtctccctctgtcactcaggctggagtgcagcggcgcgatctcagctcactgcaatctccgcctcccgggttgaagcgattctcctgtctcagcctcccaactagctgggattccaggcacacaccaccatgcacgggttatttttctatttttaatagagacgaggtttctccatgttgaccaagctggtctcgaactcctgacctcaggtgatccacccgcctcggcctctcaaagtgctgggattacagatgtgagccaatgcgcctggccactggtagctgttaggtgttggcattttccagcccctgcaaggctgaatttgggggaggtgtgtgaatactggtggccttggcctaagcaggcaaaagcttcaccctgaaaagtagctttggttaaatgtcagaatttatgtggcaaaaaaatctattaaaaagcatatataaagtatagcccttacctttcctctatgcaattttttttaatgtttgagtctaaagcttttcaaacacacctggagaaactgaatcaacaccagcctatcctccaccaatgggttaagttcacaaagatggaaagttagaggaaacctcataaacttaaagagttaccattgcttcacaagataaaaagaactctagttaaagatactctaaacaaacaactctagctttgcagtgatttagggaacgtcttgatgtctttttcctcattgattttggtgcattaaatttaagttggctgataatccttgcactcttgaaaaagctaatggttagtttacagcaatttctcttaatgattatctttcagaaagcatttgagttatgagagagagtatctaacttatcctgctgttgataaatagaattggaagacatattcaaggtgctgctgcaaagacgctttcagcaattgctgcagctcagcccatggatgttcagtgaaataaataacagaaagcagtctaagaatttgcaagaggaagtgtttttatattgcttagcaaaatcatctctatattaaaaccacttgtaaatttaaactgtgccaggggagggaaggtaaatgggcttacataatccaagtagcataggaaatattaaatacttcatgttgttaaaacagggtgacatcatttccaaggtacttttttctccagaaaattgaaggctccatccgcaagtaagtagtaggaagaattatttgctgtgggagaaactctaacatacagctctgccttacactgattctgcagctggaaaacgagaactcccctgtattatttcattttttcaagctgcaaagcaaataggggaacagaggtaaagaaactaagaaaattctgagaagccatgctcttcaaatgatggaaggtgctgccaagaatcacattaacttactacttgataaatacaaatttaagaaatagggattcttacagattcctacaatgacgaaagggattttacgcaggatcagaaaaaggtagaaggaggcaatatgcatcaaaacagaactaaaaattgaagactcattagaaaaaaataaaggtttatagtctagcaagggaagatcttaaaaagacttatgttatctagtagagtttcccaaagggccaatccagggatagaaaatcattagggggaccacagatgaatcatgcattttacacttttctgccaaaatggtggtcagtttttcaaaagttctcaaatgcgttgttattgcaatgctttctaattttctcccctttacattcctcctcaaataaatctgcatagccatcctgaaatattattcataaaattaacaccacagatgagcagattgacagaagagagccacaagtagtatttgttagggcactgatgtcccagaggactgacttgaaagcttgaaatgactcttttggtcatgattatgtataaggaagatccgattagtacatcacctttactccccccagttgtctttggcctttccccagtattgcttatggtgaccaagcatttttaaatggttccctagcaaagcaaaagtcatcactattcagcaataccacttttatttgatagcttcccctctttgttttctatatcctagtcctttatttgtttttttttttctttctttcttataacttacttaagcttctacttccttctcactctcttatttctgatgtcaggaacatgccgatttgccctttctcctgctcatctgctcagcttattataagccctgccctggttcttcatatttctgtgttttcttggaaacactttattcaaatattttcctgtacatacaccacattttctttaatgtatgctttaaaaaaattttatgaatgtaactttaataacaaggtaatacccacaaattaaagaacattctaaaaaatataaaaatgtagaaacaagaaagatcactcatggttcttcagacaaaggaatcggtgttaacattatgatgtgctccttttagatttttccatgtaatatttatgaaactaaatatgataatataaatatgttttgatgttctttgatgtctaaatgtgatgtataagtattttagatgtttttaatggttgtataatattccaccgagtggatatatcttacttgaaaaaccattccccaatggtagattattaagattattttaaattattttgctactgtaagtagggctagggaaaatatatttgtttaccaagctgaaggagaatgtgttttatcttgtgtttatttcttttatttaggctggttattatttctttagcatagattcctaggaatcgaactatagtccttgttagtagggacagtttgcttccaaaacagtggttgagttgtattttctgtccagtattcatgagaggtgcttttcactttattcttgcaacatgacagattcttataagaaaagtttgctaatttaatatgtgtaaatggtttttaacttgattataactgtttattttattcgtatgagcgcgtatatgcttgggtatttattagcctttattcattaattttttcgcccctttcatctttcctttatcttgtgcccacactgcggatttccagtgcttatccttattcgctcctgctcacttttcctccctcaaagttatttttgcattttcttttgtctggtgtccagtaacttgtggggcagtgggaaccaaattgcattttaagatcttttttatgagatgttctcagcaggcatcttcaaggccccaaattctctttttgtcccccactgtgaaaaactgattggcatctggtgatgggcagggcacgggtgcctggcgcttgcaggaagccccacaggaggtgcacagagccatggtggatgaagtgtggccaagccagcacaaggtgggggaccagatgtcgcccgattatgttccattgaaatccaaacaaagccccagattcaggatcatttccttgagactccccagttggaaattggcactgagccagaatctcacaacagctggtctccccatgctaggatttatgtgccttaccaaaaactttacctgcgtgttattgattggtttctgtaaagcaatgaaacaatattttgaagacccaaagcatactgctctctgctgaaaataaaaagaccatatatcactgaacacaccagcaagtcttattataggcttgagaactctgagaaggatgcgttttcctttttatttatgccacccatgttaaccttgaggctgtgtactgacatttgcagcttcgcaatgacaacactccactcttgttaggagaccaagtccaccctttggaaataaattatattataaaataagctttcaagggataccagcagatgagaaatcatgcttatgtttctcatcatctagtttgtgttgagaaatcggagagtcttcccaaaatctcattacttgttatcatccaggtcatttgcatttatgtccttctcctttcctcctgcaaaggaagatgaactacaagcctggcagtttcattgttgtggataacgaggaggaaaaacctacaaacaaaagccactccattctgccccaccctcaaagatactgaagttggttgtgctgagccacaggggaagattgtaatttaaaaacaaaaactagcatttctttgttaaataatcgtcatgaaagcatttatattcatattatacttggctaaatatgtattcctgatgtgaatccaggaactctgttttatgcattgccttgatccctggctgctgctgctatctcagtcacctgataatgtctcagtctttctctcattctcttccctcttcccctctctctgcccctctagctgcctggcggtcctcaactcagattctcagacctcacagtgagattttggagctaacccactccattagaaacaaacaaaataaattgtttccattccccaaaggaatgtgctaaagcctttttcctctttaacatggatgcaatttaagtttggcaagagctgaacacaatatacctcactaggaggagaaagatttctgagaccctgatagaaagaactaaacaccccctcatccttcctgtgaacttaaagtgacaaaaagtaacctggtaatgccttcggtattcacagtgtttctgcaaaatcctcactcattccctcattccataaacatgcattaagcacctactaactgaaaacgctgtgtgcacattccttcccagctgttccttcaaggtgcatttcatttcctcaatctctagcccctaccatgccacaggcattcaaatgtcattcagtggcatttctcttcattactctgatttagaatcctgcttatctgtagtgtttcacaggcgatgatttgaagggcaataagaataatatggcccataagctgggcgccatggctcacgcctgtaatcccagcactgtgggaggccgaggcaggtggatcacgaggtcaggagttcaagaccagcctggccaacatggtgaaaccccatctctactaaaatacaaaaattagccgagcatggtggcgagcgcctgtaatcccagctactcgggaggctgaggtaagagaatcgcttgaacccaggaggcagaggttgcagtgagtcgagatcgtgccattgcactctggcctggacaatagagtaagagtccgtctcaaaaaaaaaaaaaaaaaaagaataataatatggcccattcattgcaggtgttaaatggaaatcgcctgagatcagctgtcaagaattaatcagggatacttactgtattatgtacttgaaactaagagggtagaccctaagtgttaacacacacacacacaactatgtggggtgttggatatattaattagcttgattgtggtaatcatttaacaatgtatccatatatcagaaccccaagttgtacactttaaatatatacaatttctgtttgtcaattataccccagtactgaaaaaaaaaatggtcaagaagggctgggcatggtggctaacacctacaatcccagtgctttgggaggccaaggcaagaggatcacttgagggcaggagtttgagatcagcttgggcaacatgatgagacctcatctctacaaaaaataaattagctgggcatggtggaacacacctgtagtttagccctacgcaggaggctgaagtggaaggattgcttgagaccaggatttcaaggctgctgtgaactatgatcacaccatggcactccagcctgggtaagaattcattaaggacaataatatgatctagaaccaatttaagcagagccaaaagaaggacctgacctcaaagaatatgcacatgaatcagaaaagcgacccagtccttgtcaacgtcctgcttctctctctttcttttccctttcctaatgctcatctctttgtaaaacatctcctcctcatggacttaaaagattcaaacatctttgttcaaattctggaagtcatggtgcttcccccagactgaggtgattgccactgaggatcagatcccaggtgagttgagggcagaggaaagggtcctctgaagccacgttggagaagggcttgttagacttccctttactacaagaacgcctgctattcttcatgcatcctagcttttcctagtcattctttattccttgatcatattcacccacttaccaaaacacttactggattgatttttacttttagtgtgttctactttcataatccataagctgcctatcctcgtatagcacagcacacagctatttttataatcctctactcatttgattcctagccccagtaatccaggaactggccattatatctagttcatgcaacccataaagttgcacattctgtaccttttgaatagtctttctctcatctttttccccttcatcctttctgattcttgaagctgaaaagattctcaaggctccaagttagccctgccctcatcttggttccttcttcagtggctaccagatatcatagacttatgactatcaaagcaagaggaatatggagtcagggagatacattggctggagcaaggggtgggcctgaagacaaaagttgatgagcagtttttgaaggtccagtctctgttcatgagggaggctcctggtgaagagatagaaatgccactcatcactgtgtacactggggacttttccgtttacctgagatagtcacagaatggagacctgcctcctaggggtcaaccaaagtaggtacgaggaaggatctgcagctggtttaagctttaaaaatgtgcctctacccaggattaggctgcagaggctgatgaaaatgtcaggtttctttgatttggctgaactctgtgagcacaatgttgtaatactgttgatctcatgctgatctgaagctggccaaaatatatatccatgatgaattataataaaaatagggaggattatgacttgatatataaagtttgggaaataaagccatttaaaatattggtctgtgggtgaaaatgacaaaacatagggccataaggaggaataaaaccaaaggttggttgtgtgatctacatgtggagctcagagcatgtttcttcctccagcccccttccccgttgctctgcctcatgagggaattagcacttggtattgtctgtacgactggcattgttccctgagcctcgagtctacggggaccacaactagatggtctaacgtgtgccttattcagctgaataaggtgttgaatagctacaaattgataacaagttttaaagagcatgaagtgccaactatgccctggctagtaagaaagccagttatatgtcaaggaggcttattagctgtgcatgaccatatataaaattacaggggctgactatagcaccaaaattaggtggtggtaaggaatttaatcatgtactgaccaatttcttgtttcataagaacactaagtccctgtaagtgccaatgtcagcagattcataaccctgcagcgcaattttggattgtcagaatctgttaactgtaggtatgccatctatggattttaaaatcagaggttcagactagctgtattacttggtgtagtgttaaccatgtttggtggatgccaggatgtgccacacaggtcccctttggggattggacttacttccccagcaggtgggagtgccgtcagtttcagccctctgctctaagccctctccagaactgcccttatgtgaagacagcagccttactaagttcagacccccttcctgtggcagccctcatcccataactggtccatgctggggtataaagacctgacccacttcctctattaggggcaactctgaagggcagggccttcacagctttgcagctcctagtagggtgggctcaggcccttgttcagactgcattgcaaggccataccttccttacctagatcacactttcttactttccctggacaggtgttggtcctagaacacttccctaataaacttctgcatgctgatttccatctcagaatctgccacacagggaacctgaccagcaacagtaggacaatctggatggcttgagtcagaaggtgataagttagaaataaagcactgaaatttaaagggcaagcatgagaatgactcaaatgaaaaagacagtatcaagtgctggcaaggattcagaataagtggaactctcatacactgctgacgggagggtctattggtacaatcatttggaaaactctttgactctgtctgttaaagttgaatatctgtgatcatgtcctatgagctagcagtttctctcctcagtatatatgcctaagaaaaatgcacgcatgcccaccaaaagaagaatacacacaaatgggcatagcagcactcttgccaaatgcaccaaactggagagaaccacagtgtcatcaataacagaatgaataaatacatcatattatagtcacacaatggagtactatgcagcaatgagaaggaaaactacagctccacaaggcaatacagatgaatatcacaaatataatattgaacaaaagcagccagacacaaaagaagacataacatatgattccatttatacaaatgtaaacatcggcaaaactgatgtatggtgtttgaagtcagagtggtggttgcctttatggagattcactgtgacaagaagaagtctgaaggggatattctggaaggctttcgaagctgtttttgatccaattgctggttactggagtgagttcactttaggaacatttgttgatttttctggacactcactatttgtgcacttttctgtgatatggtatagtatttaaactcagagtttatatagtgaaggaagaagaaggaagggcagatgtaaacactggatacaaaaaatgtgacatcacggatgtagacaaaaattcccaagattcaaacaggacccctactgtccagtactgcagactcctatagatgacaagtctgaggtccagaagggctccagttggctcaaagttacatagccagctaatggtgaaagacttcctggccccatcctttccccctcttcccacacttagcagagccaatgtggtcactagagtctccattcatctgagctcagcattgaccacagaatcatccaggcagcctaagcaagatatgcaatgtacagggaaataaaacatgagcaaagacctgaaaaaggcataggaatttgatgtaacagaaatgttatccatttcttagaggcctttctccacctattacctactgtcttcccacccacgcttctataactacccacaatgctttgtgttgaaagtgtgtcattttctttttgcaaagccaaagactacggagaaaaggttttgagctgtgagctaaattgcctttttctcccttggctttttcctataatctttgggagaactctagactatactgggctctaaaggccccttttgagagcattgccttatgtcatggaatcattgtgaaaaacagctaagttataactactttatatgtctttaaataagttagtatttctctaagagctttaatttcatttaataggtgatagagatgaccttgaagattaaagctgaaatattcttcattctttaagtatgttaatatgtgtgtgtgcacatttgtgtgtgtgcacatgggtatgtgtgcttgtgtgtgtgtgcatggatgagtgtgtgtgtttgcatgtgtgcaaatgcatgaatctgtactagtatataggcttgcatgtcgtgtgcttgcgtatgtttgcatgtgtgtgtgcatatgcacaggcacattctctgttaatataatgccatttgcagggtgcttgccagtctcttgagactcatggttctctgctttcgattacactcagactagtccaaaacccctctgaactaattctaatcaacttggaagccaccacactcaggcatgaggccgtcaaatgtgagtgtttgcagatgtcagtgcagagatggcagtaatccaggaggacagatcaaggcttagtcactgaaaaatacatgccagtgcatcccagctccagagcaccatctcagcccataagaaaaacatgtcatgacagtaaatcaataaccccttggagatgattcgtttctgaaatatccctgattaattatgccagtccatgcttggcaagagtactttgctccagcattaacctaatgctttttgcatgaagcaggattataacgggttctcataagtcaaatttgacattttaaatcaggctttaaaggtttgggttatagattttataatgtctccatgtcaaacataattgctcttattgctgctagtagacgtttgccaatcaatcaaaataacatttattttcatcataaacaagggtaaattaaaaccatttgaaatcattgtatttgaaaacttagtgaagaagcatctttagtaccattgaaatttgcttcctcactgtgatacatgggagcgtgatgaaattataaaagtcgatggaaatgtgttactattttcaccttgaaaaattaatgcttctacatattttgtgaatacgcggcttaaatttggtggcttattcccatatgattatgatttggggcaaaatagctccctttctttacataataggaaattatcatttttgtcccttaaagatgaatatatctttcagtttgcttataaattgcattcagaacttatttcttattcctcttaaattgcaagtgtttttttctctaagaaaagttaatggaaaaagaagatttgcttaaggggaagtcatactaataggttccttcaacaaaagcttagcatacaatggtcaactggtttgtacattctccctaaagtacttccaatgcatcagggtcaccttcccttacggtaattatagcattatgtggtatattactactctatttctatactgtatgtgtatactatttctatttgattatactgagatagatctcagtatagtcattgagtgccatcatgtaggtatgcagtgggaacacgaaaaagagggattaactccgcccgagacagagctgaccttatggaatagtgtattagtcagaataggctaacttacccgaagatagtaacttcattctgaattctctgtagattaaccccacaaagtttctcattcacacaaagtatgttgttatccagttgaccctccagagcagctttcttccaggtggtaatgcagggatccagaacccttccatctatgatcttaacatgtggctctcaggtcactatggtagagaagagagagagtgaacacacaccagcttttaaatgcactggcctaagagtgtccacatcgcttctgttaataataggcccattggccaggactagagcttactgtggccccgcctaactgaggaagcatagaaatgtgaggctgattctttgatgggaggaaaatgactctgcaatatgtatataccaaggataagatcccaaatattaagggattgcagtcagaaagaagatgaacaaagacgtgaaagtttgaggtcttttaatggaacaataacagttgccagtccagagtggtataagattaatctagaaaagtaggttgaatcacatagtaagggcctttgaaggcaatgccaagaaacttggacttcacctgaaaatagtgggaagattttggccaggcgcggtggctcatgcctgtgatcccagcactttgggaggccgaggtgggcgaatcacaaggtcaggagttcaagaccagcctggccaacatggtgaaaccccatttctactaaaaatacaaaaattagctgggcatcgtgatcggcacctgttatcccagctacttgggaggctgaggcaggagaattgcttgaacccgggaggcggaggttgaagtgagctgagatcatgccattgcactccagtctgggcgacagagtgagacttcgtctcaaaaaaaaatattgtgggaatattttaaagaagagaaccacatagtcagaattatgtttttaaagccatactctgacattgcaggatgctgatatctacgaataagtggattctactgagaaaatatctgaaaagcaggtgaataacattaaaatcctaggttattgtttttcaagcttccttttgttaaatttcagagtgctgtgaatgatgtttcatttttctatagttgctccccaaacttgtcacttttccgtgctctttaagaaaatacttcaatgctttaaattttactgagtgcaggaacacctacttgagtttcacttttcccttgccattcacctctgctgtgtcccccattgctctctcttcttgcattcttcacctcactccccagaatgtttctttattagtccattttcacgctgctgataaagacatacctgagactgggtaatttataaagaatgagaggtttaatggactcatagttccacgtgactgcggaggcctcacaatcatggtggaaggcgaaaggcatgtcttacatggtggcaggcaagagagcatgagagccaagcaaaaggggaaaccccttataaaaccatcagatcttgtgagacttattcactaccatgagaacagtatgggggaaactgcccccatgattcaattttctcccaccaggaccctcccaaacacatgggaattatgggagctacaatttaagatgagaattgggtgaggacacagccaaaccatatcagtttccaaaatactattaaggagagtgggccaccaaaaacacaagaaaggtagcacaaatctcagaaagagaatgcctctccatgacaacagcttggagttactctcccttcttcccctctacctccatgaggctcttgctacctgtgggatttaccctctgacatgggcataaagactgacctgttgtccctcagaccctggaatcttaagaagctgaatggtggggcgatgagagacgatttcaggttccttctcccaggcacagccatgacacagtcagctccccttccctcataggagatctacccctggccattcttttatccttcggttgtcctggtgctccataggcagcagagcactgggagtcaaactgcccaagtctgagcacaaactcaccaccttccagttggataaacttgtgcaactttcttaacttcttgtgcctcagtctctgtaaaatggaattgatgatgataataacatataccttgaggcattatcttgagaattaaatgagttttattccatgtaaagcgatcagtacagttcctggcatgcaataaatagatctcatagaataacttcaattatttgcatgtgttgtgtgagccacttctactccaagatcctatacatgcaaccccagtgaatgagatcttttccaaggtgagagactttaaatttttattcacctaattgagacatgtttcccagaacagcagtccgttggaggcaaggatgactggtgtatagtaggaatatagtatttattggatgaatgaatgaatgaatgaacaaacgagcatgggaagcagtgtgtgtcagtaaaagagcatgttttagagtcaggtagatctggaatcaaatgttggctacaccatttatgagttctacactacctttgacaagtgaacccctctgttccttcatttcgtcatgtataaaatgaagaagataactactacattaggattgctgtgagaattaaatatgataacagtgggaaatgtctagtataaactcagcatatattaggagctcagtaaatggtagctattattattgttattccatatttctgcacatccagttaatgatagaggaagcagcataaacacagagggatgaaataaatattttctttgtttacctgtcaaattgacatttacaaagttagactagctttctttttgttctttatcttatgttgttgtctgtattgtggagcttattaaagtaaaggagaaaaagaagagtagaaagggggaaattgtaggtgacaaggctgcagagaggtgaggaagaggtgtgaggctgaggaagtggcctagaagaaagtcatggaaagtcccttccttgaaaagccagcaggataggaaccaggcaggagaggggagcgacttgacagataaatctctcctctcttcactcccttctccactctttctccagcttaatctttctactattaatatccaaatttgtttctcctacttctctagatcttaaactccatggaagatgtctgaacctatagaggaacgtctgcttcctgcagggcagactccagctcaaagccctctagggtttggcagacacctccctcaccctcacccgtgcaaacccagctcttcatcctctttcatgtcttgcagtggtaacagtgcccttagtggactgtgctgtacctttactttttcttctccttggccatgtgaatgaatgctgtcctttacccttctacttatcaacccctagtcacatttaaaaacccagttctaatgtccaccatgatatgagatctttccttgacataaccaagcagagcaaatcactctggcctttgtgccattgttggtctgcaagtctgcatacagctcatcatagtatagtggtttgcctgtctgagggcattcattagaggtgctattctgtgagaactacacatactaattgggaaatcttcgtggaagaaagcaaacactaagtcacttaaaaatggatgttatattttatggtacaacatgggtcatctctagcatcccagtcacaaaaagaattccttaattggtggcccacaggctgctgagctgaaaaggaaagagaaaatacacaccgcactgcagcctcctggtaatgccatggccccttagcacctcctgggtgtcctcattaggattcagcaagagatagttactgcctcaagtcatatttaaaatctttaaatgcaaaagtaatagcccagtaaaacgtgtcactgtcctagtgtaatggttcctatgacatatagttgctcttaattgcaacgatatgcatgtcttaattaagtgtgcaacactattttatttggcgtaattattaaaaccatatcctaagagttgttggggctaatgttagaagtgagtaaattccaaatttagtccttagcctataaagagttttggaagtgcccagaacatactggcactcagtaagtattgttctgtctgaacctgagtttttcaccttgggtcactgtttctaacctcattttgaacatgaggttgttctggtgtaagagcatctcagcctggtttgacagccggcaggaacaggtatccaacatatgccaaaaaggcacagttaaaaaatgccctggcagtttctggagagagattctatgccatgctgataggtagcaccaaactaaagccagcactgggcgctggggagagggagacccatgacaagaggaagttctgtttgacttctggagaaacagaaactatagtggctgagactggcagttcctcatcattcaaaacactacaatgtctctactaggaagggagggagggagggtagcagattttgagctgaccaattagcgaaattaataatgatagtttcaagataaaacattttgtcagatttcccgaggtaaaaattcaggggatttttttggagcctgcatcagttttctttccaagctacttcggatgtcatttctatctcccttgaagaggagaaacatctcatccagctaacactgttcagtggccccaagggcagatccacgttgattctcttcatgccctcactaatgctgcgttttcctgtattcttcgaacatttgacttatttgggaagcctagaagctttgccaaagattaggatcagccagagattggtgatttttctcagtttttctcatgtcccctttctattgttttagatcatgttttgctaatgcaatgggctttatttccaaacctggaaatttcttcttgctttatttcaagataaaaatgttctcatttttaatacccttttgttctatgggggggtgagaggaaacaggaaaaagtaaacaaaatattcgagttacaatctagagtgcacaatttttgtatcttaggatagcttttcatactattcttatttacaatatagctataaacttattggacctcctaggaacccttccgtatcccatcttcgtaggcaagtccagtcacatcgctggccctgcctgcagtccaggtgcttataagaatacaggtgcacagtaacacaaagatatgcacgttgcaaagatatgcatgtctttattaagtgtgcaacacacacgcacatgcacactgccatctttttatttatgatccaaagttgtcattgggttattagaaaacatgaaggcaagaacaagctcctctagtgatttgatgcacacataactgtgcaaacacttccagaggcctgcctgtatcctacaggtgccagtagcggacaggggattgccaggtctcttatgacccaatgaggttggccacacctcacatacaaaagctggttttacttctgaggaaaaaacgattcttgcctggtgttcatatgatatgggagtagtaccctcctattaaaaaatattttggagagaaggagaaagaccagagaaatagcagttgaacatagtcttcaaatattgcctattaatttttgtgttgtacactctgattataactctcaattctagagatctaaaatagtcttgagagctcccctaattcatccgtctgacttgcctggatttataccatcatgcagcataatttttgtccttctattaatccacagcgaagattattccaaaacttctctgtagtttataggtcattcattgccatcacaaatagtccaaaattttccccaggagccagtccagacccttcttgtgtagtgtgaacatttttcctttaataccattacattcgtctgtcagaatctaaacctccaactcatccatctttccagtttcctggtgaaagaacatccattcataaatcaaataatctagtagttagaaggtacaactacaacttatgaataatctattccagtataccccagtatgtaggctgtatagctcttgtgttttgcaagataatttatgtagcacggggacgtgacattaaataatattaaattgcatagtgaaaagtttattccctctgaattatctttcagtccttctcattctgtttaggagagtctctctttcatgccagtatatcttttttcttttcttttttttttttttttctttttgagactgagtctcgctctgtcacccaggctgcagtgcggtggcgtgatctcggctcactgcaacctctgcctcccaggttcaagtgattctcctgcctcagcctcccaactagctaggattacaggcgcctgccaccaagcctggctaatttttgttttttcagtagagacggggtttcgccaagttgaccaggctggtctcgaactcctgacctcaggtgatccgcccgcctcagcctcccaaagtgctgggattacaggcatgagccattgtgtccagcttcatgccagtatatctttagtgcccctctatacttactaatgtccttatttaacacagataggggaggcctcaaaataatctaataagattaattcatttttattgtattttgtttttgtgattatcttctatttatgacaaatgatattccatttatgagagtttacatacagttttcctttaagtacatttatttaagaaaaatgtgagtgaattgggtgagaactttaaaaaaaaaatcaagtagcatgaacggggccacagtatggcttttgtagattttaagcactttgtgttagtgagtcccttcttacattagtgtgtacgtgtgtatacgtatatgatgttttatgacagcattggtatacagatgaatataatcttcaactctgaaagttcatttttttcttctgattctaaaagaaactaagacattttcatgggccctggcactgtggctactgtccctaaagcataggtgggtcagccctggcatgtgttatagcaaaactcattagctcttcaggagaagcactaatttaatccaactgcctcattttacaaagaataatactaagcttcacacatgtgtgagaacctgcgggtctgagagtgaggaaggacaaaatcagaactagatctcagatgccagcctcctaatctttccacttcattacactgctgtcttcctttgagcctcttctgcaaaagccctttttcttgtcccatctgcttccgagtcttcacatcagaattaatcatgggtccttccgtgaatccagccccacctcaggtgtgaggactgctctgtgtggaggtgacacccccttgtggatctcttctgcaaatagacctttgtcacgggaggctggtcagttcacagcctccatggcagtggagtcagttcactccgctccatcacgggggacccaccaagaccccattaagaaaagcacaaatgatgcaataaatcaggatagatttaggcttcgttttttggacacaatcttccaaatgatagctcctcattaaaactagctaaaatggatgatagagcttgggataggttcaccacttatatcctagaccagtactttctaggatggactttatatggaagaccaaaggtttactccttgggctgtcaaccttcattttacttagctcttcaaacaagtcaagccttgtttttagctcagctcctggggaattgttctgttgacaatgtactgcagaaaacagtccaaacaattcttaagagctaagagccacctttggtgactagactttgtaaccatctcatttatccaaggtggatctacatctacctgaaaatactgtaagttgtaaatggtatttgtgtttggggaaacagcaacagatcattcttcagctcgcttccagccatctgtaactgtcatcataccactagaaagctctgactttcaaaaagtaacagatgctggtgaggttgcgaagaaaagggaacacttatacactgttggtgggagtgtaattcaacccattgttgaaggcaatatgacgattcctcaaagagctaaaagtagaactaccattagacccagcaatcccatcactgggtacgtgcccagaagaatagaaatcattctaccataaagatatatgtgcacaaatgttcattgcagcaccactcacaatagcgaaaacatggaatcaacctaaatgcctatcagtgacagattggataaggaaaatgtggtacctgtacaccacagaatactatgcagccgtaaaaaagagtgagatcacgtcttttgcaggagcatggatggagatggaggctgtaatccttagcaaactaatgcaggaacagaaaaccaaacaccgcatgttctcacttataagtgggagctaaatgataagaacttatgaacacaaagaaggaaataacagacactggggtctacttgagggggaggttgggaggagggagagtagcagaaaagataactattgggtactgggcttaatacctgggtgatgagataatacgtacaatgaaaccccatgacgtgtgtttacctatgtaacaaaccttcacgtgtatccccaaatctaaaataaaagttaaaaaaaagttctgactttatgctagctaatgttattgtttattattattgattggataatatatcacaggaaagacatatttagcaaaaatcattttttacagtgaagacctttttatttgttttgaggcccaaccaaaaaataattccaatctgttgggagataatgtaagtgatctgcaattatgcacttctacaggtttattgattcaaacattattcaactgtgatatcttttaaaaatataatactaatgcagaaaaaagagcatgagatttggaggcatacagaactagttttgtatcctacctccagacctactagctctgtgatcttaggcaagataattaacctttctgagccttttttgccccatctgcagaatggagttaataatatccatataagatgttgttttgaagattaaattatctggaaaaatattgactgagtacctctcttgtgccaggttcttttctaagtgctgcagataccacagtgagcaaaacactaagagtgctgttcttatgcagtgatgattttaactggagttaaatatttccctcctggttcttaagtcattgaagcagagtattgcctgagaatgggttggaactggatttcatgtagctgtagttctaaaataattatctctcttgctgctatagattttaagttataactcaactgctaaaggttacttattcatcaggaccattcatagttttttaccattcttttagttcacaaaactttagttatctgtaaggcaacatttatatttgcagtaggtattttctgctaatttatgtttgttaatacgtactatgtataaataaacataatttgcattataaatttctagagagggagatacacagtctttagtgcatgaaaattccaaatgataagctgttatgacatagaaaaaccttctactaagatttgccactggacaaacctgcacatgcacagctagccacaaaaagatcttttgtctgtggttatgtcactgatgggacaagttgctcctgtttagtggtgatgacaccaatgatgaagtgatctagaaagatattcctttttcaaattgattttcttcctggaatggtttaaagtacatcctgattctcccagatacatctgatcatcagcaagtatcagatgtcctatctggaagatatgcatacattttatcactttccttgataaaataatgacaactgaataagcatattctgattggttatttatacaaccaatatatatttatttaaaaatggaggattttctacttcatttggagcaatgaatgaagggtagaacttaagaaatttattaatatcagtgatccaaaagtaatgtcattgtcatttatgatccacacaggccctcagggtcagcattatcatcagtgtaaaggtttgatctgcaggtatttttcttttatgtaagatttgataagacatagccttattgctagctgtatatttgaattttgcgtgaatgcaccattgtaaaactattgttgccatctcaaactgttggcgacattccaggccgatgtcatctgaggtaactagattataatgaaaaaccaatagatctttaaaatgcatactgtctctgtactagcacacatgtacattggcttgcatgactttcttcagagctaattatactgttttaaaaaaatagtaataaagaagataaaagataaagaaatataaagctacccaactgtggaatcactcacctgattttctcagaatgccacactctaattactaatgtattggcagtcagcacagttatctagaggagaatgtttaaggcaaagatcatccactgtcttaatatttcttacaaaatcatgtctttctatttttttctaggaatataaacaataggttgctcctaagatgttcatttagatatccccaacatgccttttgcctgccaaggcctacttgccacctggttctattttgctagaatgcttattagactttgaaaatcataatattcaatttcctgccttttccttgaatacacaaataatacaggaagagcaaggcaacgattctttcacggctgtttaggaagtactaaatagaatttaaacctgctgatgggtcagttttcagttctgccatctttatactcttgagaaagtctccagtattggaaggtaaatatatatcctggcccagttttatcttagaaactctttgttccttttatctgtccactaaatttcaaaaccaagggcatttgaatatctgaaaggtttaagaattttagtttcctttcttcttacctatagatgggataaatttcatctccatcctgttccaataaacttagtgtctagagtaatcactgaatcagaaaaacaaaaagatgttctactcagcttcttgggattctgccttcagacatcatgtctaaattcatgcactactggtccaaactggcacaccatttctggaagctgatttggcgttgtttgctaacctgctgctcgtgcacacataatttggcattatttatcaacagccttaaaatcatatagcctttgacaataaaaacataatttaacatttggacaaagagttctacgaaagatgttcatcatgatgtttttaataaatgaaaggttgaaaatcttttgcatcttgatatccaagaacaagaattggttaaataaatcttagtatatccatataatggagttctccaaagctatggtcaagaccgatgttctggaagaatttctaaactaccatatcaaaaattctcatgctgcaatattatgataaaaatccaaaacagaattgcacacacagtatgatattaactgtgtttaagtaatatgaacagggagggaaaaaatgggacgtacaccaaaatgttaacagtggtgattgttattcctctctttggttccagttttttcttagacatttttctaggttatcaaaattctctgtaatgggcataaaatacaataaaatttcaaaaattaagatacagaagaaaaatattaatggagcaatcaacgcactatgtggttttacgtccattctacttctttggcgagccatagacttctttctgcctgacactttcctaggaatttatagtgtgcattctcctactggtgaaaaaacaactatagagagacaatgatagcaatctgtgtcacctagtctctgttattttccagcacacgacggttctgccctttatattaatcgagatgaggacatcgcaccatcagtatcccagcaggagcagcggacttaccgccatatgtaccttctctgttggctatatattatggtaaggaccatgcctgctgggctttcttattgtattagattttgcactgctaaatttgggcacatatttcattatggatataatcactaacagattcacgctgtgtgccgcatttggtccaagacctgggctttgtctcgtttccccagatgcttatatttttagaaagtatatgccaaacctcacacaacaggaatttgttgaacaatcccatgtaagcagtggttcttccaaggctacatttttcaactctttttcaaactaaatgtttttgttggacaccggttttattgcttaagggcttttttgcttgggattttgttgttgttgcttttgttggggggcaggggagttgcagcaaacacaaatgagaacagaagtgacctcttagagcaatgacttaaaacttactaggaaacaagtgaaaatgtatgttttccctggtccatttaaaacctactccagaattaactgttacatggagaatgcattaaactgttctgtttttaaatattgggataaataaaccacaagaaatcttcatttgatctattgtgcacaattcagatccaagtgtgaggtgccaaatttatctgataaaagaatttttgcctggcgagtctacttcacattaatttcagttcttatcaggtttttaacacttcaaaaattatttatcttaacatagagaatttcttatttctctttataattccaagtcctctttgacatattaacacgcacagaggaggtccctcctgccagcatttctgcctcttgggactcttttgtcctgagttctggttcaccatcccctcctttaagcccaaaggactggatagtgttcttccaaaaacccctcaattgtacttaatccccccaaatcctagagctctttgggaggccctatctccatggagcatcttgctccagctggagttgaaaaataaaataaaggtcactacagtacctgacacactttgcataaacaatcacatgatgccccaaatctgagcagaaaggagatttgcttcaggaagtcacaccctgtggctggatataaggggacatccagaggatgtccatgtggacaagcatgagccaccgcgtccagctgggaggagctttacgaccatgtggtaaagctcctccccagctgggtgctgtggctcacgcttgtaatcccagcactttgggacgcccaggcaggcagatcacttgagaccgggagttcgagaccagtcttgtcaacatggtgaaaccccatctctactaaaaatacaaaaaattagccaggtgtggtggtgggcgcctgtaatcccacctactcgggaggctgaggtgttaagaatctcttgaacccgggagacagaagttgcagcgagccgagatcacgcaactgcactccaccctgtctcaaaaataaacaaataaataaataagcttctcccattggcccctccatcaactagtaaagaccacttgcaaggactagggaagtatttgttttcctaattactttctaagttttttgcctcatccaaaaccttaagtgttgactttctctgataaaaaatgtccaaatgatcagaactcacacctgcaatatgactaaagttgtgtcttaaaaatagatttatgtcctttatacatatgaacttatattcaaatgagtgttatctttcagaatagtcaagtagggaggctgcacaattattccagggatgccacagatgtttaaaacatacctggaacttcctatagccatagtttaaaaatcagtctcgcatcccacccccaccccaaatacggtcttgttactttgcactcatatttgcttacctgtggaaaaggcaagttctttactctgggaactctaggtatatttctgcaaattcatttatatgctattaaattatctgcatcttgtagagccccagagatttcaggaactatgtactttctgatggcctgtcttccattgtgggtagaatcagtccacgttccaaagagacacatgggaaataccacatagtcctcattatagacccccaagatccctcattaaaatgaagcattactcattctctgcatgccaagtgaggcttgccagctctgcgtactccctaagcaaaccagtacttgtttggacatgtatttacattaaccagtgaattctctcagatttgttctgagaaagcattcaaagtagactttttcctttggtgttctgccctgggcattcataactgtgccaaatgctaaacaatggccctcacgtcatgtcccattatgtaaatccaagattttaattgttatcaaaaaggtactggcttttgcttcctttcagactatgttagggccgacatacccgtgacacaacagccaaaggttcgggatatgaaatcttttgatagcataccagggttgtaactggacattccagagccccatgccaagatgaaagaaagcattcctctcatcacatgtaaattataaaagaaatagatggcctgtgcaatactgagtaaggttgagctaaatctatacctcaggggctgaccaggctgctggctgttttgctgggactctaacttgctatccagtggccctccgcatctgaatctattctcttcccaggtttgggtagtgagagtagagaaagtaagggatacctggactttccccactgactggttcccattgagctcccattctcggtggttctgtttcccagccccgttgcagtcctccccaagcttagcatctaaaggccatcccggtctccttccgtgatgacttctgcctccctgccatgtttctctttcccccagcccaaacatcacctgtccatttgtgggaagctcttaactcctttcctggacacccccctccatcatcaaccctcccacacacacatttctctgcaccccgtttgtgagattttccctaatcaatgagaggacccttagcattccggatacatacagaggtctccttggtgtctgatataagagtttaagtatcaggaatcataatgggtaccattcctttgagccagacactgtgccaagttcagttcaaatattatcttatttagttccccaaacagtccttagagataggcatgatcttgcccattttacagggaagtatgctgaagtttagaaagagtacatgacttgcccagggtgagccactggactcttgccagaactacggtgcaagccccattgtgtggctgcagattgtagtctgttaaccggaccctccactgcccttgctgtgtgaagagtaactctatgaatgaacatagtgagttttttattttgtttagaagaaatacataagaaccagccaagcctggtagctgaggccactttctgggttggaaacatttctaggctttagcttaatcagaagtaaaacagagaggaggacagaatgtaccccatagttggaaagacactgttattgtatataaagcccatagaacaatgcctgactacagtaaaaaaaaaaaaaaaaaaaaaaaaaaatctatatttgctatttatcagtcctgagatgcttctcaacaaatagtagtataaacagtaatgtttccttttcaaggcttgagaattttagttaccataagtgttttctcttctttttactcattctggatcacttgcacaaaatcaaaaacaattttaatagtcataaacaactctaagggatatgaaaatatcttttttttaattataaaagaatgattaggaaatcttacaggggtgctgggtaacacagggagctttaagatcatgggctcctgtctcttgtcaccttctagttgacatgtataaaagagaagacatctttgctccacctggtgcagccgtctggggctgaatcttttcccgggctggctccaccctcacttccaagcacctggaatccttgtctctgcagttctgcttctcattgctctgcctttcagtctgcaagatacagaaagaggaaaccaactcagaccctaggaaatgtacaccctcaaagcttcaagaatggtctctctcctaaggagtcttcttccagcccctggctattctccctccttcaggggtttctcattcaatcagagcccatgtgagatctcagaagccatgtataatacgtgctgatctctcaacccaggacacatcaagagcaagtaggccttagtgaaggggacaaaatggatcctgggtgtttccacttatggataaatattccttgtcaactgctgtgagtgtatttaaagcaaaatagagatgtctgttgtctctgcaccctagtggttttaaacaaattccatattccaaatctcatttccccaaatgtgttcactgaataactttccaacacagaaaataaaacaaagtcaagtcagaagtgttaatggaaaaagcaaactctgtaaaatatttaaagaggtttattctgaggcaatacgagtgaccatggcccaggaaacagtctcaagaggtcctgagaaagtgtgcccaagatggttgggttacagtttggttttatacattttaaagagacagaagttacaagcaaagacataaatctatacctgtaaggtatgcattgatttgacctgaaaaggtaggatgtctcaaagaagtagtgggtggttacaagtcataggtgaattcaaagatttctgtggttgggagttgtttgaaagagttaagctttgtctaaagactttaagtcagtagaaagaaatgcttgagttaagataagggaggttgtggagaccaaggttcttgttatgtagatgaagcctcatacgtggcagccttcagagagaatggatggtaaatgtctcttttcagaccctaaatggcatcaggctctttgttaatctctcctagatccaggaaggtcctggctgtattaatggagactctctacaaatgcaaagatcccccacaaaagatggctctgcagagccatttcaaaatatgtcaaagaaatatattttgggctaaaatatgtttgatttccttcaggacctcctatctgttatgtgatgctacatcaaaatcaggttgaaatgtggaatcttattgccccaaagagtttgttttgtcagtcttatgatctctattttaatgttaatcctggtcagttgtgcctaaactccaaaaaggagagggtacaattaggcatgtctaacctgccttcccctaatggctgtgagttccatttttcaggtttctctagggtccccttggcccagagggggtccattcagttggttgagaggcttagaattttatttttggtttacagaatgaagtatgttcattcttttatgatcattcctaaattatttcatgtcaaaattctatctcccacaaaatttgattatctcctaactgggcaattttggatgatttttttggcttcttgttgaaatggttttgtacctcaagtttctgctggaaacatacattattttttatttacatacagtatttgtaagccagagaaaaaattctcaaacataaaaataagagtgtactcaaattttaaagtcttagaatttttagccatgaatgagtaaaatttttaggaaaaaatgtgtaccctctttactaagaaaatgaaattttagaccacattcaattccttccatttaatcagatgtttcttcaccagttaaacaaatctggccgacacgtgttctttgaccagcagatgacatttttctctattcaacttgaatctttcactccaccatagctgttgacttttacatctgtaatggtttgtgtacatttttctgattttctggcattggagaaccgagtccaagatgaatgaaggtgataatgttactggcggcatatatgtatgggtctgcagcaacctcagttcttgccgcctcagaagaaataatttgaccaaggggcataaggcagagtgagactgaagcaagttttagaacaggagtaaaagtttatttaaaagctttagagcaggaatgaaaggaagtaaagaacacttggaagagggtcaagtgggcaacttgggagatcaagtgtgcagtttgaccctttgacctggtgtgttatgtgttggcgtgcttccggggtcttgtgttcctttctccctgattctttccttggagtgggctgcccacatgcacagtggcctgccagcacttggcaggggccgcatgcgcagtgtgtttaccggagttgcgcgcatgctcacttgaggcatccccccttaccagttgaatgctcctggaaagtcatataacaattaaactccaccatttttcctcttagtgtgcatgactgagcccactcacccaactcctgagatcttatcaggaagctgttgatcatgagctttaggtgtctttctctattgggagactgcctttccctggtgccagctgcaaccaattattattttagagaggcagttttaacaacaaccgactgaccatcacctgatggttgcctgacattcttgtttgttggggggtggcagggggatgctctcctgccctttcacgtctgactagctacctgctgtaacaataagtatctcacattctgaagagagctacctttcttggggcttacaagagacagccgaaggactctgctcacttactatcaccaaggccatccatgcttcactatgcccgtcttccccaccctcttcccaagatggggaagagggacagggtctttgcagtcttgagttttggatctaggggagctgttgggggaaggaagggcctctccacactgaccaaagccaagtgtgaggctctaagagaatccctggtaaataatagctatgaggcaggaatttaggaagctgactcgttagccttccttatatctcctatttaagcaaggaaaagagtcttggaaggatatggcagggcagagggagggggagctgtaaagccgcctgtgatcccatcattgtacatgtcaaagtttcttgtagatctggtttgacatagaggaaggttgctggagttgagctgtcttgatggtggcccacccaagaaagaatggctcctgggcaagagttttccagcagcaggaaaccatggggtgtgctgccctggacaggagccagggggtgttaaagaggtctagctggagccagccagatcccccacataaggaagctcttcatttcagaaacccttcagagacccctgcaaacctcacacttatgcacccgacgcagaggtgagcacctggacttcagcctcacagcactaatcagtgggaagcagggatttgccaatgacagggaaagccccttgcataagcacaggcagtgaagtcagaagatattcatccttcttccatttcccccgccagaaaggaaagaggcatctcagaaccagtccacgtcctcctcttctacttcagggtcttagagtgcatggaataaataagtaaacccccctcccattcagggttccagcaataagcctgctgtgttcaaggaaagcagaaggccactgtgtgttgaagcagagtgagggagagtgcacagagctcctagggtgagggaaggagagcattagaggccactggaaagactgtccttaattcagattggcagtcattggaaggtttggacagagacttgacatgaactgagacatttctaaggaatcactttggccaatgtgttaagagtggattgaaggcaagggtagaacaaggagaagagaagagaaggctatagaagaaatcctgataagagatgaagtggcctggaccctggtggtagaaatggcgttaataggattctggatatattttgaaggtagggtcaataggatttcctggccaaatttaaattaaaccctggactcagcccctttaataatgtttaaccttggtatggaaggcaaaataatgctcaccacaagcccccaaagatatccacatcctaaaatccccagaacttgtggatatgttccctgacatggcatgtggcaaaagggactttgcaggtgtgattaaggtaaggaccttgtgatggacaggttagcctgcttttgcaggtggacccagtctaatcccatgaatccttaagagtggagagccattcacaactgtggtcagagagagacatgactgccgaaggacagttagagagatgcagtggagaaaggacttgaactgccgtcactggctttgaagacagaggaaggggctgtgagcacggaacaagggccccctctagaagccgaaaaaggcaaggaaagggattctcccctagggcttccagaaaggaactcagccctgctgacaccttaattttagctcagtgacacctatgttatacttctaacctgtagaattctccgatgaatatgtgttgttttaagccacaagtctgtggcaatgtgtcatagtagcaagaaaaaaacgaatacttgaacaaatcacttaatctctatgggcctcaatttccttatccgaaacaaaaaaagcatgatgatagtgatcaggcaggattgccgtgagcatcagaaaaatgggtatacaatgtccagcacctaactggcactcagttccagtggccattgttgttctgtttatacgctaggaatactccatcctaagagagcctcagcttagttctttctgcaactttcttccctcacgaaccttaccctggaaggcagaagtctagatctttgaagttagatgctccttgtttagttcccgtcttcctcgggtctttgagcaaattacttatcctctcttagcctcattgttaccacctttaaaatgggaaagaatgcctgcctcacagagttgtgaggattaatgagcccatagggatgctcaggaaatgagagcatcttcccttcctcttaggcgacaaaattcctgaatgcctgcagagaccctaggagaaaggctcattttctttttttctctctctctcttccccgccacccttattttattttcattttatcctctgttcttcatacgggctttggtcctactttacagcatgtgtggctcttcataacctattgagaaagttaaagagttttctgaaattttcttatggttcatatattaagttatttccggagctctgcttttcccatgagattcgagaatgtcattgctttcccattattccaatctgcgtatttttacaagcactgtgctgagaatgcactattttctcatcttctaaggaaaagtctatctgggcagttgaaagcctgacaacagagagtatgtcttgcccttggtgcctgagaatgtccacttgggtgttggtcaaatcagcttcttagacctgcatctggacagaaaaggcttgtgtatataatctgtctcaatccccagtatttattattctgagttttttgttctcctacccccaacagctggttctcagacattctgggagtacatgaagaactagaattccccatgtgctattaaccttgccccaccctgaagtcatgttttatgtggttatgatccttcccccactccccagcttccctacagccatgcctacaccactgcttcttttccccatagtctgcccaaatcaccagtgtgatgctgcttgtgctcttgatgctacttggcaattttcctgtggatttctccagccatctctatccactcccctccacctccacctcactctcccagtcctcccagcagatggcctggccttttatttcacagagaagataaaagactctaaacagggactccttcgatctccccctacaaacatcatttctgcacccatcctctcttcacctcctgagacaataggaaaagggcctctatgtttttcagcaagcaatccttccttctggactctggcctcatacccttctacctctcctgggaccccattcatgcccatcacttcattctcctgtaagttcagtctcactgctggatcctttcaatcagcatctgaacacactgtagtcctagtctccaccttacaacattgctcttcttggaccagcccctgtacatctagctgcttccctatttccctactcacagctgagtgccttcaaagagttgtctgcattgtctctactctcacaccgcaaaggcttagagacaaggtggtatagtggttgagatagtggattcatgagccagactgcctaagcctgtattctgcttctgccatatgaactgggccaagtcacttaacctctctgtgccttggttttctcatctgtagaatgggataataataataagtctctcatcagattggcattaccattaaactaatactactctttagtatatgtaaaatgcataggacagtaactcacacagagaatgtactgtggcttcagctgtcattactttagcaaaattttggctgatgtcaccagtgacttctcctttgctgaatttatggaatgctctgtagacctcttctcaattgacatttcagcaatttgatactaaaacaaaccccccctcttcctgatacactctgttcctctgatttaggtgttgtaaccatttattttccctccattctgaagatgatccctctcagcctcatttgctggctctttcaactccccccaaacctcagtgttggaattcttcagagctcacttccaggtcctcttgttttactacccactctccctaggtaaacccatccacatgtgtttgcaatgcctccatttcggaactccatcccatacctctctcctgaacctactccatatctactcacttagcaactgcaaaccaacctcatgccatgccagatgtctgcatcccaccccaaacctgcatccccttgtcatcatcccaaaactagttgtttatgctggaaatctatgagacatcctcaacccatctctcttgggcccactccaggcagttgttcaccagtttctgagttctgtacctccagtgtacttgtagaatctttatgctttgctccatctccactgccaacactatggtccaagcctcagttatctctcctctcaaccactgctagaactgtctatccaaaggatcccagagtaatcttttataaacaaatgtcatcatgctactcccttgctccaagactgtggatgacttctcattgctcctcaagataagaaccaaaattcctttacatgttttagggggccctgcattaccggacccctgctgacctctggcctcatcatattcctccttcccttttgcttgctagctccagacacagtgatcttctctgattgtcaaaagcaataagcttcatccaccttcaaagctttcactttctttgtgccacaaacaaatcccacctctcccccagtcatgtctcgcaccagtgttagtttcaaatcctgctcctctttcaggcctcaacttaactctttttctcggggaagccctctctgattctccagacttggttcagcttctctgtgctacactactataatctgttgatttctgccaggggatttaaaaaatagttgaagttttgtggttatttgattaactctttctccaaagtctgcccccaaagtcccctcccttcactatctagagcaagaaagagaattagcacttcaaattatcttaaagaaaataaagagggcttccttgtctccagtattctaagagttaatccaagcacattttctttagacattacatcaataaaatgccacagaaaatatttctaagatagactttaataagagaaattgcaacagtgggttttagatgcaagcaaatagagaaaatgaatatatattacacatacacacacacccacacacgcacacacatacacacacacccctacctctcttacacttagttcaatggtaaccatataaagggtttacgacacccctgccatccatttctccaatattgaatttcagctttattgtctcttctcccacctgcctgattcatttaaattgccaactgaagctgataaagttgtagcagaaacctcacagactgcgctccttgccagagtgactgacatcctataggagagatgacctagttcaggcaataaaaacattccacatagaggaaatattcattaattagcaaaatcataacctcttcatttccccgaggggtgccttcttggtgtctttgagagtatgagagcattttgaagactcagaacatattctcttgtgggctgcatgggagggtacatgtatgtgagcatcttcacagggacccctatcctgcccagtcccacctttagcagatggttcccacagctgacagtaactgagaggaaaccagtccccaggcatttgtatctcccacagcacccaacagaggcacacattaaaatctggttaaaagtaaacaattcagatgaagagttatctgtgccagagatgagcttataccccaagagtcaacagaaatttatagcctaaaagaccatttgcttgttatgggatggaaatggcaagagaaacttgatctaaaatagccatataaaacattgactttgtacatgtaagtagacccatttccctaataattttcaaagtaagagaagcaactggcttattgttattgtaatattttaattctccaatattctgaaagatctgggtacatcttgactggtgacaaagttcattaactctctcaaacaagcacttattgagtgcctaccaggtgtcaggcattatgccaggtgcaggaggtagactatggaagaagcttcagctctgtcctcaaggagcttacagtctattgaaggatacagggaactaaaaagcaatagtcatccagttgataactgctatttgcaagaggaaaatagagtctacggaaggttctctaacccagacttagagagttctgaaaggcttcccggaggaaatgacatgtaagctgcctcttggagggtgaataagagttagctttgtgaaggtccaggataaaagtgtcccaggcagaaaaagcagatggcctagaagcaacggagaggaaaccatagtcagggagccaaagcagttcagtgcacctggacccattgacattttgccctcctcctgtcactgcaatatatattccacctcaactctccccaccaaaactgttttcatttttcctttctacagcatccttctttgactggttatttcatgattgggtgggtggttatttagatgattggttggttggttggttggttggatggtttcttgggtggttggatggatggttgggtggttggatggatggttgggtggttggatggctgggtgattggatggttgggtggttggttgggtgggtggttgcttagttgggtgattggttgattggtagagtggttggcccatttcctgtaacactgctcctactcagcctccttgggaggccccattcttcatactctctgatgctctagccctcctggcaagctttcatacactgcctctcctccaattttcatgtctcagccagatagtttttttaaaatgcaaattttatcctgtcaatcctcctacttaaaagtcttcaatagtttattttttccagtttgggtatttttttttctttctggtagcacttttattcttccttgcacaatgacgtatccttgggctgtgatattctcacgcaacagtagaaaaacaagatgtgtaagtcacccataaagctgagaattacgtacaaaactcttacataaattaaaatgatgcataaatttacaggtaaaaatacaaatcattttgcaactagaatgagtaatttagccctgtgacattctgctgcaaaaaaaaaaaacattggataagaaagaaaatggagtcctagagcctgggttatgtacgttttctacctctgctggaagactgcaacaaagaagtgacaattcattcataaattcttgccagcctctggagaaatccaggaattgtcatttgtactctgtggagatctgatcaggccctagaggagtgaacagcttgaaagaaattgtcagtcagccaaagacccatcacatcaggccaagtgccttctataaacatgttccccttattctccctttgccacacaaagtgtctagccacacatgctaaacttaagccaaagatatgtaaagaatgttagaaaatgtattataaagaaatagttaatatgaatacaaggtgaaacagtgctatttgcctatcagacaaagacaggtatctttttaaaaaggcatcttccaagtagataagtctaatataagatgctatccatttaaaagtagccaggtgtggtggctcatgtctgtaaccctagtcaggaggctcacctaggcccaggagttcaaaacccagcctggacaacatagcaagctaatagtcccagctaatcagggggctgaggtgggaggattgcttgagcccaggaatttgaggctgtagtatagtatgcttgtgccactgcactccaccctgggcaacagagcaagactgtctctaaaattgcagtgggcaatgggcaggtcaaactcatcagactcttgcttgctattccacatctgctggaaggtcaagacagtcgctagccacagtatgtgcactcagaagaagggaaatcttaatttttattgtgtttttttttcccaaggctgtgacatctgtctgtgttctaaagccagtaatagcaggacacatggtagtactaccagaccagatgggatgtgttgtgttggcatatagatcttttctaatataagcatcacatctcatgggtgacatggaagtgctatcttgagtgccactgctttcatacctgaggaggatggctgaaaagaacttctgggtctatgactctctccttgacagaggtgatcaactgactgtgagggagcttagtggtcttctccagggtagatggtaagcaatggtagctcctgtttgacatccaggacagagcagtaccacttctccttagcatcatgtacaatttcttctctgctgtgataatgaaactgtaatctcttcttctcacagtccttaggaatactcttccaagtctcagctagcagagtcgagaaatagcatgacatagggcaggtgtaactgtcatagaagggcattgtgtgggtgccacaatcatctaagtctaccagcagtatatgaccagaagcattacaggaacagcatggctggaatagcagtacacatagctgggctactgaaggtgtcaaacagagcctgttacaggtgtcatcaattgatggacatttggtttgtttctttttggctaaagatggaagtttgaagttatgaaatacccatatgcttaaagagagaaatgagtagcagagggatttcaagccactgagagggtctgattgaattcgaaaaccacagtatgatgctgcacagtcatgtaatttatgacacacaaaactcttcaacagtaggctctgcctcttctcagaacgccacacatcagctctgctaaactgcttgtagttccacgaactcacctctgggatttgcagtgttcttctctttgcctagataatttccttccaggtctcactgccattcccaatctaaccttgagtctgagatcagatgtcacatcctccagaagctttccctgacattctgagtcagtgtcaggtgcccctttcaagtggcaccctccattcaccccatcatagcatttctgacactgctgtgaaacatccaccgtgcaccaccaccgggctagaatcttatgggcaagcactgtgacattcaccagatgagccccatgtctggcatgatgcctgctgcctaagaggggctcaataaattttaaaggaataaatcagtgaatgagtggtgcatactttcagaaacatggatctatgagggttgaagatgctgagaactaggactggggaccaatgagcatgtcactccaacacattggcagtggaaattcttcagagatgaatttctgcacttttaaaaatagagaactggagtaattaatgtttgtcaaaacatacttgtttgtatttctggacaagtttttatcaaagttaaacataaatctttcagaaatattagctttgcaattctcccgttttctttgtccacatttggcgctccactcttgaatgatggtttctagaacacaactggaaagaggcaagagtctatttacccagttgcacacaggtagaaaagaataagttaccagccaggattcccagtgtaatctagcattagagataacccctgatagacatcagaagagggtgtaagtcccttttcaaaagaaaaaattaaaaactactagtgatatgccttccctaaccattgctttcaaagaccttttaaattatttttgttaattaaaatttgaccatgtatacttctaaaaattactaaattaaggaaagtcttgatttttatagcatattgagttaatacggatattgcttgacttgaccaaataaattctttaaaatagccacacacagaaaatagagctatattttttaaattgtatactgtaagcctttgaatgaattttccatgaagaaggcatcatggagaagaataaatgtctgacacatacaaatgaggtgaggacaaactattgagatgtagctggcaatgatccagcttcttagttcacttttaatagtttattttatttttatttttattttatttatttcttttttttgagacggagtctcgctctgtcacccaggctagagtgcagtggcacaatctcagctcactgcaagttaatagtttaagttcatgtatctttaaactaactgtgtagcttgtttttataaaagacaaatattgggagatggccataagttgactcttgctttgcaaaccaaagtgtatcttaaaacaagttcccctgtgcttatctaataatgagtttggacaagaataatgctgcctcggattgcaatgttcaaggcagtcattaaagttaataatcagtgctcttgtatagaagctttatgcctaacattgatcagccctttattgtgtggcatttgctagtattcaagtagcaaggagctcaccacaaaggccatcaggtaggtttccatggtagcagtctttcttttgttattcaccttggtaacacagactgggtgcaagccccaagccttggcagcttacacgtggtgttgggccattctcacgctgctatgaagatatattcaagatggagtcatttataaaggaaagagatttaattgactcacagttctgcagcactgcggaggcctcaggaaacttacaatcatggtggaaggggaagcaaatacgtccttcttcacatggcggcagcaagaagtacagagcaaaggtgtggagaaggccctttataaagtgtcagatctcatgagaactcactatcaaaagaacagcatgggggaaactgcccccatgattcaattatctttacatggtccctcccttgacaagtggggattattataattcaaggtgagatttgggtgggaacacagagccaaaccatatcagacagtatccaaatactcaccatgtcactgcttaatgaaaataaatagaatattgatagtgctagtagagtcaagaacctggtctctgggtgtgacaacaaggcaaggcatgatgtctaccaaggttttcttttaagcagctgtccgctaagctggactagtgtccttttgatcttattccaggttaataaccctccgttgtcttatattattgccctggagacaaatagaactcaatggtgactagaatagtttcattaatgctgaatcttatgaaagacaagtttgtgattgcacagtaataaaagtacaatataaaaactatggaagaaaagagaattctacttttttttttcagagaaactaacacttttatttttttattttttatttttttctttcttttttttaatttaattttattattattatactttaagttttagggtacatgtgcacaatatgcaggttagttacctatgtatacatgtgccatgctggtgtgctgcacccattaactcctcatttagcattaggtatatctcctaatgctatccctccccactccccccgaccccacaacagtcctcagagtgtgacattccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtaccacattttcttaatccaatctatcattgttggacatttgggttggttccaagtctttgctattgtgaatagtgccgcaataaacatacgtgtgcatgtgtctttatagcagcatgatttgtagtcctttgggtatatatccagtaacgggatggctgggtcaaatggcatttctagttctagatccctgaggaatcgccacactgacttccacaatggatgaactagtttacagtctcaccaacagtgtaaaagtgtgcctatttctccacatcctctccagcacctgttgtttcctgactttttaatgattgccattctaactggtgtgaaatggtatctcattgtggttttgatttgcatttctctgatggccagtgatggtgagcattttttcatgtgttttttggctgcataaatgtcttcttttgagaagtgtctgttcatgtccttcgcccactttttgatgggattttttgtttttttcttgtcaatttgtttgagttcattgtagattctggatattagccctttgtcagatgagtaggttgtgaaaattttctcccattttgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatctatcttgaattaatttttgtataaggtgtaaggaagggatccagtttcagctttctacatatggctagccagttttcccagcaccatttattaaatagggaatcctttccccattgcttatttttctcagatttgtcaaagattagatagttgtagatatgtggcattatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtgcttcacatcccttgtaaattggattcctaggtattttattctctttgaagcaattgtgaatgggagttcactcatgatttggctctctgtttgtctgttattggtgtataagaatgcttgtgtttttgtgcattgattttgtatcctgagactttgctgaagttgcttatcagcttaaggagattttgggctgagacaatggggttttctaaatttacaatcatgtcatctacaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcagtacctaatttattgagagtttttagcatgaagcgttgttgaattttgtcaaaggccttttctgcatctattgagataatcatgtggtttttgtctttggttctatttatatgctggattacatttattgatttgtgtatattgaaccagccttgcatcccagggatgaagcccacttgatcatggttgataagctttttgatgtgctgctggattcagtttgccagtattttattgaggatttttgcatcaatgttcatcaaggatattgatctaaaattctcttttttggttgtgtctctgccaggctttggtatcagaatgatgctggcctcataaaatgagttagggaggattccctctttttctattgattggaatagtttcagaaggaatggtaccaattcctccttgtacctctggtagaattcggctgtgaatccttctggtcctggactctttttggttggtaagctgttgattattgccacaatttcagagcctgttattggtctattcagagattcaacttcttcctggtttagtcctgggagggtgtatgtgtccaggaatttatccatttcttctagattttctagtttatttgcgtagaggtgtttgtagtattctctgatggtagtttgtgtttctgtgggatcagtggtgatatcccctttatcattttttattgtgtctatcggattcttctctcttttcttctttattagtcttgctagcagtctatcaattttgttgatcctttcaaaaaaccagctcctggattcattaattttttgaagggttttttgtgtctctgtttccttcagttttgctgtgattttagttatcttgccttctgctagcttttgaatgtgtttgctcttgcttttctagttcttttaattgtgatgttagggtgtcagttttggaactttcctgctttcttttgtgggcatttagtgctataaatttccctctacacactgctttgaatgtgtcccagagattctggtatgttgtgtctttgttctcgttggtttccaagaacatctttatttctgccttcattttgttatgtacccagtagtcattcaggagcaggttgttcagtttccatgtagttgagtgattttgagtgagtttcttaatcctgagttctagtttgattgcactgtggtctgagagacagtttgttataatttctgttcttttacatttgctgaggagagctttacttccaactatgtggtcaattttggaataggtgtggtgcggtgctgaaaaaaatgtatattctgttgatttggggtgaagagttctgtagatgtctattaggtccacttggtgcagagctgagttcaattcctgggtatccttgttaactttctgtctcgttgatctgtctaatgttgacagtggggtgttaaagtctcccattattattgtgtgggagtctaagtctctttgtaggtcactcaggacttgctttatgaaactgggtgctcctgtattgggtgcatatatatttagtatagttaactcttcttgttgaattgatccctttaccattatgtaatggccttctttgtctcttttgatctttgttggtttaaagtctgttttatcacagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttaccagtctgtgtcttttaattggagcatttagtccatttacatttaaagttaatattgttatgtgtgaatttgatcctgtcattttgatgttagctggttattttgctcattagttgatgcagtttcttcctagccttgatggtctttacaatttggcatgatttttcagtggctggtactggttgttcctttccatgtttagtgcttccttcaggagctcttttagggcaggcctggtggtgacaaaatctctcagcatttgcttgtctgtaaaggattttattttgccttcacttatgaagcttagtttggctggatatgaaattctgggttgaatattggcccccactctcttctggcttgtagagtttctgctgagagatccactgttagtctgatgggcttccctttgtgggtaacccgacctttctctctggcttcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcccgcagagtgttttccaacttggttccattctccccgtcactttcaggtacaccaatcagacatagatttggtcttttcacatagtcccatatttcttggaggctttgttcatttctttttattcttttttctccaaacttcccttctcgcttcatttcattcatttcatcttccatcactgataccctttcttccagttgatcacatcggctcctgaggcttctgcattcttcacgtagttctcgagccttggctttcagctccatcagctcctttaagcacttctctgtattggttattctagttatacattcgtctaaatttttttcaaagttttcaacttctttgcctttggtttgaatttcctcctgtagctcggagtagtttgattgtctgaagccttcttctctcagctcgtcaaagtcattctccatccagctttgttctgttgctggtgagaaactgtgttcctttggaggaggagaggctctctgctttttagagttgccagtttttctgctgttttttccccatctttgtggttttatctacttttggtctttgatgatggtgatgtacagatgggtttttgatgtggatgtcctttctgtttgttagttttccttctaacagacaggaccctcagctgcaggtctgttggagtttgctagaggtccactccagaccctgtttgcctgggtaacagcagcggtggctgcagaacagtggattttcgtgaaccgcgaatgctgctgtctgatcgttcctctggaagttttatctcagaggagtacctggcagtgtgaggtgtcagtctgcccctactggggggtgcctcccagttaggctgctcgggggtcaggggtcagggacccacttgaggaggcagtctgcccattctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcaggcctccctgagctgtggtgggctccacccagttcaagcttcccagctgctttgtttacctaagcaagcctgggcaatggcgggcgcccctcccccagcctcgctgccgccttgcagtttgatctcagactgctgtgctagcaatgagtgagaatccatgggcataggaccctctgagccatgtgcgggatataatctcctggtgtgccattttttaagcccatcggagaagcgcagtattggggtgggagtgacccgattttccaggtgccgtctgtcacccatttctttgactaggaaagggaactccctgaccccttgcgcttcctgagtgaggcaatgcctcgccctgcttcggctcgcgcacggtgcgctgcacccactgtcctgtgcccactgtctggcactccatagtgagatgaacctggtacctcagatggaaatgcagaaatcacccgtcttctgcatcgctcacgctgggagctgtagaccggagctgttcctgttcggccatcttggctgcttccacaagaattctactttttaaggtataaggataacattgaggaatgaaaacagctttggatttttgttagtttatgtgtcctcattttttccagtgactcaacacctgggcttgctcattgtctctattgtctaaaataaatgcattctgataagcgtcacttctctttgattgtgaattgattatttgagttcatagcagcatgtgggggctttgttatgctgtctggcttgttctgaggtcaacagggaagtcaactagtactcagtcattcaaataaggagaataatgtactcagacttaacattgttctggtattcagtcctaccaaaacatcatttctgccacttactcaggaaagagtaaaagctctaactcttaatttaatttacctttctccttcctatacgatacctgaaaacatttatgaatgagtacgcctttagtgcctccattttagttactttaatctgtgaaatttccacaaagcattgtatggctttcccttgtagttttagcctttatcataaacagtctgagtgtaacatccataggggtgtgtaaagtttctgccatatataaaatatatttaaaaaatatatttaaaagaaaaactacaaataccaaagccaaagagaaaatcttgaaagaagctggtggtggggagtgggagagtggggggcttccttttacttatagagaaagaggataagaattataatatacttctcatcagaaatcatgcaagcaagaggggaatggagtaaaatattaaaagtattgagtattgaaagacaaaagccgtcaacctagaattctatatctagggaaattatctttcaaaagtaaagaagaactattttctcagacaagcaaaaatggagagaattcataatccacagacctaccctagaataaatattaaaagatgttcttcaaggagaagaaaaatatagttcagaaacatggatctacactaaaagaagagcatagaataaggaataaataatcctgaaataaaacatatgatttttctttttaagtgaggtattagagaagtgctttttaatgttacaaaggcaacaacttattagctgattatagtatagaaaaattataaaaagaaatacttttaagaatcagaagtattgtaagagagaagaaaaagcagaatcatataaaatactcaaaccaaagaaaacagaaagggggaagggcataaaaaaagaaagaaatgcccagtgcaatgaatagaaagcagttaaaatatggtagttattaatccagctatatcaataatcactttaaatgtgaatagcctaatacaccaattaaaagacaaagattattacattagataaaataacaagactaaaatattatacatgtttctacaagaaactcactttaaacataaagacacagctgggctaagagtaaaatgatgaagaaagatatgctaacactaatcaaaataaatctgatgttagctatattaatttcagacaaagcatactttgaacaaggaaaattatcagagataaacaggagtactacataataatgaagggattaattcaccaaggggacataatctttaatgtatatgcacataacaacagagcataaaaatacatgagacaaaactgatagaactgccaggaaacataggcatatccactattataattggagacttcaacacccctcttttagcaattattagataaagcaggcaaaaaattcatacagatatagttgacctgaacaaccatcaatcaacttgatctaattgacatctatagaatattttattcatcaaaagcagactacacattccactcaagcttatgtaggacattcaccaatatcaaccctattcggggcaataaaacatatcttaacagagttaaaaaaatagaaatcataccaagtatgttcacagtcaacatgggagttaaactagaaatcaataaaagaaaaatggctagaaaagtccaaagtatttggaaattaaatagcacactaataaataacccatggttcaaataagaagtggcaagagaaatttacaaatactttgtactaaaagaaaatgaaaatataactcaccaaaatttttgagatgcaaggaaagtagtgcttagaggttaatttaacattaaatgcatatattagaagtttctaatctgatgtaagactagagaaggaacaatttaagtcaaaagtaagaagaagaaatgaaataataaaaattaaagaagaaataaataaaatttaaaaaaaaacaataaaagccaaggctgattattgtaacagattgataaaattataaaactccagccaggctcaacaagaaaaaaagaaagaatatacaaattattaatataataaatgaaagaggaatcccactactgagcctatggacattaaaagaataataaaggaatattatgaacaactctatgcccacaaatttgataatctagataaaatggatcaagtcctggaaagaaacaatcaccaaaactcatgcaaagagaaaaataatatcttaatagacctgtctctattacagaaattgaatgaataattagtaaccttttaaaacagaaaacattaggttcagatggcttcactggcaaatcctaccaaacatttaaggaagaaatgataccaattcttcacaatttctttcagaaaatagaagcagagggaatacctcctaactcattctctgaggccagcattgccttaataccaaaacaactagagaaatacattacaagaaagaaaacttacagacacgtatctctcatgaacatagatgcaaaaaatcctcaaaaatgtttgcaaatccaattgaacaatgtataaaaacaattattccaaaatagctggatgagaggacttgaaattttctcaacatatggaaatgataaatactcaagatgatggagactcccgaataccctgacttgatcatgcatcaagtatatgcacacagtctatgcatataacaaaatattgcatgtaccccataaatatatgtacaaatattgtgtatcaatttaaaaataaaataaatttaaaataattattcaccaaaaccaagtggaatgtattctaggcatgcaaggatggtcaacattcaaataccaattgatgtaatacacaacatcaataagctaaagaagaatcatatgatcgtattaaaagatgcacaagaagaatttgataaaatccaacatccacttgtgatttaaaggaaaaaaacctctcagaagactataaatagaagagaactccctcaagttgatgaagaacatctattaaaaatttatagctggaagtcctagctagagcaatcagacaagagaaagaaatagagagcatccaaaatggaaaggaagtcaaattatccttgtttgtatgatcttatgtttggaaaaacctaaagactccaacaaaaaaactgttagaagtgataaacaaattcagtaaagttgcaggatacaaaatcaacatacaaaaatcagtagcatttcaatatgccaacattgaagaatctgaaaaagaaatcaaaaagtaaccccctttacaatagctacaaggaaaattaaataactagtaatcaacttaacaaagacgtgaaagagctctacaatgaaaactataaaacatggtgaaagaaatcaaagaggacacacaaaaagcggaaggatattccatggtcatggattagaagaataaatattattaaaatgttcatactacccaaagcaatttacagattcaattcaatccctatcaaaataccaatggcattctttacataaatagaaaaaagcaatgctaaaatttatgtgaaactacaaaagacccagaatagctaaagctatcttgagcaaaaagagcagaactgaaacactcacattacatgacttcaaattatactacagagatatattaatgaaaacagcatagtactggcataaaagctgacacagatcaatgaaacagaatagagaacccagaaacaaatccaaagaactgcaataaacccatttttgacaaaggtgccaaaaacatacattagggaaaggacagtctcttcaataaatgttgctgggaaaaccggatatccatatgtacaagaatgaaactagacccctatctcttgctatatagaaaaatcaaatcaaaatagattaaagacttaaatctaatacctcaaactatgaaaccactataagaaacattggggaaattctctaggacattggactggccaaagatttcttgagataccctacaagcacaagcaaccaaagcaaaaaatggacacataggatcacatcaagttaaaaagcttctgcacaacaaaggaaaccatcaataaagtgaagagataacccacagattgggaaaaaaaatacttgaaaaccacctgtctaacaacggattaataactagaatatacaaggagctcaaacaattctatagggaaaaaataataatctgattcaaaaattggcaaaaaatctgaatagacctcaaaagaagacatacaaatggctaactggtataggaaaaggtgctcaacatcactgatcattagagaagtgcaaatcaaaactacagtgagataccatctcaccccagtaaaaatggcttttatccaaagacagccaataacaaatgtcggggaggatgtggagaaaagggaacccttgtccactgttggtcggaatgtaaattagtacagccactatggaaaacagtttggagcctcttcaaaaaactgaaaatagagctaccatatgatccaggaatcccactgctagggaccccaaaagaaaggaaattagtatattgaagagacatctgcactcccatgtttattgcaacactattcacaatagccaagatttggaaacaacctatgtgtccaaaaacagatgaatggataaagaaaaatgtggtacatatacacaatggagtactactcagccatgaaaagaaggaggttctgccatttgcaacaacatggatggaaccttaggtcattacgttaagtgaaataagccaggcgcggaaagacaaaattcacatgttctcacttatttgtggatgctgaataggaaaacagttgaacttatggagataggtagtggaaggatggttatcagaggcgtgaaaagttaatggtggcaatgagggttaaatggggatgattaaagggtacaacaataaaaagaatgaataagatctagtatttgatatcaataaaagggtaactatagtcaataacatttaaagataactaaaagagtataactggaatgtttgcaacacaaatgataaatgcttgaggtgatggataccccatttaccctgatatgattattatgcattgtatgcctgtatccaaatatctcatgtaccccataaatatatacacctactatgaacccacaacaatcaaaactttttaaaaatttaaattaaaaattaaaattaaaaagccctacagctaacatgtttaaactaagaagcttgatacttgtctcctaagattgggaacaaggcaaggatattccctctcacaactcctattcggcatcatataggaaatcctacttattgcaataagacaagaagaggaaataaaatgtaaatacaaactgggaagaaagaaaaaatactgggctgggcacagtggttcacaactataatccttgcactttagaaggccagaactgcaggattgcttgaggccaggagttcaagatcagcctgggcaacaaagctggaacccatctcttaaaaaaaaaaaaaaaaaaaaaaaaaagttaaagtagctgagtgaggtagcccatgcctatagtcccagctactcaggagactgaggcaggaggatcacttgagcccaggagttgagctatgatcctactactacactccagcctgggtgacagagtgagatcctgtaagaaagagagaaagagagagaaaagggagaaagaactgtctttatttatatagatgacatgattatctatgcagacaatcccaaataattaatttctggaacttgtaagtaattataaaaatattgaagaatacaaggttaatatgcagaaatcaattgctttcctataactacagtaaagagtcagaatttgaagtttgaacaataccatttacaatagcaccaaaaaataaatacttagataacatctaataaaatatgcacaggatctatatgcaataaactataaaactctcacaaaagaaagtagatgtgagtaagtagaacgatattctgtgttcatgcatggcaatacccaatattgttaagataccagttcttctccagcttaatctatagatttaacccttttccatttagaaaataaaaaagtacagctcactaccagcactcatttaattttacataaacacactctttgaggatgaagcaaatctgattgattttcaatgtgaaaatataaaaactgttcttggagttatttctaaacaaaactaacatcagaattgtctgaatcatcagaatcatctattttggaaaaactggattcgtcaaatgaatctttggccaacaactgttggagaatgatgttaatatcacatgtaggaatgctacattttctagaattttacatattcagtgaccgagaattactatattttctaagtggaaataccactaccaaaaacagaatgctataaatagaatgatgtcttttgtttccaaagttgatatactaaagcaatgcgaaaataataataaaagggagatatttcgtggcaaaagtatatcggggtaaatgcgacagctgcaagcactgccggcaagtattctcagggcaaatgggaaaagggtttaatgtaagcctaaccaaaaatcccagtaagttattttgtagatagcaaaaactgattctaaagtttatattgaaagtcaaaaggcccagaacagccagtgcagtgttgaagaagaacaaagtaggaggaccggcactacctgacttcaaaacttactgtaaagctacagtaatcaagatattgtggagttggaaaaagaatagacacatagaccaatggaacaaaataaagagctagaaatagactctcacaaatgtaggcaactgatatttgacagaggagcaaaggcaattcaagagagaaaggacatctttttaacaaatggcactgcagcaattggaagtccatatggtaaaaagctgaatcaagtcataaatcttacacctttcacaaaatttaacccaaaatggatcatagacttaaatgtagaagttgacacttataaaaattctagaagaaaatataaggaatttgaatttgacatagaatttttagatacaacaccaaaggcatgagaaaacaataataatccacttgactcagccatgagcaaaggttacataatcataataatcataaatactgagtactgatttagtttctcaaaatatgataaaactaaacttagttgataacagataggggaaaaaaagaggggagagattgtaagaggactgaagccatatcttttattttaggaaatcagatgataatacataaaactgataaatcaagaaatagcagtatatagatattgttaagacataggggtataaaacccagaaagaggttgacatcagcagcatggcagaataggaggtctccagccttggccattacccccaaaaaaacactgattaagcaactattcatgaagaagaatgcctttgtgagatttagggaacccaagaaaaaggttgcagcacaccaatggtgcaaaatatctgagaaaagctgcatttaaaaggataaaatgagtagtttccctctatcagatttacacttcccctaagctaccacagcacagtaccaagaaagatcccctttgcccacaatttctcccatagggagtttcacttatgaaacttagtttcactggaaacaaaatttttgactgataattgttttgtttaaggaggccaaagataggacaccaatcccttctagcttgtaaggtttctgctgagaaatctgctgttaatctgttacagcaaaaggggatacagcaaaagcagtgctaagaggaaagttcatagtattaaatgcctacatcaaaagctctgaatgagcacaaagagacaatctaagaccacacctcaaagaactagagaaagaagaacaaaccaacccaaacccggcacaagaaaagaagtaaccaagatcagagctgaactaaatgaaattgaaacaaacaaagaaaaaaaatacaaaagataaatgaaacaaaaagctgtttccttgaaaagatagataaaattgatataccattagcgagattaaccaagaaaagaatagggaagatccaaataagctcaattagaaaagaaacgggagatattacaactgataccacagaaatacaagagttcattcaaggccactatgaataccgttatgcacacaaactagaaaacctagaggagatgaataaatttctggaaatatacaaccctcctagattaaaccaggaagaaatataaatgctgaacagaccagtaacaagcagtgagactgaaatggtaatttttaaattgccaacaaaaaaaaaaatccaggaccagttggattcacagctgaattctatcagacattcaaagaagaattggtaccattcctattgacactattcaaaaaagtagagaaagagggagtcctccctaagtcattctatgaagccagtatcaccctaataccaaaacgaggaaaggacataacaacaaaaaaagaaaactacagaccaatatccctgatgaacttagaagcaaaaatcctcaactagctaaccgaatccaacaccatatgaaaaagataatccaccatgatcaagtgtgttttataccagagatgcagggatggtttaacatacacatatcagtaaatgtggtaccccacataaacagaattaaaaacaaaaatcacatgatcatctcaatagatgaagaaaaagcagttgacaaaatccagcatccctttattattaaaaccctcagcaaaattggcattgaaggggcataccttaatgtaataaagccatctacgacaaacccacagccaacataataccaaacagggaaaagttgaaagcattccctctgagaactggaacaagacaaggatgcccactctcaccacttttagtcaacataatactggaagtcctagcaagagcaatcagaaataaagggcatccaaattggtatagaggaagtcaaactgtcactgtttgctgatgatatgattgtatacctagaaaaccttaacgactcctccagaaagctcctagaactaataaatgaattcagcaaagtttcaggatacaaaatcaatctacacaaatcagtagcttttctatacaccaacagtgaccaagctgagaatcaaatcaagaactcaacccattttacagtagctgcaaaaaataaaataaaatacttagaaatataactaatcaaggaggtgaaagacatctacaaggaaaactccaaaacactgctgaaagaaattatagactacacaaacaaatggaaacacatcccatgctcatggataggtagaatcaatatcgtgaaaatgaccatactgccaaaagcaatctataaattcaaggcaatttccatcaaaataccaccatcattattcacagaattagaaaaaacaatcctaaaattcatatgaaaccaaaaaaatgcaagactaagcgaaaagaacaaatctggaggcatcacattaccagacttcaaactatactgtaaggccatagtcaccaaaacggcatggtactggtataaaaataggcacatagaccaatggaacagaatggagatcccagaaataaagccaaatacttacagccactgatcttcgataaagcaaacaaaaacacaaagtggggaaagaacactctattccacaaatggtgctgggagaattggcaagccacatgtagaagaatgaaactggatcctcatctttcaccttatacagaaatcaactcaagatggatcaaagacttaaatccaagacctaaaaccataaaaattttagaagataacatcaaaaaaatccttctagatattagcttaggcaaagacttcatcaccaagaacccaaaagcaaatgcaatgaaaacaaagataaatagatgaaacttaaactgaaaagcttctgtacaggaaaagaaacaatcagcagagtaaacagacaacccacagagcgggagaaaatcttcacaatctgtacatccaacaaaggaccaatatccagaatctacaagaaactcaaagaaatcagcaaggaaaaaaaaaaatcccattaaaaagtgggctaaggacataaatagacaatgttcaaatgaagatatacaaatggccgacaaatacatgaaaaaatgctcaacatcactaatgatcagggaaatgaaaatcaaaaccaaatgtgataccaccttactcctgcaagaatggccttaatcaaaaaataaaaaataatagatgttggcctggatgtggggaaaagggaacatttttacactgctgatgggaatgtaaactagtacaaccactatggaaaacagtgtggagattctttaaagaactaaaagtagatctaccatttgatccagcagtcccactactgggtatctacccagaggaaaataagtcattatatgaaaaagacacttgcacatacatgttcatagcagcacaattcacaactgcaaaaatatggaacaagcccaaatgcccatcaatcaacaagtggataaagaaaatttggtatgtatacaccacggaatactactcagccataaaaaggaatgaaataatggcattcgcagcaacttggatggaatggtagaccattattctaagtgaagtaactcaggaatggaaaaccaaacatcatatgttctcactgataagtgggagctaagctatgacgacacaaaggcataagaatgatacagtggactatggggactccagggagagtggtaggggagtaaggaataaaaaactacacgttgggtacaatgtacacagctctggtgatgggtgcaacaaaatcttagaaatcaccacaaaagaacttatccatgtaatcaaacaccacctgttcctcaaaaactattgaaatgaaacataataatttttaaaagaagataacaacaaagctaagagttgggtttttttttgaaaagataaacaacatcaacaagcccctagctagattacctttttaaaaagagaagactcaaataaataaaatcagacatcaaagaggaaacattacaactgaagcaataaaatgaaaagattttaagggattattatgaacgattatatgccaaaaaacaggcaacaaaagcaataatagagaaatgagacggcatcatattaaaaagcttctgcatagcaaaacaatcaacaaagtgaacaggcaacttatggcatgggagaaagtatttgtaaattatagctgataaagaataaatatccaaaatctataaggacatcatccaatgcaatagcaaaaaaataaataaaaaataacctgatcaaaaaaatgggcaaaagacttgaatagacatttcttcaaaaaagacacacacggccagcaaatatacaaaagctccccttcactaatcatgagggaaatgcaaattaaagctacaataagatatcacctcacaccagttaaaatggctattataaagaaaaaaaaggatgagtgtttgcaaggatatggacaaaagggaacccttgtacactgttgatgggaatgttaattggtgcagccattatggaaaatagtgtggaagatcctcaaaagtagaaacagaactaccatatgatccaggattctagttatatacccaaaagagttgaaatcagggtctcaaagaggcatcagcattcccatgtttttgcagcattattcactgtggtaaggacatggaaacaacctaaatgtccaatgagagatgaatgataaataaaaggtgtatagacatagaatggaatgttattcagcccttaaaaaggaataaatccttccatttgctaaaatgtggattaagccgaaatgacattattctgagtgaaataaaccagactatatgatcccacttatatcaagaatataaaatagccaaagtcatagaagcagagagtagaatggtggttacctggggctgggaagggaatcaaggaggtgttggtcaaagggtacatttcagttatacaagctaagtcctggagatctactgtacagcataaaagccgtaattaacaatattctactgtgtacttaaaacttgttaagcgagtagattttttttttttttttttgagaaggagtttcgctcttgttgcccaggctggagtgcaatggcgcaatcttggctcaccgcgacttctgtctcccgagttcaagcgattctcctgcctcagcctcccaagtagctgggattacaggcatgtgccaccaccctggctaattttgtatttttagtagagatggggtttccccatgttggccaggctggtcttgaactccccacctcaggtgatccacccaccttggcctcccaaagtgctgggattacaggcgtgagccactgcacccggccgtgagtagatcttatgttaaatgtttgtatcaccaaaaaacagagaggaaggttttacaggtgatggttatgtttatggcactgtttatggtgatggtttcaatggacttatacttacctgaaaactcatcatgtatacattaattatgtataccttcttgtatataaatcatacttcaatttttaaaaaatgaattaggccaggcaaagtggctcacacctgtaatcccagcactttgggaggccaaggcgggtgatcacttgaggccaggagttcaagaccagcctggccaacatggcgaaaccccatctctactaaaaatacaaaaattagccaggtgtggttgcacgcacctgtaatcccagctactcaggagtctgaggcagagaatctcttgaacctgggaggcaaaggttgcagtgagccgaggtcacttgtccagcctgggcgacaagaggaagactgtataaaaaaaaaattaaaatgaaatgaaatgaaatctagaaggaaccgctgaaagggttgaatgtggcttcctctggggcagaacagggcatgaagaggaaactaaagggcagttggtggggcagggagtttctgcttttttaatataaacattttagaacttttgatggtttcattctgataaacattaaaaaggaacactacaacacaactgggaaaaaaacctgacaccaccacccttcccttgcttagtgagggtgtgatactgtggtgtcatctaatgtctgtgttgctgatagactgggagctctgtcacagggcagggaccacatctacttcatagactgctgtattcacaggtctgacaccttctaggcgccaatacgtatttgttgaatgaaaaaaatatataagaaacatttcacagtggtagaagcagcacccagaggacagatgtgacaaatgatacagagatagccttactacagtttgacatcaggcactggcatagagcaggaactcagaaaggtctggaaatttgctctttattaaaggaggttggtgatgagagagagaggttggtagtccaaggaggtagcgagatcaaggaagacattatcatggctgggatatcaggacattgtttgcagtaccaaaaataagcatctagtggagggagggatataagcgatgccagagagagacactgaagataatttctgcaaaatatggaaaattatgattttctgttgtggaatttcagatgttcttcctcctccccctccagagctagcagttctgccgtgttttgatgattgcttgggccgttacagtgccttgctaaccacactccctacctcccttctgaaagaacacatgttccctacaatgttcgatgtctctacttaatgtttggcatctatgtgccttgagaagctccaaatgattccagttaagcaaaacaggtcatgaatgttattcaggggaattcaaattgaattctctccagggtaacatcaccataaaaccaggtagactttagaaagtgggactgcatggaagcacatcacttaaaatcactgtagacgtgtgccaggaaatgtgttggaggaaaatgttctgaaggagattattggcctcctttatggattaatcactctgatatttgtgatttagaatcaggaagaaagcacattacctcattacaggaattcattctgggaggcattcacaatttgcctctttctccagggatgggcggagggacttgtaaccttgaaaacattcttgcatgtgagaagtacagaaaaatattatatatttctgcataaggagaagcagtagaaagtttttgtttgttctgtttgcttttttttaatctaacataaattgactatgccaaaaactacattatctgatgaccacgtctctaaggtaggctgtatggtttatagcactttaccaaaagggaaactgaggctcaatgaagttaaatagtatccaaggtgaactaacaaatttgtggatgagctcagagttgatcccaaatatacgtaggcaggaccagttaatcgttgatctcataactacgtaggcgggaccagttaaatttgtgatgcccagtgcaaaataaaaatgcagagccccttgttcaaaaatgatgtaagactttcaagatggtgacagcatatccttaaaccaagtgtgatccccttctgagcacaacaccctgtgtgactgcacaggatacaaatgcataagcctgccccatgtatagatacctcccagattctgtacatttgggctagctccactgaaaaaaaattgggacagctttgatgaatattaaactatgattataccttaaaatattgtcttgaaaaatactgtaaacccactgtatatcaaaaatggacttctacaatgatatttgtacctgagttagagatgatttcaatattatttcagattggctccttctatttgaaattgatgcattaattttttggctttaccatacactttactaaggagaccattttgagccctgtttccatctaagctgatgtcctttgtcctattcctgggacctacaggctgttcatcaggaatcttggcagacccccacacacactgtgagcccctcacagccacgcaatccccactgctgctcaccccacctgacacagagtgaagactcaagaaacattcattgaataaatgaatgagtgcatgaactctaggaaactgcagcagaatttcagattttcaaaaatggagcaagaagcagtctccatgcaatcaatactcaggcaatggtccaagggacctttagaatggttctaaaattagaccattaggtctcaagagagggccaggtctaaaatcagcatttgagccaaaagtcaaacctgtccttgaaaagtccttcaggagcttcaggttggaggtaccatgagaggctcacagaaacctactgggtgagaagctgatgcacatcccatatcttatcccaccctggggcacatgctcattgcctgccaagccatgcagtaaattccagtaggttaaatgcacatgtgatgtaactgtttcttaagaggtaagtcagtgccttctctgaaggaagtgtttattactttatgtctgcagcatttcttcccccttctcaggggaagttgtaaaattctgaactctgcgttttataagacacttagtcttgcgttaaaacttcacccaaagtgatttatcttgcatcttgcaacatttctgtatctcacacattttctataatgagcatgaattacttttatagtcagtgggaaaaaaactttacagggagattttatacttagatcatttttttgttctgagcaaaacattaaaagaaaagctttccagagccctgtccccatccatcaccatctagccttcagagcagtacaggagcttggcatccaggctgaacactaaactgctgaaatgtgtatctcagattctccacttacttaatctgtctaggcctcagtgtccttatctgtaaaatggtactaatacaataccttctccaaagagctgctcatataaagcctttagcacatgtgcattcagtgtggttagctaattagctcttattgcatatgagtctgtgtcttcagtgctaatagcctagatctcaagcaacctaattccttatctaaatgtgaatgatagagcaagtttttaaatcctctttaaagtaatctcaaaaatagaaaggtgacatagctagaagagtaaaggatgatatatcgacctcactgcgccctcaagggctccagtgaccaccccaactcatgacagaataggatgaaatttggccatgtagcaaaaagagctactgagcttgacaatgtcattttttcaactgactatatatcatttatacccagtcaacatccaaagtagattcgaatgttgtacataccacttggaatctgaaaatgctttcccttccactttattggtggcaaaccagttttctaataattctctatgaagaccctgtgctaatagatgctgtctacctttgaaccacttgtcccttggctttacaacatcacacttttctattttgcttccctgttactagcccatctttcttgatctcctttttaggctcatcatccttgaccttatcccttaaatcttaaccttttccaaggccctttcatgggcccacttccttcagaccctgtactcttcctgggtctcagtctgtcctgatagtttcaaccacaatcttcttttgccaatgaacttgatacctgtattgccaaatcagtcctttcttcaaagtccaaatccatagaactgactgccttcagaacatctccacttggatattttacaggtacctcaaactcaacatgtccagactgaactcatcatcccttcaaacaggctcccttacagcattccctctctcaggaaatggcagctgtttccaccctgctaatcaagccaggaatctgtgattaatccttaactcatctcagtttcctcattgcctaaatctaatcaatcaccatgttgtcttaactatatttgttaaatcagtgcctgtcaaatttcttttacaggtatacacacataactgaaatagaagtttcacaaaataattcttatcatcattatatgcaaggccctgtaatattttctcctctgttcacttctgttactgttttaaaatgctagtaacagtgagttactgacaaatgtttaacaaccagctaggtcttctggaggcaagggagggaatacctgatgtgtaacatttgcccatatccttggtgtgactattcccaccatggctgaattcaagctactgaccaaccagcttgcaaaccacctaaagatttaacaaccagctctcatgacaatctccagcacgccacactcatgactcaacagtttgatagacactggtctaagtgttcttaaatctttcagctaattttcattgccaatgctattgttcctctcctagccactaccatttctgatacaattggttcagctcaatctgatctatttcagatttatttattttcaaagactttatatttgcacactaggacggagtctacaattcttaccatggcttaaaaatcaacccatggtttggcacctgcctgctccttctgccctctcttccttgatcacaacaaaagtgttctcttcttgaacttctgggagcgttctcttgttctcagttctttagacatgcctttttttggctagaaagttctttcctcccatctttactcaatgaattcttatcctttctatcacagtttaaatgctactttattcattcattcattcttctagtgtgtgacaggcattctgataagtgctgaggatccaaggagaggtaaaaataaacagtccctcaccccaccgaacttacactgtagagggggagaaacatattatttaaataaagatattcaaatttaagtatgaataaaagagctttaaaaatgaatgagagccctagttctataagaacttataaaaatctgtcctaatctgatggatcaggggagactttcccggagtaagtgataattgatcagttgtaccagttgagctaatatagaaaagatacatataacctaattattctaagtggtggctaactaacagtacaggcagaaagaagaatatgtgaaaacccacattgcaggagggaacatgacaagatcaaggaaccaaatgaaagccagtgtgacaggaatgcaaagaggaacaggagcaagatatgggatggggccaaagagaccgatagaagccactctatgaagagcactctagactttgttgaaactttgggtctctaacaaaaaatcagtgggaggcctttgacatgttgaaagcagggatatggtgtgttcatacttctggtttggaaagatcactctggcagcagtgaggatgacatggaaggaggaaaaaatagatgtagagacaaattagaaactatcacagtcctctagacagaaatgcttctaacacaaattaagatgctggtgatgcacatgggaaaaatcaacatattagagagatgtaaggggtaaccttgataagacaagctaatggattggacaatcgctacactcttcctttccaacttgggcctggcagaatggttctcacaaagaaggatggcaagacaaaaagggccactctgccatcaacaaggtggtgacctcgttgatgatacaccatcaacattcacaagcgcgtccatggagtgggcttcaagaagtctgccccttgggcactcaaagagatctggaaatttgccacgaaggagatgggaactccagatttgcgcattgataccaggcccaacaaaactgtctgggccaaaggaataaggaatgtcccatactgtaaccatgtgtggttgtccagaaaatattctgaggatgaagattcaccaaataagctctatacttcagttacctatgtacctgttaccactttcaaaaatctgcagatagtcaatgtggatgagaactaactgctgattgtcaaatacatcaaataaagttataaaattgtaaaaaaaaaaaaaagataatggattaactaaatgtgatgaaagagagggaagtatcaaagatgacttgcaatgtttgagttacaaaactgaatgaatgatagtactatttgcagaaataagaaatactggaggtttggggagaaagaacatgattttgtctttagatatattgagtttgaggtatctttaagatgggcaaaatgagatgtcttaagaacagtttgataaactgcctagaatagaggagagatctgggttaggatataagtttgtaaaatacctgtgtataagtagtgaacatgatgccatagccatgaatgaactcatcaactgagaatgcataagagaaaacagtttggaaaccaagatttaagcaaatccaaaaattagtggtagggtagtgaagggtgcactgacaaagggaagaggaacagccaagtggtaggaggaaaaccaagagaaattgatgtcaaagaaaccagtatcttttggtcgaatagcaagaagagatgccagactgctgtgggtgaaagtgagtacaatgtacagatatggtgtcagtgaatctggaccacttattggagaagtttgcttttgaagaggagagacttgagtagtacttgtgaagtatttggaaacttttgattgtgctttaatgaaaggcatctgaacatattcatcagctatgaaaaacattggtttgaaagaaagttaaatacacaagagaaagaaagactaaaggcaagtgggaggtttaaaaaaagttggggaataatccctgtgtacccatggcacgcctacacttaccctttcttaattctgactacacttgtaattcttaattatctgtgtttctcattacactgtactccatgaggacaggagttagctctgcctcatttactttttttcatcgatgcattatagatgtacacagtttcaaggtatatgtgtaatttaattcattcatataagccatttactttgtatcatttgtgagtaacaaagcactcagataggaggcatgaataaatgttatttttttaattgtacataaacgtgaatgcaaacggaggtacatttaataaaatagaccatccaaaaatcttattatgctaatatgtgcatatatatgtatgcacacatatcatggttattgatttcttaagctaaaattaaaattggtaccatgaccataagcatatgttatttgatcactaagacaagaagaccttagaaggagagaaattaaaagtcagccaagaactaagcactctccagatagatgggcaaggccatgagtcatctttgtgcagagaattgagccctgataaaaatcaaggaaacaaatggtgaaagcacaacttgttaagacaagtggatgcatcattcacactgatccaggtgaaaccccaaataacaggatttctttatctgagatggtttgatgacctaacaagttaagaaaaccaaaccaaaacaaacaagaaacgctcaattccattttggagacaatattgaatgcctcatttagggaagcaagtccatgcagcaaaaaagaaatcagatgtgcacttctttcccagctttgccagttttatgataagttctttagtctgatctcagtttctttacctgtttaaagagaataatcatacctaatagggtggttgtacaaagtaaaggagattacatctcatgtttataagcaccacactcagaagagctgtctgcttctctgcctcgtaggttgcaaacctgagaatttcacattacattagcagctctgacatagtctcatttataccctataagctctgattcatacaatagtacgatgagaatgccatgctatatctagaattgctgagaagactagatgacattgtgtgctgaaggaactttgtgaaatacaaagaactacttaaacaagtagtcagcagatgacagccggtgtgccaaatccagcccaccacctggatttttgtttgtttgtttgttttatgactcaaaagctaagaatggttttcacatttttaaatagttgaaaaaatcaaaagatgaatatttcatgatgtgaaaattacatctaattcaaatttcagtgtctataaataaagttttattggaacacatccacactcgtttacatattgtctatggctgcttttgcactacaatggcggagttgagtaggtgtgatcgagaccatatgggaatatttactatctggttctttacagaaaaggtttccctactcctgacttaaattaaatatagtgacaaaaagcataaagattttggaggttttttttgagattaaaaaaaattcataagttattggcgaagtgcctgccatatagtaatggctcaataaacagatgttgctgtttatattccttcattagattattaattcaacaaatagttattgagtgcatactctgccagatactgctccaagaaccacagaatacagcaatgaacataattggacaaaattcctttgctcattgaatagacaataaacagacaaataaaaataagtagagtatattatttggctgggagaaaaaataaaggatgaaagaatagagagtttgagggtagaggttgcaatttttagatacagtggccagggaagacatcactggaaaggtgacatttgagtgaaaacccgaaggacacaagggagcccaaggggatgctgtgggggtggtgaggagtattgttctgggcaggggaataatacaaaagcctggaggcagagagagcttagagtgttcgaggaacaccaaggagttgatgggctggagtggcggggaacgatggggagaataacaggagattaaatcagaaaagtgcggggtagggccttgaagaaccatctagggactctggcttgtactctgagtgggagaggaagcaagttttgagcagaatagtggcatggcctgactcacatttaatccagatccatccgactgctccagtgcaaacaccctgtagcacagactgattaaaattttataagttgatttgcaacatcaattacagcttaatggtgttaaattgggggaatattgcatattctctccatggaaattaataaaccatttgatgggtacacagcaccttccttacattatttaagacaatgtcagaatgatgaaactgcttctaatttatggacaaacaatatgatatctcagaatcccacagggtagttctaaccatttaatttctgcggattctcacaactgcttcagcttttctaacagaatctttggactaacatggcctctttttttgatacaaatatttttgtttggacagtgattgagactgacctggacagacctagagaatgcctctttgctgtaagattgttcctcaatctttctttcattactacttccctctaccaaggaacctttgtagacctgttttttttttcctaatttccaccacaggaacattttttattgtgctaaaatatacataacataatatttgtcattttagctatttgcaagtatactatttaatgtccttaaatgtatttacaacattgtgtaaccatcaccagtatctatacccaaaattttctcatcatccccccacataaactctgttcccgttaaacaataactccctattctccactcccccgagtccctggtaactgatagataccatgctttctgtctctgtgaaattgcctattctaggtacctcatataagtggaatcatatacaatatgtgacctgtgtctggcttattttgcttagcataatgttttcaaggtccatccatgttgtagcatgtatcaacattttactcctctttatggctgagtaatattccattgcatgcatatgccacatttgattgtttgttcacctactgatgtgtttctatatacatatatgtacatctgtgtgtgtgtatatatgtgtgtgtgtatatgtgtgtgtgtgtgtatctgtgctttctacataaaaagtgcaaaattgttttaccaccaaccccagaatgaattttcgcctgcaagaagaggggggatctcaccctcattgataacgcaggttctcaggtatagatccccaggtttcctgccaaaaatgaggtacatgtgtaggtaatgtttattattattattattattattattattattattattattttgagaccaagtctcactttgtcacccaggctggagtgcagtggtgtgatctcagctcactgcaacctctgcctcccagggtcaagtgatgcttgtgcctcagcctcccgagtagctgggattacaggcgcgcaccaccacgcccagctaatttttgtatttttaatagagatggggtttcgccatgttggccaggctggtcttgaactcctgacctcaggtgacccaccctcctcagcctccgaaagtgctgagattacagatgtgagccactgcaccctgtcagtaatatttatatgtagataaaccacttagagtgaagccaaggataaggaaaatgacctcagaacacataagtatgaaaagtcatctttattcccaatgcaatagagttatctgtattttatttagtcttcacaattgccaacagtttataaaggaatgaactcaagaatgtttggaaaacagctgtaagcagtcatgtcaggaccaagccaatggagccgatattctaactaaacttttgaaagcagtggcaattcatgatgttactattcccactgagtcaaaaatatttctggaacacaaagagaatgattaagtaagaatgtaaaataggaaaaaaaatgaaatcaatgtcacatctgaagatcagaggagtgggaagctggtacctgctagggtatgcatggttgtgtcagcatatggcatgagtgttggtgtctagttggaaggccatatggcaaggtatctggcacagactcacctaggtcttattctcctgtggttgcccaatgccatattgtctcattctgtaaagaagagatttaaaagattgttgaacagtgttaataaagtcagccatttcaaatacatgaccagattgtttaacagtgttaataaagtcagccatttcaaatacccttcaaatatcatcaaagacaagtagagactgagaaactgccagagtatgagactgcggagatgtgaagactgaagaccacatggggtcctggattggatcctggaacagagaaaggacattcacaggaatactgggaaattctgaataaagcctataatttagtactgtcatatcaatgttaattttttaattttagtcaattgtcccaggattatacaagatgttaacatgaggggaagctgagtgtgttgtgcttcttctgtgagtctaaaattatttcagaataaaaagtaaatgaaaataaacagcaaccaagtttccagtagctcctgagtatcagaagcgaacttgagactggcaaatgctgaagcatggggagagtgagggagtgtatatttgcatcatagcagctttgatgcctgccataagagtgactcctgtccttgtctcctttccgattcttttgcagggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtaagtattgtctgagggaacataaaacaagagaattactgccggcaacagtctatgcagagactgagggaaaattccactgtagcctcttcttttagccttcacacaggatctcctataaagagctccatttttaaaactacaatatgaatttaagagctgctgacagttacctgaaagttttactagtcacttggtcttgttagctagtaaaacctccaaatctaaagaggaaagaggcatgtctataaaattttatagggaaaaatgtagtgttagcaaaaaatatatattagggaaatttgtcctcattaacaacacaatgctgccttagttagctaaagggacctcaaattaaatagatacattattaaatgtaaccaatctcctttaaagtcacccagatctccactttctatgtgggtgcagtcacctgggagaggtcttactaccattctgctagagctctatctaagcagtgtgtgatgctccggccaccttgactcaccagtggctgtcacggaaagtctgaaagtggcaaagagctacaagcagtaaaagataatatttcgtggctggaaaaactcttttaacctgtgatttgatttctcttttgtttccatttatggcagagcctccatcttggcaaggcacgtaatcttatccaagctgtgcaaaacctgtccaaagtgtatgtacaataacataaaaattgaaaggtggaaaaagcgccagcacagacatgtagtgattgagtcctgcatgaaaatacatccaaaggcaagatggtttggagattttaggaagccctggctctttcctctgacacaatcacagcattctagacatccccagtaaatggactctgtgacacagacattgagcaccctgctttgtgccagacaccctgccaggagctcaatggaatcagacaaataacgcacagtgagtgcatggttactgtgcatggttactgaatcagacttttgtgtgtgtggatcctctaagattgtatgtgtcagggtattagccaatgttaaatggcgcagaggaatttgagggtttcttttctcatcagcttttgattttaatcaatgttctattagaaaaagtatcaacatttttaattctgttcaggccacagcttggggaacaagacactaatcttttaataatgttccacctgttcaatggaaatagtgatctttctccattaatttacagaagtatttagttacttgacaaaaatattttgagaacaaaatataaacctttctcagcttcttggaagaaaaactgtatttaaacttaaacgaatgtgtccaatatatgttattcaggaagtacttaagtacctgcttacacttgacttgattgatttgacagtcatttggccacagttctactacttctatgagaggatgacctgaaaaccactagagagaaatatccactctacattaatagaatactgctttttagcagctttgaatgaggagttaaaaatgaataatgaaattaaggttttttgaatgatttgtttaatttatgccattcttttaagtaacataagattgactaactttttttaaaaattcattttagatatgaaaattaagtttatgtacctaggaccatctagttagttccacaaagacagatgttttgtgccaagtaagtatcatcctcatttacaagaggggtcacaaactgctggcctcccccaacttctacctatcaagttctgttaggcctacatcgtggaatttttgtttttgaatcagtattttaaaattgggtgattttggctgggcgcagtggctcatgcctgtaatcccggcactttgggagactgaggcaggtggatcacgaggtcaagagatggagaccatcctggccaacatggtgaaatcccatctctactaaaaatacaaaaattagccaggcatggtggcgtgtgcctgtagtcccaggtactcgggaggctgaggcaggagaactgcttgaacccaggaggcagaggttgcagtgagctgagatcatgccactgcaccccagcctggcaacagaacaagactccatctcaaaaaaaaaaaaaaaaaaaataggagatttcacatgaaggccagattttcagcttcttaggaaatattttaagatctggaacacagagcccactgttctattctggtgacaatggtttagaatagagtatcagttatcccttggctgggcacggtggcttacacctgtaatctcagaactttgggaggctaaggtgggcagatcacttgagcccaggagttcaagaccagtctggccaacattgcaaaactccatctctactaaacatacaaaaatgagccgggcgtacatgcctgtaatctcagctacttgggaggctaaggcacgagaatcgcttcaacctggaggcagaggttgcagtgagccaagatcgtgccaccacactccatcctgagccacagagtgaaactctcagaaaaaaaaaaaaaaaacagaaagaaaagaaaaaagaattgagtatcagttatccactttagatgactaactttccctcgttctcacctggccactttactcagtcacattagctgcctgattctgttagctgttgagtcaaaaactactcactaaaagcagtgtgttaggatgaattgaggacatgggagtacagtactacaatcctgagtatttcacatcagttactatacaatcccccaagaagaaggaagattgcattggagccaccctcctttttccataatggtttttaatagctcaactctgtctacttgggtaacttatgttagctacaacttcaagataaaaatcacattattgcagaatcttactgctgaaagagagattggaaatcatcgaaaccgaccctttcctttcaccaaaagtaactgaggccccaaaatcttaagtgaccctccagaacaggtgatggcagagccagtgccttctaactgatgttcagtccagtctccaaatttcccctttgtataagaataccagttgtatttgattagggcccaccctgatgacctcatttgtaaatacttatctccaagtaaagtcacattctgactttaaaaccacatcctgggggttaggatttcagcatatgaatttggaagtgggggacagagttcagctcataatacttcactctctccccaccagaatacatgtccttcacccaatgaaaatattccatcccaacaaccccaaacgtctttcagacatcaactctcaagtccaaaatctcatcttaaatatcataaaattgggtatgcgtgacactcagggtatgagtcatcctgaagcaaaattgttctctagctgtgtgtgaacctgggaaaccagacaaaaagttatctgcttccaaaacagaatggtgggacaggcatagaatatacattcccattctgtaagggagaagttgcagggggaaaaaaaaagaaagaatcatggttcccaagcaagtctgaagctagcgggggaaattccattccattttaaggcttgaaaataatcctctttggctagatgttctgtcctcagggctcacaggggaggggatgcatagccctgccttccaggcacagggtcacaggagccccacccccacagccctgggcaatagttctaccctctacaaccaaggaggagccagtcgctgaaccatctttgaagccattggtccttcatttcatcctgtctctgtccctttcagtccatgctgtcaatgtttctgctggtataaaattctcaaaaaccttattggcctcccatgcaagtcatgggggtccaagcagtcagacaagagggcactccgcggatctttttcagataaccacctctctatttctggcatctactgtggaggttgattggatccgtgagtcacgtacctaatttcgttagcacatggctgtccagccacacccttggcattctctcccaatctgaggtactgagagttaagcacttcgatgtagcagtttggcggggtggagcgcggggggggacacaattcacagctgaaatatttctttacttaagctaagactttatcccaattttggtatatctgaccagtcttactaaagctacattttgtaagaccagaaatgagtcttttcaaaaccaaaaggttggtgtgaggacagagaaagtaggcaagcggggagacaggagacgtctatgtgtgcagaaacctgcacctcttctcctccagctacccgtgcaggtcatttccccccaggcccatccaggtctagcgatgtcccagcactgccccctggtggagccctccaccggcctgcaggaagggcatgtgactgactccctcagcgccctgcagtcttgtcccctctggtcccaaaagtgtatcctgccttcgctttgcgataggtttcttcctgccctttgcctggaaattttatctctggttcttgcaaacattatttacagctgtctaattttttctgtctacctcacagctgccaaactaaagtaggtgggaagccattttccctctctaggtcaatgaataccccccgttctccacccgcgcttttgaagattccagcactgctgccaagtcaacccatctgcaggagaacgctttggaaaaaacagactttaaaaagaaaagcaaactgctcttagcccctgatagcttctccacaggagagggaatatggacagagctgaggttcaagacacatgtgctgtttgagctgaatctgtgctgttttcttctttccgtggttacccaacaacgaaggcgtgttgtaccttcttgccttcaaacctgttcctcctcccgtcagatgtccttactcctcaatttgaagttttccttcataggatttctgagaaggactttggaaaaagtgctccagatctctgccagttccttagccatgaaaaccaaacataaaagatcatctggggacattcattcagagcacgttacccacattccaccaccactactctgacagcacaaaacatataccaggagctggggttatgtggtgggggagtccttcctattgtaagccctaacattatgaccctctggggttaaattttataattttcatattgtggagtcccatattttgttctgctttccactagtccaggcttctgaggtcttctctgtgttcattgcttattaattttattcagcaaagattaattgagctcctgcaatgagacacacacactatgttaggtgctggggaacaaaatagggaagggccctaccctcagaaagcttgcaatttatgaaagaatactaacaaaacctgcaaagtggtattttaagttattttgtttcatttttgctattgaaacaaagaaactgagaatttggtatgattcaaaaaatgtttaggtacaagaaaaagaaaaaagcaagaagcacttgccagatttaactataattcctaaaaatgatgaacattttcatcttcaggaacatgaaacatcatcgactattctctacagacaacaggcaaaggttcttactggtccagtacatacaagtccttcaggaagaaaaacatgattctaccaggattgggttgaatagagagagaattgcagtttaagattcatgagtatggaaataaacagctcttatggctaataaactctctatgaactttaaaaagaaaacaagaaaaaaaaaagcatggctttttaaaatccaaagtccttgccttaggaagagacaggactaaagtaaaaataaatgaagtctgtttgaaactcatgagttgcacacctcatgttgccagaagctggtttaaaaagcagtctagctgggatttccatgcaaactcagcaagtcatgaatcaacttgaagccttgtctcccagaggccataggagctgggtgtgtcccagagatgctgtgtcctgattctgtggaaagggtggggaagagaggtcactgaggatgtttctggagaaagttgtgcatggctttccttcttagctaggagggaatagggggtgtgtcaggagggtgaatgggagaagtgagggcagatgagtggatgtgtgagtagtgttagcaagccagattaaacaaactgcttgtggtttaatctgatgctcaaataaaacactttgcctgtatttctaggtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaa

SEQ ID NO: 786 - DNA, 86751 bp, Homo sapiens
gttggggagctcccgccccttccgcctcggcgccccgcccaggcctcgcccctaggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaaggtaagtcggcgacgcgcggcgcccgagcccttgcgtcggcgcccgggttcgtaccccggccaggtccgcggcgctcgaggtgggctgctggatcgcggcggggcggacgcctgggccgtttgtccacccgctgggcctctgggccggggagcggaaggtgaccctctgcgcgccccccgccgtttcccgcccgcgccgccgaggggggcggggaccctgccgggcaggggccggggccggggtcggggcctcggggctactgcaggccggcgtggcctcccttgtccccgccgtcgcgcgctggcccagaaaagggggcctctgtcgctgccgtccgggggcgttttccgcacccttcccccactgggttttgtctttctttacgtccttctgcctattgctcgccaggccctaccccctcgcgacagaacttctttgttgactttgaaacttcgcgaaaaataccccgccagatgacggccgagtggagtgagctgacccctgttgaaaagcctggtcctcggcttgcctgccgctcgagaatctgtttactaaacggggaggctcttttgttgcgatccatttggttttaaatccttgacacctataagcagggttctgtttgttttgttttgcgattgcttgtgttttggatacggttacattgaacaaactgacccttgtaaaatgaatacttaagatataaacgtccacaccttatgtctcttcaaacgcattttcttacccactgaaggtagtagattatttttaaccagctgtgtttttaaatgagtggtgagtttatagaggaaattactaaattttgctttttttgatgttccggttatcgtgcaaatgcttttctactttaggtatatttatgggggtatgagcgtctttcaaccttatgggttgcgattttggcgattttaaacgaaaatgaattatcaaacgccgtcatggagtgcaataatgagtgaaaaaagtttgatattatctatgtaatgagttgataacgacttatttttttttaaagaagtcttgcctttaataaatacctcaactataacatgtggcacttgatgtacattcgcgttccatcttcgtaaaaagcctgtggaataggtaggtattatcttttatagatgtggaaatgtaggcttcgttattttaatagcttgtcgaagctttacacaggtagtaagaggcagatttgaacctaggcattctgattgcaagtaatttccctttcattatgccacagtgtgtttattatatacactgagtgtagctaatcgccactggagacgcctttggaaaaaatagtaaagcgaaactgctgaaggttgcgaactatttctttttgacaggtggtccttgcgtgtaaatttccatctacataggtttcacatccttttagattcaggttttaatgagtaaatctagtaaggcatgtatttatcacaggataggtacggacgtattacattcaattctcattcttttggcctgggcattgctacttgcatacttttatggtgtgacagtaatctgtggtaattcaggaattgcgctcgaagcacgtatggaatcatgaaatattttcactgtacttctagtgcttaaatatattttttctcttgtaaaattataatcaggataaggtatacataacatttatttattgaacactgttgcctgttaaaataacatgtgctgaagactcaacgtgtagtatgtgctttactaaacactttatatacatttcatttaattctctcacatcgttaggtagtcggcattttcattttacagatgaggaaactgatggttagtatgattaagtaacttgtccaggataatacaggtagtaaatggcagaggcaagattcagactcatgtctgtcagagtcgcacttaaattagattatttatttatgagtgtatactacaagtccaatgttgaaatttatttttgtcactccctctataggatgaatcatttatataatttggtggaaactttattttgctttattttgttttatgaaattattagtcatgaaatgcaagtgaattttagtgccgtattctcatgcctgcttttgcaaaattccagtttggaagtcttctgacatttttacaattaaatttaagttgaaataacacttaaaggaaaagggagggttatagaggattaaaaatgatatagcaaagatgccaaaaaactaataaaaaatgttctatttgtgaaatcagttattataggttatttctttaaaaaatgcgacttaggttttttaaatctgcttagaaattttttggtaggagatattcaaagtatggccaaacataaaactaaattaaaaaaaaatcagtatcacctacttttgaaaacacttatactgttgtggttctgttttttatttattttattttattttattttattttattttattttattttattttattttattttattttattttccgagatggagtcttgccctgttgcccaggctgaagtgcagtggcatgatctctgctcactgcaacctccacctcccaggttcaagcgattctcctgtctcagcctcctgagtagctgggattacaggagcgcgccacctccctctgctaatttttgtgtttttagtagagatggggtttcgccatgttggccagactggtctcaaactcctgacctcaggtgatctgtccgcctcaacctcccaaaatgctgggattacgagcgtgagctaccgttcctggccggttctctgtcctttaaaaatatattttaatattctgagcaaagagattaagaatgttacaaacacatcaaccgtgcgtatagtaagtcttcccttccttttaaaaatagcacattgcttgcctctgatggtaccatatatgatagtctgatgctcagaatgttatgcatttgtagtaatacttagttccgacatggctgtttcatactaattgtttgctagattttaaagatctctaaagtttcttcagtattaaattaatttttgtaaaatcaacaggtttataatccattctcataatacagggatggataaatcattcttactgtgtatatgttatttgtatgagtgcagatgtgttatgtcaactgctatccatcctgacatttttaaacttcagagctataggagaccttagacatttgccctcctcattttatgggttaggagtccgatcctgtaatgcactgagatttctcagtttcagagaaaagtctatcctttggtcaaggatatacttttttttttttttttttaaaggaaaagcagtacaatattggaatagatgttgcaagtgttgatgtgcagttctcaaagataatattaaacattttgtcatagaatgcccacatttcggctcagtgatataaagctgaggtttttttttttttcttttccattttgctaaattactgcttgtattagcacaacataatacaaagtcttagtaattttattacagaataccaaagcagctgttctttatgctttacggaacatattcattcgaaaagtgtgaagctaaagagtattatggttgatcatgttctatatcactatggcaaaaatttgaggtaacttaaatttggaagaaatgagttaaaaggatagaaagttgtcagaatcagacagctagttcctctctttctagacccacacagtcttctttgtttccagagatgtctgctgcatgtttcttaccacgcattacctttcactgttttggcatgcttgtgaccaagtgtacatgcatttattcgttaaatgtttactgaggacctgttatgagccaggcactattctatgcatttgggctaggcaaggaacaatatagagaaaatcctttctttcatagagcttacattatagttattagcttaagacaaaataaacatgtaaattatatggcataactagaaggttataaacgctgtggagaacagtgaattgggagggaataagaagtgccaggatatgagggcatgggttgctttttttttttttttttttgagacggagtcttgctctgtcacccaggctggagtgcagtggcgcgatcttggctcactaggggtcgcagttttaaatatagcagtaaaggaaggcctcactgagaaggagcaaaggagaaggagttagccatgcagatactctgggcagagcattccaggcagagggaacatagcctatgtgaagtgtctaagatgggagcatgcctagagtgttcaataaatcaccaggagagcagtgtagctgtaacggagtaaaagagttggagaagagtaagtataatatgaggtcagaaagatatggagccaatggggagagagcatgtaggacttcattgacttttatagtgagatagggagctatgggagggttttgagctgacgtgagacataaattgtcttgatatgcagccagctttctgtatttgtgggtttcgcatctgtggattcatccaatgtcagatggaaaatacttggaaaaaaatagatgattacctctgtactgaacatgtacagcctttttttcttgtcattattcctcaaacaatacagtatgatgactacataacatttatgttataattattctaagtaatctagagataatttaaagtacagttgactcttgaacaacatgggtttttgaactacatgggtccacttacacatggatttttttcttcaataaatatattgaaaaaaattttggagatttgcagcaatttgaaaaaacttgcagatgaactgtgtagtctagaaatagtgagaaagttaaaaagttatgtcattaatgcataaaatatatgtagatactagtcttttactcactatcataaaatatatacaaatctgtcatgaaatgttaaaatttatcaaaacttacacacacaaacatgtaatggagactgtacatggcaccattcacagttgagagatgtaaagaaacttaaagatacagtattaaatcataactgcatgaaattaaccgtagtgcatactgtgctactgtaataattttgtggccaccttccgttgctgttgttgtgagctcaagtgttgctgttgttggagctcatctctccagtaaattgtatatggtaaaaagtatctctctggattctcttgtatttttcattgcatttagtgcagtaccctaaactttgaataacatgatgggatccatatgaggtgccactaagtgatgctggaagtgctccaggaagctgaaaaaaggcatgacattatgaagaaaaagtcgaattgcttcatatgtgccatagattgaggtttgtagctgtggttgctggccatttcagaatgatttatcttgtaaacagacaggtatcaataaatatggtacagtgctgtaaatgtaatttccttctgattttcttaatttttttctctagctttattgtaaaaataaagtatataatatagaatacagtatataatattacaatacatattgtaagaatgcagcatataatacagtacgcaatacatataatacagtttatgcattcatggcataattttattttttttgctccttctaagctacacagttcatctttttttaaattgttgtgaatttccaaaaaattctccaatatatttattgaagaaagaaatccgcgtataagtggacccatgtagttcaaactgtgatgttcacagatctgtactttaaataatctcctgagtactcataatacctagtataatgtaatacaaaggctgggtgcggtggctcacgcctgtaatcccagcactttcggaggcggtggcaggcagatcacctgaggtcaggagttcgagaccagcctggacaacatggcgaaaccctgtctctactaaaaatagaaaaaattagctggatgtggtggcgggtgcctgtaatcccagctccttgggaggctgagacaggagaatggcgtgaacgtgggaggcggagcttgcagtcagccgagatcgcgccactgcactccagcctgggcaacagagcaagactccgtctcaaaaaaaaagtagtacaatatgtgtattaatctactgtttatgttgtattatgttatgggaaggcttctggtcaccagtaggctgttagtagttttccattagtagtttttcgggagtcaaaagttgtatgtgtgtgtgttttttttttttttttttttttgagacagagttttgctctttttgcccaggctagagtacagtggcaccatctcagctcattgcaacctccgcctcccaggttcaagcgattctcctgcctcagcctcccgagtagctgggattacaggcatgcaccaccatgcctggctaattttgtatttttcgtagagatggggtttcatcatattggcttgaactcctgacctcaggtgatccatctgcctcagcctcccaaagtgctgggattataggcgtgagccaccgcgcccggctgtatgtggatttttgattgtgcaggaggtcggtgcccctaactcttgttcaggggactcctgtatatggaaggatgtgcataggttacttggaaatactatgctgttttacataagggacttgagcatctgtggattttggcacctgtggacttcctgaaaccaatcccccagggttactgagtctatctctttcctggttaagacaagtttttgtttgtcttaaattcaaatttctggaagctacaatctcactggctcatcttgggtcagttgcttatccttttgatccaggtagctgggtggtggtgggaaaggtaatggaagaataagaatcatgactggctgtgtccattcttgagctggtaagacagtgcaaaagagatctgctatattgctcaattagaatactttttagactgaagccctgtgagtgattattgctgggctatcctcttccagatgcctacttcccatttcttccaggccaggcttactttagtgggttttacttctgtcctgtaagactatgaagatcacttatttttagtataatacagttagaacagaaagagttcttgaaaagtgaataggaagtaagaaccccccaagggaaaacttaataattcagactatattttagaatgctgttgcagtaggctagatgagatataggagttacattaaggtagagggaatggaaagaatggaaaagaagaaatagaccaaggtagaattaatagaacatagtaattgaagaggtaatataaggaggaggagttaaaaatgattgatttttatattatttcaaatgggaatggaaagagataagtagttcagttttagatattgttttagtttgcaggggctgctgtaacaaagtactacagattgggtgcttaagagaaatttgttttctcaactctggaggctagaagtttgagatgaaggtgttggtaggcctggtttcttctgaggtctctctccttggcttgtagatgattgtcttctgtgtcttcatgtagtcttctctctgtatgtcttcatgtagttgtccctctatgtcctaatctcttctttttttaaagacgctagtcatattggattagggcctactctaaggacctcattttaacttaattacctctttaaagatcctgtctccaaatatagttacattgtgtatacatgcaggttagggcttcaacacgtgaattacggggggaggggcagtgcaattcagcccatgatagacatgaattcttgaaggcttggaagactgaagcattccctgtacacttattttttataacttaacttcattataatatctttttttttttgagacggagtttagctcttgttgcctaggctgcagtgcaatggcgcgatctcggctcatggcaacctccgcctcctggattcaagggattctcctgcctcagcctcccgagtagctgggattacaggcatgcaccaccacacctggctaattttgtatttttagtagagatggggtttctccatgttggtcaggctggtcttgaactcctgacctcaggtgatccgcccacctcggcctcccaaagtgctgggattacaggtgtgagccactgtgcctggctgtaatacactttttactttcctgtctctctccttcccttctgtcacctcttaatgtattctgtaaagatggaatcaggttaataaagtataatttacacacaaatttaccctgtttagggtgcagttctgttataacacttttgaaatagaatattggagattccatgtcttttttgattacttccccatttaccaaatattgggtacatgtctactacgtatctaggacctgtgcaacaatgttttctgcatgtttcatttcttcattccaagtccttgaaaagtgccaagaggcatttctattgaatggaacagtttgaagagcattgatgtagctagagtagtggttttcaaagctttgtcccaagacccctttacattcttaaaattgaggacccaaaggacttttgtttatgtgggttttatatgtaaagatagatatttaccatattagaaatgaagaatgaatacaaattatttagaatatttaaaagtaacaataaactcaatatatgttaataaaaataacgttatctggattattataagacaattggattctcatctctccctttgcagtcactttgttaagtgttttggttagtgtatataaaaactcggcatcacacagatttatagcttgaaaagggatgaatattttcagatgtttgtatgttctttgatactatgtcaaaacttgacaagtggtagtttcttaacgtatctgaaaacatggcagtcaccttaaaaaattaaattaactgttaaattaaaatccatttgtctggtagtgtaggatagagtccagaaatagatccacacatacatggacagttgatttttggacagaagtgcaaaagcaattgcataaaatataaaggatatcgtttttcaacaaatggcactggaatagttgaatagctgtaggaaaaaaaaaagaactttgagctatagcttgtaccatataccaaaattaactcaaagggctgttagacctcaatgaaaaacctaaaactatgaaacttctaggggaaaatataggagaaattcttcggaatcttgggttagaccaagatctcttaggtatgactccaaaagcatgatccataaaagaagtggataaatcagatggcatcaaaattcagaatttctttcaaaattagaaagacacttaacagaatgaagacaggatacagaagatgtatcttataaggggcttggagtatataaaaaattctcagaactcagtaataagaaaacaataactcagtttttaaaatggtccaaagatttgtatagacacttcactaaaaaatacatgtacatggctattaagcatatgcaaatatgctaagcatcattagtcaaaaccataatgagacaccacttcacacctgctaggatggctataatcagaaagaacaggtaagtgttggtgagcattgtagaaaaattggaaccttcatttgttacgctaggaatgtaagatagtgtgactgattttggtaattcctcaaaaagataagctgagtaaccatatgacccagaaatttcatatacccaagagaattcaaaaaatatattcacacaaaaacctgtatatgagttagcagtattatttataatagccaaatagaaacaacccagtgtccatcaactgatgagtagataaatgtgatctatttgtaaaatagaatattacccagcagttcaaaggaattaagtactgatgcatggtacaacttggataaatctcataaacattaggataagtgaaataagccagtcacaaaagaacatattttctatgatcctatttgtgtgaaatgtccagaataggcaaatctatatatagagaaattagtggttgtctggaactggggagagcagatggagtaggaagtatccactaatagttacagggtttccttttgggatgatgataatgttctaaaagattatggtgatggttgcgtaactgtaaatatacttaaaacaattgaagtctttaaattggtgaactttatgacatatatctgaataaaattgttaattaaaactactgtgagatatcattacatacctattagtgtggctaaaatggtaatagaatgactgaccgtaccaagtgtttgtaaggaggtagagcagttggaattttcatatactgctggtgggagtgtaaagtggtacaccacttcttctggggagcagaaagcaaccttccgggtacaggtgagccaaggttgatgggcagttatgcagagggagttgggatatcactgtgtgtacctgtgcaagtcctggagtgtgttgggtcctcatcagcagggctgtatgaaggtgttcattaaaacaaaactactgatagtgtggcaggagctagaaaacacccctttcttcttagatatccctccagcaccctctactggcaaagtttaactgcccctagccaaaagaaaagaaaagaaaagcttagcatccctatcactgaacagggactgaaagggagaatttggagttgagaaggggatacatggataactagctcattactgctgaaattgttggaatcattcattgcctgtgctgctgaagcttgatgttgcccacagctgttgggcagaatctccaccatgacttgcgtatctgttagcaggagtctgcagtacctgccattagctgcaactgctggtttttagaaacaagtagaaaatggtttcgctgtttctctgcttcttctttatttttatttttgagatggagtttcgctcttgtcgcccaggctggagtgcaatggtgcgatcttggctgactgcaacctctgccacccaggttcaagcgattctcctgcctcagcctcctgagtagctgggattacaagcacatgccaccacgcccggctaattttgtatttttagtagagacggggtttcaccatgttggccaagctggtcttgaactcctgacctcagttgatctacccacctcagcctcccaaagtgctgagattacaggtgtgagccactgcacccagcctccctgcttcttctgatctcacagaagtgcttctcattgacagactctaacttaagcctagttggcaaggaggccagaaagtgcagttttcaggcttccaggagcaacagtacaggtgaatttttaatttagtaacgatagtaatctggtgagctaaaataagtaaactttggggtacatagagaattggaattattattattattattatttttgagacagagtttcgctcttgttgcccaggctggagtacaatggcacgatcttggctcaccgcaacctccgcctcccgggttcaagcgattctcctgcctcagcctcccgagtagctgggattacaggcatatgccaccacacctggctaattttgtatttttagtagaggtggggtttctccatgttggtcaggttggtcatgaactgccgacctcaggtgatccgcccacctcagcctcctgggattacaggcgtgagccactgcacctggccgagaattggaatttttaaactgtgtttgcaaggcctaattcccaaacccacatagtttgtgtatgggtatacgctcaccctcaaaaaggaaatattttttgtaaaatttgagcagttaaacatttttttctgcctgtaattgtaaaagtagcaattaaacactatctacttggggacgagaaaggaagaaaaattacccatgttctcgtctgaccaattacagtggctgtcttttttttgcattttcttctttaggctatggtgtttttacctagttggaagtaagggagtgtggtcatttaaaaatgttatatctctttccatattagcaaatagttatatatacatatatatactttttttttgttttttggtctgttgcccaggctggaatgcagtcacgcaatttcggttcactgcaacctccgcctcctgggttgaaatgattcttgtacctcagcctcctgagtagctgggattataggcgtgtgctgccatacctggctagtttttgtatttttagtagagatgggtttcgccatgttggccaggctggtttcgaacttctggactcaagtgatccatcttgccaaagtgctgggattacaggcatgagccactgcgcccagccttgtatttgctatttttaagggactgtatacattccatatagtgaatgtgcaccatttatatagccgcttccctattttgggctatataggttatctgcagacattttgagtaatatttttaatatattttcaaaattgtctactataattgtagctactaattgtaaaaattttattgataattacatattaaacattccttgtttacttcagccagatgaacaaggtcaacattaacagttacatgtggcatagtgccacggttattacttgagactgtcactatgacagttactgctgttactacttgagaccgtcattatgagactgagtgaagggggacaaatgtagaaatgaaaaattaagacaaaagaaacttttaaaggaagaaaaaaggggaagaaaaagagggctccctgcttctagggagcaaaggcagcagcctagcttccacagcccttagaatttattgggtagaaagagcaggggggaggtgataatgactggtcagctgcttaattgatcacacgttcatattattacgaacaggcttcagatgtacctaatcacaagaaactgagcttggggcgtgactgccttcagcattccttctgggtggcataggcagtttgtcagtttgccaacattctgcgtttatgagaacagtttgctgttcactcttatagcctccagtggtatactgagttgatcacgaccctcagtctttcggcctccaacagttacaaatcatgttgatggcatatcccttgatatgatatgatatgatataagatgccacttcatgtgatttttttccttcccaaaacccatagccccagtctattcatgaatcatgcaatttccagtaaacagacattctacagtgtacctgaccagtactccttaaaattgtcaaggtcgtcagaaacaaggaaaatctgagagactgcccgagcccagaggagcccaaggagacatgacaactaaatatatgtagatcctagaacagaaaagggacgttaggtaaagactaaggaaatcagaataaaccatggatttgagttaatgacaatgtatcaatattggttaagtgtaacaaaagtgtaacaaatcctaataagatgttaatagtaggggatattgtgtgctgggtatatgggaactctgtactctcttcatattttctgtaagtctaagacttctaaaatctaaagtctgttagtaataaaaaataattctttgtatattaaattatcactgatttaacaccagaaggtaagtggagagattttgaagtcttacatcaaagaactttcaagatagataatagcttaagagttataacatgtaccccaaaacttagagttttatttttttcctcatactaggcacttaggataaattattgaactgtactgttggctagaaaaactttgatgaaatgggctgacttccacagtggtggtggttttctttctttctttcccatctcctgggcaatctccacaagaatttgaaaaattactaaggacttgaagcttttttttaattaaaaaaaccactattgtttattgagccaagctctttggtggaatctttaaaaggtatccatgtgtaaagacattaggtattcaaatacagcaacaaaaattgctacaggattaaatagaaatttccctttgaaaaccaggaagagctttgccatattgtttctaagtaggtttgcgttcataacaagcaagatgcattgattttactttggcctgagcaagattcataattttactgcatacgaatctgatgggggggagcctcaatctgccacagaacctacttcggtggtttaatttttagtaaaggactttaagctgagccctttgtagacttcactctttttgtagccttggccttgttactctgttgaggttttgggtggtgggattggaactagtatacaaaacaggctattctttttttgactttgtatgtttgtaatagtcgtacttgcttcatgtttttgcaaagctgctaagattctgtataaaataggatcagctaagttatgtcgtagtcacaaactaccctaaacctcaggagcttaaagcatcaaaaggttaatcacttcttggccaggcacattggctcacacctataatactggcagtttgggaggccaacaccagaggattgcttgagcccaggagtttgagaccagactgggcaacgtggtgatagagagaccctgcctctacaaaaaataaagaaaaatttagctgggcctggtggtgtgcacatgtagtcccagctgggaggctgaggcaggaggatcacttaagcccaggagtgttttttgtttgtttgtttctttttgagatagagtcttgctccgttggttgcccaggcttgagtgcagtggcgtcatctcggtttgctgcaacctccacctcccaggttcaagcgattttcctgcctctgcctcgcaagtagctggtactacaggtgtgcgccaccacgttctcggtaatttttagtagagatggtgtttcaccatgttggccaggctggtctcaaactcctgatctcaagcagtctgcccaccatggcctcccaaagtgttgggattacaggcgtgagccaccgtgcccagccaggagtttgaggctgcagtgaactatggttgtgccattgcactccagccttgatggcctggatgacaaagtaaggctctgtttctttaaaaaaaaaaaaaaaatttccaatgtgggtggagggggaagtgcttttgctaactgtagtcactggggagcccagcttgatggaagctccatcccttactgcatgcttccacgcccattgaggcagggaaaatgcagtgtgatgaattgtgttcattggctttcagacacttctaccaagaagggatacttgtcattgtacctcatatttcattgaccaaagtaagttacatgtccatgcctaatttcagaggtggcagggaagtgcagtttcagtgtatgcccagaaagtggaaagtgagaaatatttgatgaccaatgctgatgatttccagtccctaacaacatcagtttctacctggttggatgaaaaacgtgtgctcattgggtgtacacttcaatctacaatttcattagatgacattttagagagggaacaagtatgtttttcatgtcatccttctttcttatttgttctttcttcccacatgtctgtgtagacagtactgtagaaggcctgtcgatttcatttttcaaattaaagtataatttaaatacagtaaaatttaccttatttaatatctattttgacaaatacatgcagtcatatagccagcacagtcaaggtatagaatagttccattacccccccccccccttgcaaatatcctttacccttttatggtcaactttgtcccccatttccagcccctggcaactactgatctgtttctgtccctatcattctgctttttccagaatgtcataaatagaaccatacagtatgtagtcttttgagtctggtttctttaacttaatacaatgtttgagggttatccacatcatcgttgcatgtatcactagttcatttctttttattgcttagtattttattgtagggatgtaccaaagtttatctattacccagttgtggaattcttgagttgattgtttctagttttggggaattaaggatgaaaccgttatacatactcacataggtttttgtgtgaacataagtttttgttttatcaggttaaatatatattagtaggatttctggattgtctggtaagggtgtttttattttcatttttttgccctttcaataggtatgggagtatcttactgtgattttttttttttttttttttttttttgagacaggatcttgcttataaacccaggctggagtgcagtggcgccgtcatagctcgctatagcctcaagctcctgggctcaagcaatctttctgccttagcctcctgagtagctgggactacaagcagacgccatcataccctgctaattttaaaattttattgtagatatgggggtctccctatgttccccaggctggtcttgaactcctgggctcatgtgatcctcttgcctgagcctcccaaagtgctgggattacaagtgtgagctgccatatctggcgttactgtgatttttattaaaaaatttgattgtggtaaagtatatgtaataaaatttacttattttaactatttttaagtatatacttcagtggcattaaatacaccttgttgtgcaaccatcaccatcttcttgtgatttaaatttgcatttcttgaatgacttgaacatttaaaattttttattcctctttcggtgagtgtgttcagatcttttgctgattttttttcaaaccattttctttcttttttttaactaacccagcacaaagctgattttttttttagttttcttactgttgagaccttgattagtaaactggacaaagaacttgaacagatagttcacaaagaaagagaacttggtaaactgtggaaatgttcaggttggcagtaataaaaccactttttaattagctgctgtactacctggttattttttatctttatatttcagtaatgtatgttttactcgatggagcagtctactgtgcaagtgggagaatatgataaagttggaggagcagataaatagaatattgacattatgaaaaaaataaaacattcacgataacctggttgcttgatgaaggtagttgtggggaagaagcatgataaggtcaaaaggagagtactcttggaattgggagctagtttttaatcctcatttggcccttggttgataattacttggttctcagtaactgaaatagaattagctattcttagatttccagccagttttctgaaagtgtgacagttcagtgataccctagatctcttgtatactgccttctccttagtcttgtgtggccttagatgtgttatattaccctacccctttcaacctcagtttcccaaactatgagattggtattgtgaggagtaagtgacagaatacattcggagtgcttagaactgtgtgtagagatggtaggtgtattagtctgttttcatgctgctgataaagacatacctgagactgggcaatttacaaaagaaagagatttataatggacttacagttccatgtggctggggaagcctcacaatcatggtggagggcaaggaggagcaagtcacagggatggcagcaggcaaaaagagagagcaagtgagcttgtgtgggggaactcctgtttttcaaaccatcagatctcatgagacttattcactatcacgagaacagcattgcaaagacttgcccccatgattcaattacctgggtccctcccacaacacgtgggaattcaagatgagatttgggtggggacacagccaaaccatatcagtaggtaatgaaataaagggtagttcttagctgatgtcaaagtaacaattgaatgttgtgcttttttatacttttttttctttgaggcagtggctggtcttttaaaatgccttcattaaagtttctagtacattataccaaatagaaattaaaagacatgcaagttgctgctggctggcatctataatcccagctattcaggagtctgagacaggatgattgcttaaggccaggagtttgagactagcccgggcaacatagtgagactctatctcctaaaaaagttagctgaatgtggtggtgtgctcctgtaatgcccactcctcatagatatttcaaaatagtaatatttattgctgccaatgtgagtaggccaaaaaaaaaaaagagagacatagagacatggaagatcaaatgccaattaattacttaaaattgattttgagaatatgaaaacatcattttggattttgatgttttctgctccataatggagcagaaaattaattttcattttccttatatttgtttttctcctaagacccaattgaggggggagaaaacccatagcatcttaaagatctttatttttttatcatgtctgtgtactattgttagtggatataatgctttatgaaatgtggtcatttcagtagttttataaaatatgttttgatttaaaagcatgtagcaatagtgatcattaatccattcattagaattttttatacttcattatacaattgactctgtgaaaatagatgctagggagattttaaagagttattaatactgcttggaaataataatatgttagaattccctttaggattattttttttccccacttgagacctaacctgtcattgttttcatataaaccaaaccacttaaagtaacaaatggattaatgcacttgttcttcctcttgacgaactccttgaagaacaattttggaagtatttattaatttgctttaaaataacaacactcattatgtgttaatataaatactgtttttcgtgaaaataactattccaaactcccaaaattgatgaggaaagtggatttgttttatatttgccaatctctttaatacctattttaatgagaagcagctgggtcttttcatctctagctgcattcattctattatctcatgtagcctctagaaaataccactgcaaactggcaagacaataagtgaaaaagaagtcttaggggctgggcatggtggctcatgcctgtaatcctagtgctttgggagctgagatgggaggattgcctgaggccaggagttagaggttacagtgagctatggtggtgtcactgcactccagcctgggtgacacagcaagaccctgtctcttaaaaaaaaaaacaaaacaacaacaacagcaacaaaaaacttaagtgttactaggatagtagttgtgtctttgcattctctgagtgagaaacttgggatcccagttctcttctctaggccaagcagagccctggggcttgatttcagagttgttgggtttgcttagtatcttgtttgttggtttgtcattcagaaggacaggggtcttctgaaaaatcagtgccctaattcatgtgtgtgtctacatccttctaagtggagatccatgtctctctccccactccacctgtcctgttccaccattcgctagctggccatccacttggagtcagcagtgcttcctgtggtgagtgtgccctggagtttgccactgctttggtcctgaccacagctttctcaggccacgcagggctaggttgtctaggtggcagtgttttgtatcatggaatgagcccaccaagtgaccaattgctgtacccacgtggatgtcactccacctgttgtccttgcctctcacaggcagcaatgtgccagcaggactgtctttgccataccccaggccatagtcaatggccgacccgtcacgatgttcctggagggcagcgtcccacgggtgggacaccctttgtcatgctgtggctgctataccctacttcctacttgcacagccatctgaatgtgggctagggagcccaaaccctatgcctgagatctgtacatccacacttgcacccaccctccctggtagatcctacagtagtagcacatgccagtttcaaaagttaatccacagtattgttgtgaatggctggatgagggttcagctcctatatagataactggttattgtaggactgatccgcacctgtggcttcagtgactctggtgattctaggtaacctagatcaatcacattttctccccacccccaccatggccctgtcactcttaggtggcagttgtagtgcctactgaggcgaccactgtgaccaagaatcttaataatagggaatctcaatttgattctgcagagagagagcctgataaattaataccctatctaaagaatgcagcaggcgcacaaattacccactcccaaccctggaggataatgattaaaacaatatagaactctttcaaggccctgtagttggaaagagtccagtttaaatcctttaaagaggatctattgcagggcaagcctggtgctggcagccacggtaatcccactttcaatgtggtgtgctgaattcctggcagttaaaatgcttgtttttggatcttaacgtgctgccggggtccattgcaagaaagtccatgcctcttgtctttttggtaccttacgggctcttcttccctgagtttccctggagctgaagtgtgcacttgaagaaaattagtgttcaaagtagcgtgggctgcctggatactgctggtgggaatcatggaatgggagcgtggttctattttgtttgtgttggaactttgaggaagcttattaagcagggcagttggggcattagtattgcaccgctaggactcaaattctgggccagtaataagactgatcagagtgaaagtttttgccaaggatgttttcattaaccaagaatgaaggtgaaagtgggaagtttaaagatgttcaggtcctgtgtagttacgaacataaatgtgatgttgaccactgcattaatgcccatgacccactagcagcttccaggaaaccagagccctttgggtcgtggtagggggaaggtctgtgttcatagctgaaactgaaaggcaacagcaatagagacagcttaatttgactgaacatgagcaaccttacctgcttccagcacagacaggattgtcccattgatagttattctgtgggtgggggtgcatggcttttctacttgatgaagagattttgagaggtgacagcatgctggcagtcctcacagccctcgcttgctctcggcgcctcctctgcctgggctcccactttggcggcacttgaggagcccttcagcccaccactgcactgtgggagcccctttctggcctggccaaggccagaactggctccctcagcttgcagggaggtgtggagggagaggcgcgagcgggaactggggctgcgtgcagcgcttgcgggccagctggagttccgggtgggcatgggcttggtgggcctgcactcggagcagccggccggccctgccggcccaggcagtgagagacttggcacccgggccagcggctgcagagggtgtactgggtcccccagcagtgccggcccaccggcgctgtgctcgatttcttgccgggccttagctgccttcccgctgggcagggctcgggacctgcagcccgccatgcctgagcctcccacccactccatgggctcctgtgcggcccgagcctccccgacgagcaccaccctctgctccacggcgcccagtcccatcgaccacccaagggctgaggagtgccagcgcatggcgcgggactggcaggcagctccacctgcagcccgggtgcgggatccactaggtgaagccagctgggctcctgagtctggtggggacgtggagagtctttatgtctagctcagggactgcaaacacaccaatcagcaccctgtgtgtttagctcaaggtttgtgagtgcaccagttgacactctgtatctagctgctctggtggagccttggagaacctttatgtctagctcagggattgtaaatacaccaatcggcactctgtatctagctcaaggtttgtaaacacaccaatcagcaccctgtgtttagctcaaggtttgtgagtgcaccaatctacactctatctagctgctctggtggggccttggagaacttttgtgtcaatactctgtatctaactaatctgatggggacgtggagaacctttgtatctagctcagggattgtaaatgtaccaatcagcaccctgtcaaaacaggccactcggctctaccaatcagcaggatgtgggtggggccagataagagaataaaagcaggctgccggagccagcagtggcaagctgctcgggtccccttccacactgtggaagctttgttctttcactttttgcaataaatcttgctactgctcactctttgggtccacactgcttttatgagctgtaacactcaccgtgaagatctgcagtttctctcctgaagccagcgagaccacgagcccaccagaaggaacgaacaactccagacgcgctgccttaagagctgtaacactcaccgcgagggtctgcagcttcactcctgagccagcgagaccacgaacccaccagaaggaagaaactccgaacacgtccgaacatcagaaggaacaaactccagacgcgacaccttaagagctgtaacactcaccgcgagggtccgcggcttcattcttgaagtcagtgagaccaagaacccactaattccggacacaatttgactggtagttaatcaataaccagggagattagcgtgctaaccagttaggtgagcattcggcatctcccaatttagacaaatggcattcagccatctgagattgagcagttaggctctggattgcccagctggttagcacacagatagatctctccaccagcctagaaaaggcatgcaccccactcacagaagagtagccacaggcctgtgatgctcttaaatgcctgtaaccacgcaccacactgctctcggcatgtgctcacttgaatccgatggatgtcagagacccgttaagtgcattagtgatggggatcgggattgtagtaagtcgtcgttaaggaagaatttcccgtgagagattaggctgaaagtgtgcattaagtttctgcccattctccctccgataggccactagggattggctcttggccctgacagatagctgagaacggtctaaaataaaagttataaccagggttccctaagtggacccgggtaggagctttagagcgagagtgcgaaggatccgtcgcggttcctctgccgtcgtgctgctttggggccactccaggcagaagacagacaaatatgcccctagagtcttgtagtgctgggcatgaggggtgggctgcggtccaaggaccccttagcgctgtcccttctgcttaaggtggcttccggctcatctctctgtggcctggtgcttttgtggctttggggtatcccctccccccaccagcccttaaagtgtgtgtatgtgtgtgtgtttctgggtctgcctaccttgcactcttgtggggtggggtgacatgaaaagcttgtcttctaactgctgttattgtggtgagtcctcacatgtgttttgtggagtttaggctgttaggactttaaaccgttaaattgttaagactggagtttaaaactgttaggacgctaatggtgacctgattttacatatttttattatttgttgtggagagcgcagttttgaataaaaccatctgtttctcttattttcgactttgatttatttaaaatctgtcatacgaaggaacaacttaacttttaatacattatttaggaattttttagttttagataaacacttgaatagcaacttaatcacaactttcagttctccgtactattaatgttttgtcaagtgatagattcttgctttaatgtccaatattttggtttatgcttgtttcttgcttttttaaaaaagttataaccaaaggaaattcaattttcctttttcattggcagacatatgtagagtgtgtcggtcagaaggaacacctgagaaaccgctttatcatccttgtgtatgtactggcagtattaagtttatccatcaagaatggtaagtcatacttttagaaagttatgtaagtctgagcttcagtttcgtcatgtatacagtaacagggatcatttcaatgtactttctctgtaattatttttaaaagttttattgtattttcctgagcacaggaaactgaaaaagcccttttattgtaaaaattaaaaaatttggaaaagaaattatccattaattcttaataccatggctgttattttggtgtatcctcttccaggtacacgtaattacccattgtttatttctaccatggagagcttattttgtcctctgaaagtgttatgattttctagttttgcttggcataatagtagcttacatttatgaagtactttttgccaagaactgttcttagtggtttgtacatctcaactcatttttaatccttataagaaaattgtgatgaggtggagtattattattatgcagatgaggaaattgaagcatgggaaggctagataacttgtccttggccacatagccagccagttagtggcagaaccaggattcagacctagctaccaggtaccagtattatcagaccaggattaaaactgatgttgatgcttagagattctttcatgttcattttgctttgaggaaattacagttttgattaattgaaccttttttaatggtagaaaaatgtgttgtttttatctctagctgttgtagtttttcattcttagaaggcagttacaaaaagttaagaatattctaaatttgaaaattttgaaactaaaagctctgtgatatatacatttttaataaaaacaatgttttcgacaaaactgtaatgtttctttgctgtaaacactgtacttatgaatctatttataattacagcttagttcaatggctgaaacacagtcgaaaagaatactgtgaattatgcaagcacagatttgcttttacaccaagtaagttctttagacattttcactgcattttttttggttatcactcgtggcataaaggtgtttgatatgatcagttgacagaggaagggggataaaagtgcttaagcactttaaagcaattattttcagcttgattttttttgatagtaataggaagtattgatatttaggaaaatattttgaaaaactgtatgctgtcttttatcacacacatgtttgagatttgtggggtgtttttttttgtctttaaaatttatttacttttaattgtagacaggttcgaacacatgcaaaaatctaacaagtccacatgaacccatcacttagtgtcaactcatagcctgtcttgttttacatacactcttgttccctgcctctttatccttttatttttttctctattatttaaaaaataattctaccatttgtaatttcatctgtacatacttcagtatgtatctctaaaaggtaagggttctttttcaaaaacgtaactataataccattatccacctagaaaaataaacaatgatgccttgatttcatcaaatattcagtactcttcaaatttggactacattttgagttaaagttgtataggttagaataatagtcataaagataaagctttttttttttttgagacagaatctcgctctgttctgttgcccaggctggagggcaatggcgtgatttcagctcactgcaagctccgcctcccgggttcacgccattctcctgcctcagcctcccgagtagctgggactacaggtgcccaccaccacacctggctaatttttttgtatttttagtagagacggggtttcaccatgttagccaggatggtctcgatctcctgacctcatgatctgcctgcctcagcctcccaaagtgctaggattacaggcgtgagccaccgcgcccagcaagctttttttaaaaaaataataaaaaatagagagagggtctcactatattgcccaggttgttcttgaactcctggcctcaagcaattctcctgtcacagcttcccaaagtgttgggattacaggcttgagccacattgcttggccaaacaaagttttaaattaccgtttttttcatgaggctaacttttaaggtcaatatttcataagcctttataaaatatttttgcagcctttaaggttttaactatgattcctgtgcctattaatatttaatatgttttatctcaaataagtagaggactgtgctggcaagttattaaatatttgaagcataatttttcattctgggatcccctatattgccttcccttacaaaggatttttgtgttttagttgtgtgtgtgtgtgtgtgtgtgtgtgtgtgtgtgtgtttaagcatcttgagcttctcgatataaatgctgtaacttagtgttttactttgtttttatttgatgagtataaatgattaaagttattacattttcacttttggagctgtatattcatcataaaaaagtcaattctgttattttgtagtcattaattttctgtagtacgtaaaagctgtacagcttgtcaagattcataggaaactaagactaactagttgagtatcttcatgaaattcagttgataggaaatatgtgggcttttactttgaggccaatagaagcttgttttgtacattttaattttcatttgatagttacattctctatttcttttatcttttgcaaaaaatctctattattcctggttttaatgacttgctcttgtataccagatatcctatcgaagtcaatgatctgtgggcatgtgccattaaaagttgctatttgtggccaggtgctgtggctcacccctgtaattccagcactttgaaaggctgaggcaggcggaccacctgaggtcaggagtttgaggctagcctggccaacatggtggaaaccctgtctctactgaaaatacaaaaatcagccaggtgtggtggcagacgcctgtaatcccagctacttgggagcctgaggcaggagaatcacttgaacctgggaggcggagtttgcagtgagctgagattatgccaccgcactccagcctgggcaacagagtgagactctgactcaaaaaaaaaaaaaaaaggtgctatttgtcagttgtttatttctcaatgtttataggtgtgaacagttttgtgatagtgttcttataaattttagatcattgcttttaaaccctgatatatcataatttcttgttttggccttactggagaaagaattgtttgtttttcctttatgttctttccgagctacctgtggtagaggtttttgataataggcagtggttttttattggaaccattttaaaagggaatcctttttaaatgtggcagaacttttctttttctgaatgtgttgagccacatttctcagagtagtgggaagatctgaatttatcatttgaaattttaagtattatgctaacatcgggaaagtggctaacaaatgtcagtgggatgtttgctcccacatgaaatgatctgctgcggactgttgtgctttttgagtgctatttaatgcttatatttgggggagtgttgatggcttgttgtcagcttcatcttttgctcctgtttgctttattacatcttttatagtttgggaaaccagatgattatattggttgaatgttaaaatgtgtgtaaatgggccttgtatgaggttcatggctattagcaagggatgtgaacatctattgaatttttttttcctgcccagaggcctttgttgatttccacgtttcacatgtgatttgcctcataaatgacttcttgggtaaatgtgatattataactatttggtttattttttttaaataggaaaaaaattaagcacaaggcaaatattggaagtttagttaatgtctattttatatttatgaattaagctattttcgaatcttcatgaaactgtaagtactttttttccgcttatagtttattctccagatatgccttcacggcttccaattcaagacatatttgctggactggttacaagtattggcactgcaatacgatattggtttcattatacacttgtggcctttgcatggttgggagttgttcctcttacagcatgtgagtattcatgcctctgattggagttatttaaacattgcataactacttaatattataaagcaatattgcatcatattattatttgactgatgtttagttatttgatgtcagagtgtcatgtattaggaaagccttacttagaagatgttcatcggaactaagaatgagtttaacaggtcagttttttgagtgaatgtgggaaagaacacagcatacagaatggctaaccatgaaagttcatgaaagcgttgaaaaaatcaaatcaaatcataattagatatgaagtatgctagagctttcaagggctacaaaagacggccgggcgcggtggcttatgcctgtaatcccagcacttcaggaggccgaggcaggcggatcacgaggtcaggagtttgagactagcctggccaacatggagactgaggcaggagaattgcttaaacccaggaggcggaggttgcagtgaactgagatcgcaccactgcactccagcttgggcaacagagcaagactttgtctcgcaaaaaaaaaaaaaaaaggactgcaaaagatgaattcttttgggattctgcaaccctcctttaaaaaaatactcacatggccaggcgtggtgactcacgcctgtaatcccagcactttgggaggccgaggtgggagcatcacttgaggtcaggagtttgagtccagctgaccaacaaggtgaaaccctagctctactgaaaatacaaaaattagccgggtgtggtggtgtgtgcctgtaatctcagctactcaggaggctgagacaggagaatcacttgaacctgggaggcagaggtttcagtgagctgagatcatgccactgcattccagcctgggcaacggagtgagactttgcctcaataaaatacaaataaaatttaaaaatactcatacatgtaatggtcataaataattgggaggcttatctttcagatataggaggctctttgggagggtggtatactaatcaacccccctaatcaatccaaagaatcctcttggattctttgttgttcttatagacatggagagaagtacatagtatatgggaggcagagtatatagataagattcattagagttaaactaaatgtttaattagtataattgatatcttcatgtctccttaaaatatgataaaataatcttgattacctatggaaatgaaattcttggaagataccaactagcagaatataggtactgttgaagagtgagttagctagaaaatgtatcaaggaattctcccaggatgaaactcagagggacaaatagttacaagtatgagaaataaatattgacaaatggaggctagtctagtctgtctagtaagtagttccacaaggtaaaagagataatggagatgaggaaacaattggtgtcttttagattgaacgagaaagctgaccatggtaaaggaaaagtctcatgaacctagacatattctcaagttttctggagctgggtagggtggcgatggtgatagaggtatagagattgtatgcttccagattatcctacaaagtaaagaaaatcagagtggcatcagacttaaaattagcaatgttgaatgctagaagacaatggaaactcaaaatttgatgtttttgaacctaaaattccctttctgcaaattactctcagattgaaggacaaactacagatgtttcaatggatgtgagggattggaaagtttactaccttaaacctttttgaaaaaacaggatatactttactaaatgagcaaggaatcagagagaaagatgtgagatacaaagaagtgtttcatatagctaagtctcaattgttaatctgcaataattaatagtttttgggtaacagcctggaactaaaattccagatgatcttaacgtgggagaaattgtgacgggaagatagaaattaaagcttttaaaattgcttatctcatttgtggggagattatagatgttctagatgtaggtagaaaaatacagcataactgtgcattaaaaatgtggactagacttataactacccagaactggactcaaaactacattgttacattattaatgacaaaagtgccaccacagatcggtggcaaaaagatggtcttttcagtaaatggtatggcagcaatcagatggccgtacagaaaaaaagaatcatatcattacctcaacctaacacagaaattaatttgagatgaatttaaaagcctgaatgtgaaagttaaaaagaaacttctaaaataaaatacaggagaataagcataaaacaaaatattagtaaattgaacataattaaagttaaaaacttctcttcatccttagacacttttaagaataaaaggcaattgaattctggcactcaaaaaaaaaaagaaaattgaaagccatggagtgagagaagatatttgcagtacccatagccaacaaaggacttgtatctagagtatataaatcaataacaaaaaggcaaacacatcccaattaagcagtggacagaattttgaacaggtatttctggaaaaatagctaaatatactaagctctccgtatctgtgggttctgcaatgctgactgtagaatgtgagcatctgtttattttgttattgaggagagtcctggaacccattccccatggataccaagggatgacagtagccaataaacacatgaaaaactgctcagcatcattagagaaatgcacaaggagggtgactaaaaataaaaagagtagacagtgccaaatgttgctcaggacatagagcatctggaacacgtatacagtgatcaagggggagcgcatatgttataaccactttagaaaactggcagtatctactgatgctaaatattacaaataccttatgatctagcagttccattcttgggaatataactaacagaacaagaactttctgttcactaaaggacatatgtataagaatgaccacagcagttttattaatagtacttaaaaactgatatcagtcaaatgcctattaatagtagaatggatacatcgtggtttattcatgcaacggaatactacatagcagtgaaaaaagagctaactattgtgacatggaataacatggattaattttgcttctttgacaaaaacaagccaggcacaaaatcgtatgattgcatgtgtgtgaaattttaaaacaggttacattcatctatagtggtagagatctgaatagtggttaccttttgcaggggctgttgcctgggaagaagcttgagggagccttctggggagctggaagtgttgaacatcttgatttgggtggtagttaccaaagatatacatattttaagaattcacccatctgtacacttaagatttatgtaaaatatactttaataaagacataacaaaactcaagggcaagtgctagaagaatagaaataggatgagtgggaaacagcaaataaaatttggaaatttcaaacaaaggcaggaaagaaaggaagggaatgcagaggaaggaagtagggaaataaaattaaatacatctgtaatcataagggtttagatttctctgttacgagagagcttcatagatgtgtaggtataaaacttgcactactacaagagataaatacaaagcagcacaggttaatgctaaagagatacaaaaatagttttgttagcaaatggctaacaaaaagccagagcaatattaatcagccagttatcattcaaatgcattaaatgggacaaagcattatatttcatattaataaaaggcataatccactaagaaaatagaattaaagaacttttatacaccagaaagctgggccttgaaatatgtaaagcattcacagtcatagtgaaagacttaacatgcctctttgaaatcagtagatgaaataggcaaaagtaaggacttacaagatttaacagttattaatcacaagcttgatttctgttctaatttgtttatatacagatacacacaatttaaattacatcacacgatacatattctgtaacttttctctagcttagcatcgtatcctggtggtctttccatgtacgtgagtgttgtgctgtcttatttttttttttttagcgatacacagcactctgtagtaagaaggcctgttgcacatgaatccatttacctatctaaacatttggtttgtcagttttacattgttacaagcatacttgtctgagtattttataaacatgtaagtaatttttattacagaaaatcttttcctacctttccattttgacttggttttgaaaacagccattgaagtcactgaaaatctgattggaagtctccgatacaaggctatatagggaatgcttaagctaatacacaaatactggtttgaaagaaagcctcaggtttttattcttgtgccccattttcaaatctgtggtctgttatctcattctgtctagaattctgctttcctgactaaaagactttctgccttgatagcagttcgttcacccatactttgtctttctctaaatggccagaatttagaataattatattctgtattttagaggacctgtgaatctgtgcttttaaaatattggttgtcaggttgccatttatggcattgcagtacatactctactgaaaaattctcttaatttcaaagacttatacctccaaaactgaaaccttttattgtcatgagcagacttaatgaattttggaattctagaatttaaaaaattctttatattataattttggagatctttactttagatttttcttttcaaacatctaagctcattcaataaaaaaaagcaactaaacctagagagaatctaagtgctaaacatgattgtgtaacatttactcttcattgtcactatatttgtgcttgactgtgtttttaaaaatttaatattttgagacttaggcttgtaaagactaaatgtttatttcagtggcatttgtggcgttccactttacctctgctttcttgagcagctatgtgaattcatgatgcgagttgtgactgtgtgccatcatgctctttttcggtaggccgcatctacaagtgcttgtttactggctccgtgagctcactactgacgctgccattagatatgctgtcaacgtgagtattgaacctctgtgacgaatgttgcatgatgtagatgatgcttgcttttttccttgcatatttattttattataatttgtaaattcttttgttttgagaacaataatttatgtctattacactaacagttatagctgcagtagaagtagctgataaatgtaaatgacacttcttttaaaacatacctgttttatgggactgttttgtaatgatgggatgacttttctttctttcttttttttttttttgagatggagtcttgttctgttgtccaggctggagtataatggtgcgatctcggctcactgcaacctccgcctcctgagttcaagcgattctcttgcctcagcctccagagtagctgggattacaggcactcgccagcatgcctggctaatttttgtatttttagtagagacagggtttcaccatgttggtcactctggtctcgaactcctgacctcaggtgatccacccgcttcgggctcccaaagtgctgggattacaggcgtgagccaccgcgcccgtccgggatgactttttaaataggctgtcacgcagtttgagatacatactactgtcttatgttcacaaaagtttttttgttttgtttttttaaatggagcctcgctctattacctggggtagggtgcagtggtgtgatctctgctcactgcaacttctgccttctgggtctcctacttcagcctcctgaatagctgggattacaagcatgtggcagcaagccaggctaatattttgtatttttagtagagatggggtttcaccatgttagccaggctcgtctcaaactcctaacctcaagtaatctgcctgcctcggcctctcaaagtgctggggttacaggcatgagtcactgtgcttgcccaagagttcgttttaacatgtgtttttaacatacacatttgaactcaaatttattttttaaatgttttccatgattattagaatataaatgctaagaacttgcctgtagttactttactatatcttgatattaagcattgttgcttgccttatattggcaggcttctttttccctctcacctgataggcttgagggtcacctgaattgctttcattagactactcattgactccagaggaccactggaagcctagtggggctagtcaaaataaattataaacatggcttggttttagctgtcttttacagtttgaaaaattgagccagtttttctgatagcagttgtgaccaaactactttttttctgagtaatgttttacactctctatagaattttttttctgtgaaattttactttaaatttccttaatgtcttaccagtttctatgtattctgtagctcagtaattgaggtcatgtctaggtgcactgtatcagttatctattgctgcaaaacaaactgtcccaaaccttagtggcttaaaacagctaccattttatttgcttataattctggggtcagcagtttgggctgggctcagctgagcttttcatctattgggcttgcctaggtcactcagctgttttactgggacttaatgatctaagatggtttgtctgagatgccttggttcttctctttgtggcctcttatcttctaaaaggctagtagggcttctttacatggtagtctcagggcagcattctaaaagggcaagagaagaagcttgcaggccctcctctgggctctggaacttgggcagcatcgcctctgtccaggattcacaaaaccagcccagattaaaggagtaaggaaaaaggactccagagtttgtcaccaaatgtttaaaatctgtaacaaacagttaggattattgctgatagcaaggaagatgtaaaggggatattttggtcccaacctttcagaatttagtagcctggagagttccttactaaggtggtagttaggattcctcttttgattcaggacatattgcagactatattttcctagaggccataccagtttagtttaagtttggagctgctgggtcaaggtctaccagattgacccttctcaggttttctatggaggaaaaaagtgattccattaaaataatggattttccaatggctaagagtccagaggcttttgagttatctgtgaataattctgaaatcataaacatggactagggaaggaaagataagcctcttaagaaaggaaaaggacaaaatggtcttcagtatcatgatatttgatgcattttcttgtatgattactaaaggaaccatactttgcctttctgaatttgttgagaaactaatacacttttggtatgattgcagttagcatcaaaacttggtttgctttctaaatgaaaaatttctttttttttgagatggagtctcactctgtacccatgctggagtgcggtggctcaatcttggcttactgcaaccccccgcctcctgggttcaagcgattatcctgcctcagcctcccgagtagctggaattataggtgcacaccatcatgcctggctaatttttgtatttttagtacagatggggtttcaccatgttggccaggctggtctcaactcctgacctcaagtgatccacctgccttggcctcccaaagtgctgggattacaggcatgagctactgcacctggccaagtgacaaacttctataaaatttataatagacctctttgtcttacatatggcatactgaatatctctcaaccttcatttctttatgttgtcattagacttatctggaggagcttctcctcttttctgatttgatgattctattaatttgtgtgggttcaggtgtcagctaatcaagtttttaaacatgtgtaaaataaagatacagaaactcttagagttggacagagtttttaacctttggtaaattacataaatttaatgcatggcctttgtcaagtgttagactgcttttgtctttttttgcgtgctgcctttctgtttctaggccattttcaaaagataggctatggataggtaatttccatatagttctgatggtatttgatgcctaaataaaatacataatacaagtatgtaaatatgtataggttctcttgcaagtagaatttcaccataatcacaaatagttcttttggagaaacttgagattttcatccaaaaaattatgatttattcttctggctgttttttttttttctgagactttagtataagaaaattttttacctttgttttcctaattttaagtcttctttggagtaattatatgtacttttttttttaatagggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggtaactcccctaccccaaaattgattttacttaggtaggtcatgagaattattgtttctctctgagactcaaactcttgacttccatgtccctcataaacattcttttgttattacaaaggagggcagcggaaaggtttgggtgaagatgaagagagatgtgaaaaatcaagaaagtggtattacgactttgcctcttaattttctagttagagtgggaacagcgttggggggtatactgaagtccatgtacacagtcttacccactgagcagaaatttgaaaacatttcctcaagtgtttgatgacagagcatgtatgtatatatgtatgtacatttttttaaaaatgtattttcatccctgatgctgtcaataaagacaaaggctgtcttataaaaaggactacagaatgtttttaagagagccagatttgttaaccattttctataatgctttgtgaactgttaatccgctaaattatactgaatgaatatgtacacgtgttatgaagtgaggttgtgttcttatatactaaaattgatcccacatcagatacatttaaaaaagatgtctttgaaaggttttgtttttaaaaagaatttagtagagtttatatttgttttctagttttttgtttgttttggttttttgagattggctcttgctctgtcactcaggctggagggcagtggcatgatcacacctaactgcagcctcacaacctctgggctcaagagatcctccttcctcagcctcctgagtagctgggactataggcgcaaaccaccatgcctggctaactttttaatttaagtacagatagggtcttgctgtgctggccaggctggtcttgaactcttgagctcaagcaatctgcctgcctcagcctcccaaagtgctaggattacaggcatgagccactacacctggcctaggttttttttttttttttttttttttttttagcaggaataatgtgatttggaaacagagcaaaacagacaagtggatctaaatttctgggcttttctgtgattttaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccagggtaatggctgcttgtgtgtcctcactcttcagcactgcaaatctgttctcaacttgcattgaggaaaagggctggcgttttcaaatttttaatgttgtgaagttctatttctaacttatttttactttattttggcaaactggcatttatggatgtacatatgcataaatatgtttttttctatgaaacagggcatgttttgtgttttaaaatcctttttacacaggccttttttttttttttgggagactgagtctcgctctgtcgcccaggctggagtgcagtggcgctatctcggctcactgcaagctccgcctcctgggttcacgccattctccggcctcagcctcccgagtagctgggacaacaggcgctcgccaccacgcccggctaatattttgtatttttagtagagacggggtttcaccgtgttaccagtatggtctcgatctcctgaccttgtgagccgcccatctcggcctccaaagtgctgggattacaggcgtgagccactgcgcccggcctacacaggacttttttaataggatagataggaagaaactattttttaagttggattaggtactactttttttaaataaaggactttgatacagattcacctcattcatttgcttctctctttccatgtcccttgagtcagtgcaatttctaagattgaaaaagaatcttgaagtttatactgcagacaagatgccatctaaataaatcaacgtctcgttttctagcagtgtaaactctagaatgtaaaataagatccaagacaggagatgggtagatcacctgaggtcaggagtttgagaccagcttggccaacatggtgaaaccccatctctcctaaaaatacaaaaattagctgggtgtggtggcgcacgcctgtaatcccatctacttgggaggctgagataggagaatcacttgaacccaggaggcagaggttgcagggagctgagatcatgccactgcactccagcctgggtgacacagcaagattccgtctcaagaaaaaaaaaaaaagatccaagacagggtctaccagtcagctgttggtcactcacttcccctcctccctcccaccacagttttcctgtcaagctttgcactatctctagttctacttggcagcctgatatttttgtgtctctttgtgtcacgtactctgttagacactgagcatataactgtgaccaaaacattaggctgctgcattcctggagtttctggtttagtgaaaaagtaggaaatacacgtcatgatgagtgttgtgcgggttgctctgaggatgctgttggggagagacctattaatttacctttttttttgagacaaggttttgcctttgagccaaggtcacctgggagggagtacagtggcaggaacacagctcactgcagccttgaccttttgggctcaagtgatcctcccacctcagctccccaagtagctgggaccacagatgtgtgccatcatgcccagctaatttagtttttgtttttgttttcttggtagagatgggttctccctgttgtcctggctggtcttgaactcctgggctcaagtgatcctcctgcctcagcctcccaaagtgctgagattataggcatgagccattgtgcccagcctagacctattttgaataaggttttccaggtagctcagagtacctggtatttgagctgagacctctgaaggatgagaaaaagcgacttgtgtaatggtaacagggggcctttgcagggggaggtcagaggctctgagaatacagcctgctgctacccttgagtctggccgttatttctctctcttgatctaatacagtagctcctaactattctttctccttccgttcttgctccacatagttcatattactctgctgcctttaaatcttttagtagttttcccattactaaagaataaaatccagactccacattcctcttgtatgatctgatttctgtctttctactacccatatcattagtcagaatgtccttagttccctggcttccttacttttctcaaatctgccagattctttcctggcttagagctattgaattcctctctttcagataaccttatttattccttttctagcatttatctcaatctaggattaccttactttatatgtattatttatttatatgtatgtttttattcttatttgttccctgacaagcaaatactcagtatggaaatgtggcttagcttctcaacaacagcttacaaagtactaaattttactatttttagtgcattctattttttttattatttattatttttacttcaagtaatctttaaattgcaattatattttcagatgacatgaattggaatgctttagaatgggaccgagctgctgaagagcttacatgggaaagagtaagacctttttctgtcaagtatcctggtgttttaatcctaaaatatattttaaactttggtgtatttagatgtatacactaatgttatcgttacagttgatgaaaagttactagaattttcattcctagtgaaagttaagtgatatattgtttatggtcaaaatattgtgatgttggtggctttttttggtcttacaaaatcttgctccatttaggaaatgttttacctgaaattgtggacttttgaaaaacaaaataacaatttaaatttaagtagtattttcatgcttcagttgacaaaataatacagttttattatgaagtaatcttaattagctgtatatcttgagtaacaaatccaagacggaattgttttagactttataaatcatgtaattttgaataaaaggagacccaaaatataaaactctcattcagaaacagaattttttttattttctgaaaatgataggaagtattggaaagtataggaagtgggtgaggactgtgtttaaagatattgaaaggaaaatgaggcttttcataaattagaatagaaagttctgttgcatcttaaattaatgcttatcgtttttgtttattttagatgctaggacttgatggatcactagtttttctggtaagtaaaactaattttttttttttttttttgagacggaatctcactctgtcacccaggctggactgcagtggcgtgatcttggctcactgcaacctccgtctcctgggttcatgccattctcctgcctcagctttccaggtagctgggactacaggtgcccgccaccatgcccggctaattttttgtatttttagtagagatggggtttcaccatgttagccaggatggtctcgatctcctgacctcgtgatctgcccgcctcggcctccccaagtgctgggattacaggcgtgagccaccgcgcccggccaaaactaattctttctagtaacagaattggagttgtcttagtgattcagaaacttcacatttatagtatgtagtaaaggtcaagatgccctttggcttttaattactttatatgttgaagattgtatgtttagtgtgctgaaaatattgaaaaagcataaaggtaatatttttaaaaaattgttaaatatttgatttttagcaaagaaaataaaccccaaagttaatggtagttaaaaagaacttggtcttcttttaaagtttcatcttgcagtgtttattgcctgtactggtggaagcaaagcagttttccctattttcacagtgagacaccccaggctgatgttaggttttcctgtttgctgaaccccacctgtctttacctaggaactttgccatattagtaaagattgcaagtctaaggtgaggagcaattctttaaagaacttgttctttaaagaagaaatggtgctgttttcaggtcctgtaatatgaagttatttgccatttgggatttttaaatagcttaagatgactttggctgcaggtagcagaacccctgctggttggaacattaatttaacaggaagtccagaggaagaatgggcttgaggttgcttgatccataggcccaacaatgtcatcagagaccgagatatctccatctgtctcctttgctgtcctcagtgttggccttctcctcaggctggctccagatgttaaccagaagaggatgttgaatttagcagttgtgtaggtttttaggaacatatctggtataattccacagtttagtgggaatgtgatattaatgagcttctagtcatggtttgatcacagtcagtatagaaagcattatttggccacatactgatttatattccttaccccatcagttcctcataaatgaaggacagaagtcgttgaggtagtggtggtgactcaaactcatttgaattattggaaaaaccttcgacaggatgaattcattattttagtaaaaaatatttaatatgtatagtgtgccagctattgtgctaggcactggggaattcagtgcctatgaattcaatgcctatgaatgagacagggtccctgttctcaaagatgctctatagtgtggtagagagaaatgaacatgtaaacaaggaatgttttggagtctcagtgacaaaaagtgtgcataggacacaagaggggcacaaaagagggtttgattaggtctttcttagtggaatggagtttgtcagcaggagattttccgcgaagataacagaggttgaagtataaaatgtgttggggatagggaaaatttaggagcccttaaggcagagaggttgaaaaaattgagcccacatggtgagaagaaatgtagtagtcattcacaaactaattacccttctttctggttggatttgtggaagattaggggacctgaacagagaaatcctttttttagacaaaagatctttggacggatcatttaacttgatggttgcggggaaggttgtgggcatgaatgaatggacttgggcagtctggtcagtgtcagcatggggcatagctaaggtgtgtgtaacatggctgaaggaataggcagatagctgtcgccttagaggtgacagtatgtaactgtgggaggtgaccagatggtcaggtgagacaggacaaagaaagtcagggcaccatagggagtggagggaccagaggagatcaagctagagttttccaaaggagtggtagccaggcaatagtgaccttgtaggtgtcaagaaggcagattggacgttgaaagaaacactgcagttgacgttaacatgatgtttacaattaatttggctttcaaatttttctccatttgaaatttttagtgtcatttgatttaaatgaaatctggtggttatgaaaatctatgtaatttgtcgtagattatttctaaaaaggaagtgtttataaatgaatttgttttttgtacatgtaacatttttgagttttattaggcttagttgtatgagctatctaatgaaaaatgaaagttacatattatgtctagattgaaatcccaaaacaatagagggaaaatttcaatcttagctgtttttactatttggctctagctaaataagtggaatagtccaattaaacatacattaagtatgaattgaatatgctttattgatgcttttttcctttaggaacatgtcttctgggtggtatctttaaatacactgttcattcttgtttttggtaagttgtgtttgtgctttttttttttatagtattatggtaggaatttagttttgtaggagccttgttataggtttattattattttttaacatagaaataaatactaagcagtatatgaaaatagtttcagatacaaaccctgtatagataggccccagacagacagatactttcctaagcagcagtgactgcagttacctacctatctctccctctgttgggcatttctgggttttttttttgtagaagctggttttagaccgacttgaaaatatacagtttcccatttctggaattagttttatgctgattgtgtgtgctcttccctatggtggaatatcttgttttcatctgtcaaaatcctgaccattgccttctagagatcttgacttgggagctgttaccagagctgagtgtaggcttgtgggaagacagtaagccttccccaaatgtgagcaccccttagaaccagattccagcacatacaaaatcacttccaagcacttctgcgagggcagctgtgaggattctttgacagcacacaatggtcccttccattgggactaattagagaaagaaaggcaaggttgaggagacactgttgacagaggtttttctcctttccagaagaggtaaggaaaactaagttgagtaaaccaaggccttagaattcagtttctgtatctcttaggggtgaggacgtagagtctgatggaatggggttattgttaggtgtcctatgatttgtgtctcagagacttcaggcaacatatccctatatagggataatctatgagaaattccttccttagtacatgggatttacccctcagctctgctgaagaggatgagtagagatttcccaaggcttcttccaccaaattccaagttatttgctctgttgaggactacattgtgacgtgtaaagcagacgtctttaataagaagccatgtggtgtaaggggctttgaatatttggactgaggatgagaccaaaaattgatttctgtgtattatctgtaaaagaggaagataaatttacttgtattttgttaacaaagtatttcggatacttccattgatttcttaatttttagtagatactcacaaaggtgcagatttattaggattttttgttccctttacatgtgggggtgtctgtatgttatcctgcatttatttttcattatgtaaaataattcatatatagactgtgaaactgttatgatcttgactgcattttttttttttgagagaaaaaatgatctatagatttaagtctttactcttgcagaaaagcttaatgctaaattaatgtttggagaaccaggtcacatttaaaacatgaattatacaaataagaactctgatttatagaaatcaaatctaagtaaagctttttctaatccaacctcctgagcttatattgcgaaaagaattttcttagtaaacttatgttttattatatagttagaatcttttggaatcttttgaaatgaaacaagttttcttccattaggaacatactttttcttttaatcattgggattaaacaccctcctgtttttttcttgcatgggttgctctgttggaagttttctacaggcagttttttggctcttgtggtcatatgctttgcagaaatataatttgacaaagctgtggtcttccactagaaggtgacaatcctgagaaattgtccttaatttcaggatgcctttccattagtttgtgtgtaatgggatggaaattgattgttgcaactggtatttaaggttaataattatttaatacatctgctaatagagttaaaacttgcccctcccaggggcctagttgagtcatcttcagactgggatatgagagcaaaataggcaaaattcaacatacagtttttttccttaccttattaaatttcttctgctttatattacacacaatatgttagtaaactaatacgtatatataatttataaataaatttaaatatattggaaatacatgttcaaaaatattcttacccatgaaatagtcagaaagggttagaggccagatccctagtaggttcactctgacttctgtcttcatgattgagtttcccactcccctggtaatctactgcgctgtcgatttatttctaccataaagaaaagataactatattttattattaggaatgaagtaaaatttagccagaaagacttgaggaaaaagaagactataaaaattctcttgctataaaggttttaaaaatactttcatacttagctataatgccattatctcaccttacaaaattactagaatttggtatttcctaataatccatcatattcaaactctctgggttgtcccttacataccattttgcagttggtttctttgaatgaagacccaaataaggtccacatattacttttagttgttaagttataagttattagtcttttaatctagagtactcttctctttgcttcccccaactcaccctatttggccattgatttgttgctgggattaggttaactgttcttgcagcatgtcatgttttacatctgtccatctgcttcctggatgtcctctgcctttatcctttgtctcccatatttctcttaaactggaagtcagatctaagggccttattagattcaggttgaatacatctgggacaaatccatcactggtcacactgtgcctattaatagtatatgtgaggagctgagatacatgatgttggattatccacttttatcactggattcagctgatatcaacctgggcctctaatcttaggttttgtttttccctttaccattataaaataatctgttgggagtgatattttaaacagtcattttttatatttattggctgacttttctgaaagaagaagaaattcttatcaatttgggactattcagtcaacccaaacctgtctgtccggggcaagtaggacagatgctcatatttttcccattaattttggttttcagaataaggaattggtgtattaactattcacatgggtgtgctaactgcttccaaaacatcaaagtgttttctttgatgttgctttttctcttttcgtgattattattttggacttttccttttttgagcatcataaactcatggatttgtgtatgttcagtgtttttccatcagttttggtcattattctttttgatgctcatattatcctctctttggcctgttttcacaatggtttctgtgttgatttggcatggccctattagaccttaatagctttgttgttctctagttacagagaatgtcctaggcagtgtatttttagcctagttctggaatctttcatttctccaagaagccctagttccttttagtggggaattgtagtaggagtgttcattgttttgatgtcggagttttcatggaattttttccccctttttagcattttgcccttaccatattggtcatttctcccttgttggtttgggatttgaagaacacgtgagtataatacttttacaaagttactttcattcattactcccaaatgtgattattaataaaatagtattctaaagagttacatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggtgggtgacttgggcagtgtgttcctgctttcagtggttagcctttagcaaatctgctttagagtgagagtagagggcaggctgttgtattacagtgctcttgtttttgtaaaatttaattcactctactgttattttgtctccttgggtaaagtgttatttaatttttcttcattttttagtaatatataacagtcagtgagagaatttggttttcagagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaaggcctaatcacaaccatagttgggtatatacttttagcaataacactgataatttgtcatgtatcctttaatgaaccaacttgggtgtacactaatattattcataccaaagaactcttcattaatggcgaaacttgtctatccttgtcctcttagtaaaagttgtaggtatttgcagtaagggtcagtgtggacaaaatgtgaaataaattaattctgtcaaaaaatactaaatgttggctaagtagttacctgtttcattgtacctttaaatactcagtttttccttgacctgatgctgtagggcttggcaactcttgtgaaatttcatagatctcgtcgcttactgggagtctgctatattgttgttaaggtaattcctgttataacttaaaattggaaatgatttctcctacatttgggtgatactgatgacctttattttcacttaaggtctctttgttagtggtggtagaaattggagtattccctctcatttgtggttggtggctggatatctgttccttggtaagttgagtattcattattgtataatagcataatttaagggcttcaaaagaggaagtcttcagcatgtattctttttaaaggaaagcaaatatttgataatttgcttattcttttggcatgtgtatcagtataggatcttaatgttaatttttcttgagtacctgagtttttgaggctttgtgcaaatttttgatgtcaggatagtttgggtggaatctttctaatagtggaggattttattgcccattttgctgtcgtaaatttgtgtagataatgccaagacattatatacatagagaataatttgataaggaaactgtctttgtagtaataaatttaaccctaatcatttgatttaactaatatgctcagtcttgattatactctttaattgctgttagtgataatcagtttttgattgtttcaaaaatattttatgtgtagaaaagctgcctttggttctgagataacatttaccctcccataccttacttttaaaacttctcaagaatgcagacctataaccaagaaaattttttacattcatcaaaaatagttctttaatagaatcagtattaataaagcttttactaattggtttatcattctttatatttgaagcagtagccaatcttgtatatagttctgtgacaccgtggaatgacattaagtgaactgcagttctaggaattgttccttgcatgcatattgattatttatttcctagaagatgaaaatgttaacttggcaaatgtagggggcacagatttctcttacctgtcctcttttgtctcaggaaatgtttgatgctactctgaaagatcgagaactgagctttcagtcggctccaggtactaccatgtttctgcattggctagtgggaatggtatatgtcttctactttgcctccttcattctactactgagagaggtaagtccacagggaaatgctgatgctgtacatttataaaaaggacttttgctttcaccaccagtcatgtctcaaaggctatgatgatttcctacctaaatcatattctctactattttattctaagagggaataacttataggggactttgacttaattactttaaactgtttcagttgtttgtctccataattggcaagttttaatatttctgtctgagtttgaaagacgattcaactgaggaaaaagataagagtactcattttgtcacacttcgtatatactttagccatcctctaatacagactcttggaattttgtatgatgtgagtgtgtctcagacttcaaggaactgtactgctggaaataaccaaaaggatatggttttgcaggatcagacatgtaaaatcattttgatttaggcgccttaagtatagaattacaatgagggtcctttatgattccagttcactggcctgatggattacctttatttatttatttatttatttatttatttatttatttatttatttacttatttactttttgatactgagtcttgctctgttgcccaggctggaatgtagtgccatgatcttggaacctccacctcccaagttcaagtgattctcctgcttgaacctcccaagtagctgggactgcaggcacccaccaccatgcccggctaatttttgtatttttagtagagacagggtttcaccatgttggccaggctgttcttgaactcctgacctcaaatgatccacccaccttggcctcccaaagtgctgggattacaggtgtgagccactgtgcctggcctgatacctttattagttctatgtttctaatctggttcttagtgatttgaagatgatgaaagcagttgagtatttgattagtgtacatctcaagctcagtcattccccaaatactgaatggtcactgtgtgccggacactatactgcattctggggtttcagtgagaaacaaaggcacaattcctgttctcctcgattttatagcctgaaaatgaatacagcattgaaaatgttggtttacacggagacgggtgatggagatgtgcagggtgtggaggaccaggttgacaattccagtgagaagggaacacaaaagcacaaaggctgaatgctgctcttggtgtactttgttctttgaaagatttgaggaagaggaggaggggtcagggaccaaagcattctcctgaatcatacggtataatttcagtaaattctcttggtaactaaagctttcattctttctttgaaacaactgattgagaactaaagcaagtacagaaatgtgtttcttaaaaatgtaattatatgtgaactccagattacttcattaagtgaataaaatgctttataatgatttctttcattttatcagtgtggtggtttttgttgatataaaattttaatatgtggaacttaggcagaaccttagaaatcacacactgtaaccccttgtttaggagatggagaatagaagtttgggcagattagatgcgttacacagagggtaactcagtgagtttggaccacatagaactagtacccagactcctcctttaccccatcacctgcagcctcttgggtgatgattttcatttacagggggaaggcaaatcagaccgtctatttagtacatttataaattgcaacataacccttttacgatagtaatggttgtatttatttttcgtctcagaggtctagatttcttgacacattggacccaatgaatgttttttttttcccccgcccctagtgaatgatgatgtcaaaggacatcatcagacacagggtagttttcataaagattctggtttaggaacttactttcctaagaataccatgtacattttctggggcccactttagatgccagaataattctaagtgcttatctttctgttaatgttttagctcatatatagaatttgaagacattggtgaatattcatagtatttaaaatatatttgcaggtacttcgacctggtgtcctgtggtttctaaggaatttgaatgatccagatttcaatccagtacaggaaatgatccatttgccaatatataggcatctccgaagatttattttgtcagtggtaagaagatgtttccattgttttttttttttgaattaattgtgctaacctatagttttgtttaggtttttttttccagttctcaagcaggctgatagagtatattgaataatatatttatctaagcctgtggtattcagttgtcaagtagctgtgttattggttactttgttaaaataaatatgtaaaaagatatttactaaaaggaagatacttccttgttccatagtagtataattcaggggtccctagcccccatgttttggctgggtactggtgcatgtcccgttaggaatggccgcacagcaggagatgggcagcggtcaagcaagcattaccacctgagctccacctcctgtcagatcagccttggcgttagattctcatgggagcgggaaccctattgggaactgcgagtgcgagggatccagattgtgtgctcattatgagaatctaatgcctgatgatctgaagcagaacagtttcatcctgaaatcccgttgaaaactgttttccatgaaactggtccctgatgccaaaatggttggggaccactggtatgattgattgctaaattacggttgtctgaattacgtttaatttgcattgaagcaatggagacttactactggcttgtaaattaaactcttaacagaagcatgtcaaagtttccccacccagaagaagaaattacatagttaaatctaatttctttcttttttttttttttgagatggagttttggtctgtcacccatgttagagtgcggtggtatgatcttggctcactgcaaccttcacctccctgtttcaagcaattgttgtgactcagcctcccaagtagctgggattacaggcgcccaccaccaagctcagctaatttttgtatttttagtagatgcggggtttcactatgttggccaggttggtctcgaactcctgacatagtgattcgcccacctcagcctcccaaagtgctgggattacctcacccagccgtaaatctaagtttttctaaaataaaattcttaaagtaacattatgtcctttgaaagcttttgtagccattaacatggggcaagtcttagctggttacaagtgatttattaagttgcaggcatttctgcttcctcattttaagtttccagctcattccttaggtagcaagtggtgattatcctttgtggcttccgttttagcatttgtgtcctagatgggaggtccttacaggaagaggggcaggcatcttaggaaaacatttttatacaaaatgactcaaagataatgtgtagagtgggaaccgcttgggctttgagtagacacaggcctggactgcatattgcttgagtgtgctcagaagtctgcctgtcttgcacaggagtgattgactcttatagtggtgtcataccctgtttccttctgcagattgtctttggctccattgtcctcctgatgctttggcttcctatacgtataattaagagtgtgctgcctaattttcttccatacaatgtcatgctctacaggtaagttttaaaaatttagaatagctttactaatttatctctattagggatttgatgttcagattacattaaacatttaaaacatttcttatagttactggaaatcatctgacaattaaattttgctttattttacctttatttttattattttttaaattaaatttaatgtttaaaaaattttctggaccttttccactttgcataaattttgccttattttagatcagataaacattagtacttacattttgtaaaggaagatgtttattttttctgcgcataaagtatgcatttgcacaccattgaaatgttttaccatacctaatgagagtgtattagcatcatctttattttgaaaagcacattataaagaataaagccagagttgcacatttaattattaaaaatagggtacaaggcttgtagatggaacatcttttttgctttaaaaacttaagtgggctaaggccaggcgtggtggctcacgcctgtaatcccagcactttgggaagccgaggcaggcggatcacctgagattgggagtttgagaccagcgtgaccaacatggagaaaccctgtctctactaaaaatacaaaaaaattagccatgcgtggtggcgcatgcctgtaatcccaactactcgggaggctgaggcaggagaatcgcttgaacccaggaggcagaggttgcggtgagccgagatcgtgccattgcactcccacttgggcaacaagagtgaaactgcatccccccccccccaaaaaaaaaagccatccggaaacctcccactaccagtaatctttaccactcatcctatatgctctttagggatttgtattatccccacagtcattatcccaattgcaggcaaattggattatttcctcaagtttacttctaatgagtctttaaagtattgccaattctaatttcttaaaatctcttactaatctaactcgatttgccacttacttaatttaggccttcctcttgctctccattcatccgcaacacctctgcctctagattttctagaacttggattattttacccctgtgtttaaaagttggcagcacttcctctgtaatctatgtgatatatacaccatttagaatgagatgcaagacttggcataatctcatgttgctttttcagtgtcttgtctcagcattgactgacttcaattcttttaattgtgctacactgccattgaggctcccctgattacttagctgtttgtctttttctctctgtttacaatgacttgcttgtccacgtttgagtggcaagcatttgatattctttttaaaatccagattaaggtttttaaattttattttattttttatgagaaagagtctcgctctgtcacccaggctgtagtgcagtggtatgatcatggctcactgcagcctcaacctcctgggctcaagtgatcttcccacttcagcgtcccgggtagctgagactacaggcgcaagccaccacacctgcctaatttttgtattttttggggagaccgggttttaccatgttgcctgtgctggtcttgaattcctgagcttgaaccatctgcctgcctcagcctcccaaaatgttaggattacaggcatgagccactgtgcctggccatcattccatcctttaaaattgtcttcatcgttgtatttctttttatagcatttgttacattactttacaaatatgtattgttttatcccagatggcagaaatcatgtcttatttaggtctttttctctctgtctctctttttttaatttaaaaaaatattttgtggagacagggtctgactatattgcccaggctggtcttgaattcctggcctcaagcaatccttccactttggtcgcccaaagtgctgggattataggtgtgagccactgcgcccagcctcttatttggatcttaatgctttgcataggaacatgattgttcaaaaataaaaggtttactctacacatagtaaaatctcaaatttgtattttattaaattagaattggaaaatacttatatcctgattatttaaagtggcagaaaaaatgccagtaagggtatagaaagtgggcaggatggggttacaatttaggaatagtgactggtaaagacctgagggggtgacagttgaggaaagccctgaaggagttgagagagtgagccacgtggatccctgaaggcagaatattcttgcagaaagtaggtgcagtggcacccaggtctgtttgaggatctgcagggaggcaagtttgtctgtagtaggaggaggaaggcaaagaattggccctgaagtcagaaaggtcatggagagccacctcctagagagtcttacacgacataagcactttggcttttgcttgagtgaattgaggagctcttggaaagctttgagcaaaggagtgatctaacttaggtttaaagaggatcattctgactgctgtgatgagaggaaactgggttggagtggctaggtcagaaacaggaagccagctgggaggataatgcaatgatcctggtgagaggtgagggtggcagagatgaaggggaggtagcagtggaggccttgagaaatttttaggatattgttaaggtacagtcaaaaggattctctagctgtttggatgtgaggtgtcaaaggaaggagtgaccttttgtgtaacatgctactaatatagcaagtgaggagagaaccaagacctacccatcagtttagcaaaatgaaagtctttggtgacccttatcagaaacaatttggtggagtttgtggggaaagcctcactgagttggagagagaatgaaaggagaggtaataaagacagtaagtttattagattcttaagaagttgcgttgtaatcccattaaatagtagtcatatgcaaaatacaattcacattataaatcctgcctctttcagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctgtgagtatgggcagctgactccttggacatgcatgtcatttgtgactatggaataacctttctggaaaaagtatgttccatggcccactcaagaaaaattagttttaataagagacaatttagtaatatttgcaattgcatataatacttctaaatgaaatttttttttcttattgtccatcctttcatggagaatatatacatctttttgccctcttatagaagtttgctgctggtccagctttcatggagtaaatgtcttttttttttttagtgcattaaaaacaaaccagtttacctttatttagaccaactaacttacctttatttagtgctcataacctgggaaatgggttcttctcaaatttgatttctcaatcttctagtgaacatgttgcatttttttccccaagctttatatactctatatttatttaaaagttgaatctttaaaagtttttcagtttggcatcttgtaggtatcttaaaggtgaagtacagatttggttatatttgcttgaacatctgtcgtcctctaactgcttcctcccccagtctcatttctgacctaactgatttatagcttggaggttttacaaatttatagcttgtagctacatgttgcagtagtcatctgtagagaagataagaagtttttcttttcctcctgtagatccttaacaatattgtacattgtaagtatgtacttacaccttgtgcttgtaagtacttacctcttgtacttacaagtgtacttgtaagtatcttgtacattgtacttttttctttcagttactgatttcttctcagatactggctgaagaaaacgtaaaataggttgaatttatgggatatcctacaagttcattaacattagaaaggtttgatttaaagtgggtacaaacatttagaccaaaattaggtaataatgtggtgcacaaattctgtattatacattttctacccttagtagtaaatatgaagaaaatgagtgtcatgtctgccattttattgtgacctgaagtgagacttgttactgatgtaatttttgcacagggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcagggtaggtgctatacagacttaatcacatatagaggtttttttggtttttttgttctccaaattgctgttgagaattggtgctattagtatgcagtcctctgtgtagacatgttccacattttattaccctcattatgtaacgtaaatgattaggtaagtttatcaaattttagagataagtcaaagagttgggattccctgggctcttgctccctatttaagaggaaaagactctagagtaattaagaaactaacattattgatacatttcaacagtgtgtcaggaactagaatgggcatttggatgttttctcatttaatctccactcaaatactgcaaagtgtaggcgataatttcatgtttatagctaaggaaactgaaggcaatattggttaagaatgtgcctattacatgttcgttagcaagtgatcaatctttgtgcacctcagaattttgtcagaaatgtaagctgatgactgctatatgattacagtgaagtcatcatttatatcaagtctgttattttaaaatgccctttaataatgacatgggcttgtgagtctgatcattttaaaacttgggcaggttatttaacctctcagcctcacatttctttttttgtaaaaatagtcattattatacctttgtagattactgtgggtcacatgtgttcagtcattcagcaaacatgtcttaagtgtctatgattgatattttcagtgtctgtgaggatatagagagcatacgtggtctttgctcagaaagagcttacagtctactcagatgagaaagacagtggcagatttgagctctcatgctggtgtttacagtgggtgctgtgactccttcaatcaagaaccacttgttcttaatatggacccaaaggaatcttcctagaataggtggtgcctgaactgtcttaaacattgagagacctgtcagagagtgaaaaaaaggaagtgggaagggcattccaggaatatgtcaggactagggcacattaggcatggtgggcttagaattgcagataagagagttgtgttgttttgtttttgagacagggtcttgctctgttgcccaggcttggttgcagtgtgcgatcatggctcactgtagccttaacctcctgggttcaagcgatcctcctacctactcagccgtccgattagctgggaccatgggtgcatgccactacacctggctaatttttatattttttgttgaaatggagttttgctatgtagcccaggctgttctcaaactcctagttcaagcagtctgcctgcctcggcctcccaaagtactggaatacaggtgtaagccactgcggctggcctaattgaatatatttagagggtgaggtgtatgtccaggagaggtgaggaacaaggggagagatgaggggccatgggagtggtgagggataaggtggggaagaggtgagggacaagaggagtggtgggagataacgctcttgaatgggcaggaaccagataatggagcaccttgagcaccctctgcatgagtccacactcactgaattgttcttctgctcctttgtccccttgaggggcatatctctgttcctgattcagtggcttattctagaggactttgctgcataaccttgaggaaagcatgaaggtcatcttttcctttatctcttaatagcagatctcatagtcagctcccgtttttcccccttggtctttactcagctctctcgcctctccgcagacaaaaaaggccttctgagcaacagttactttctggccagatcagagacagactcaaaaaatgacttttcacacagttacagctgacaaagcctcagagtctcctgggttttgttatctgtccttttcgggcttcccaccagagctctgccctctggtcttgtggagatccacctggtaagctagcaggcaagctacagttgctgcctttctgctcagggaaactggtttcctcttctctgtgtgatcactttttatctgcacttctgtattagtctgttttcacactgctaataaataatctgagactgggtaatttataaaggaacgaggtttaattgactcatagcattcacatggctggggaggcctcacaatcatggtggaaggtgaatgatgagcaaagtcatgtcttacatggcagcaggcaagggagcttgtgcagagggactcccatttataaaaccgtcagatctggtgggacttaattcactaccaggagaacagtatgggggaaactgccccatgattcagttatctccacctggcccttcccttgacacctggggattattacaattcaaggtgagatttgagtggggacacagtcacaccatatcagcttctcagtacaggagcactagtttatatggctatttacatttcaatttaattaaaattaaataaagttaaaaatttcattactcatttacactaaccacatatcaaatgctcagtagccacatgtggcctagtggctactgcattgagcagtgcagatctagacatttctgtcattatagaacattttaattggatagcactgttatttgattaaaaggtgaatgtttttaatttgtaatgttttaataacaagggaaaatttaaggtgaatgttttttttttatgctctctgattaaaacatttgccatttacttgtgggatgtatctgattatgtgagaatggatacttattttcattttggcctaaatcataggtaattttactgaaaataaaaattttatgtgaaattgcaggaaacctggcaacgcaaatatagatgatttctttttaatgggaagattgtgttgattctttgataaaatacattgagcacgtgttctctatttatgcactccttatgttttactttgcagatatttctgttgattgtcttcatgtgtataacattactgattgccagcctcatctgccttactttaccaggtatgagcttgtgctagccttcagctaatagcatcattaaggttatttatttagctatttgacagagtcttgctctgttccccagtctggagggtagtagtatgatcatagcttactgcagccttgaactactgggctcaagcaatccttccacctcagctaggtctatagctctacttaggaattcaaaaagtatagtaccatattaggaagacaatctgtggaaaaaatatactggaaatttgggtcttactgttctctctagcctattgagaagtaatcatataaagtaagttactaaattatgtaaatggtcttatccaagtgattgttgtgggatgctatagagtttattccgaacaactttttgtatgaggcactcccttagactgctctcaaatccatttttcacattccagcatattcagatagtcttaactttttctaagaaaattaatatggtattctttgattattgtgctttaaaatgttattttgcccactccttattaaaataagcttagttttctgtcttgatgaatgagccaattggaagatagttactctaaattatttgtaatgtttctacatattaaaagtattgacatcacaaataagagaagaaattccccacttttgtcctattatttgcataacagtttcatttggtgataaaaacaatgaaaacattaattccctcaaaagcttttttagacctaaaagaataagtaattggcatgacaaatcagagtgtatgtcccagtagagctcgcctccattgaacttaccttgttttggttgtgatttcatcaaattgtgtactctttagacattgtgatttttgtcttttgtttttttgatgaagacattgatatatcgaatgtgatatctttttcctaatgtgaaaatactaacataacaacatgaagatgacaattctctttacctagccacatgtctcatttatcagcttttctattttcagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatggtatgtgtgtgtaatacaagactgatcttgtatgttaggaatagtgaatatttttccagtcatcttaaatttttttttttggcacatttatttccttactatattgtttcaagagagttgattttttgaattagaagaaatactctttcaagatagtggctttctggttcattcttgttcagagtcctacgttcagatatatgaggtttaaaagaaaaacaggttgggcacaatggcgtatgcctgtaatcccagtactatgggaagctaaggcaggaggattgcttgatcccaggagtttgagaccagcctgggcaacaaagcaagaccccatctgtattttaaaaagtatatgtatataatatatttttactggatcatttagtagcatgtttttctttatacacgtgcatgcacacacctacacatgcttatattacttacttaagggccttactggacactttgtaacattattgctctcagtaacacatatgactcccacaaatgtaggataaaaaaaatactgtaagatgattatctgagtgcagtgatttatgtctgtatgtgtgtaatgttggctgcaactggtaactatgcttaggttactgcttacaccttttcatttgtataatcaactcttaattttttatcgatttatattttgattttgatttcattagaagtttaatatccatttaatattaatgttgaagaaaaatataaaatccatttttatagtgagagattcattatatattatggaggggtataattgctatttaatccataagataatgagacaaccatatttaaaatacagaatccagctaattccagttttcatttgatagtcttccacattattagaaagtgccatatagagaaacaagtattttgtcttccatacacatcatatttagtctcttgttgaaacaggtgtgttttctgaggccacctgaagtaaaagagaggtcatgaggatccaaggccactttaaatcattttttttttggtcagaatttcatcattactcttttataatgtctcctctctgtgtcagctttattttcattttgccatttagtccagttgctagagctgcactatctggtatactagtcaggtggctaaatggctaccatatttgacagatacagggtatttctatcagtatggtaagttctattggaccatgttgttctttgagggagccagtttgatcagctttattaattactttaggattgtgcagagccctccctgtataccagtccacctcaaagttcacagatcagcctgtgtatgggtgggccaccgttggagcaggggccttggccagtcggtagcttttcttgggcaaacagaaacctagtcctaagaactggattgtgagaaaaaaacagcccagccagctgtgtgctttttatgtaagagacttgagtacctgcagattttctggatcctaaaaccagtccccgtggatactgagggatgactgtggttgctctgttaggcatcagtctcaaacctcaaaatggaaatagagtttggctcagaaagatcctctttaatgatgtgggctcctgtttcctaatagatcatgaagactttgatagttgcggtgctgttggctggagttgtccctctccttctggggctcctgtttgagctggtcattgtggctcccctgagggttcccttggatcagactcctcttttttatccatggcaggtaaatgtatgtcttttgctcatgttatttcattaaggatttgagatcagaaaataatcctagccaggcatggggcttacgcctataatctagcactttgggaggctgaggtgggaggactgcttgcacccaggagttcgagaccagcctgggcagcatggcaagacctagtctctataaaaaattggctcatgcgtctggtcccagctgcttgggaggcaaaggtgagaggatcacaggaggttgaggctgaagtgagccatgttcatgacactgcactgtagcctgggcaacagagtaagagcctctgtccaaaaaaaaaaaaaaaaaaaaagacaaaaggaaaaaaatataatttttaattattttaggtgattttaagcagctggtttagaaagactaattttttttttaattctaggaactcttataaaattgtttaatgctctttaatctttcagaatatgcaggtcttataactcctttaaaagtgcttactttataggttaaaatgttactaaccatttagtcttctctaatacttgaaaatacaaattaatagtcattgatttttgttcacctttgaggtagggtgaattgtcttactccttttgacttggaggctttaatacttttgaattattatagcatgttttcccacaaagtcacagattcattaaaaagagtatcctggctgggtgcagcggcttatgcctgcaatcacagcactttgggaggccaaggtgggtggatcacctgagctcaggagttgaagactagcctggacaacatggtgaaatcccatctctacccaaaatacaaaaaattagccaagcgtggtggtgtgggcatgtggtcccagctactcgagaggctgaggtgggaggatctcttgagcctgggaggccgcggttgcagtgagctgagatcatgctactgcactccagcccgggcgacaagagtgagaccctgtctccaaaaaaaaaaaaaaaaccaagagcatcctgagggaacccatgtaagtcacagcaaaggtcttaaagctcatggaaaaagaaatggaacttttctattgtatttagagcctgaggtttttaacatcatagaattaagatctcaagttcttagtaggtattgggggaaaagagctaggtattgacttcagtcattcaaaggctttttagctttgtttttatctgttagtatattgcaatggatttttcagaaaatgaaaattatttggcccgtatttccctttttctgctttccagatggagaacctccacaaacttcatttacccgaaaatttttatttaagtgcttttaatggtgtacccacaccctggattgtatcacccagatgaaaatgaggctagtgcagtaattttcctgaggaatttacacactctgatgggaaagctagacaggtacacaggtgttgtgtggtgtgattaggggaagcacaaggaactgtggcattgtgtaggagagacatttaatctagctttgggagtttcaggtatggtgttccataagagatagtatctaagccaacctaactagtagagaacagagaagtgggtaagaaaggaagaagtatattccaggagggagatgggcagacctggcttgagacaaggcatgcatatgtggggaactgcctcctttctagtctggttcatagactagaataggtgagaaataagtaatacaaagaagtacagaactgacttgtgttttgatttatgactttttaactttttgatggttgaaagcgatacacattcagcagaaactgtactttgagtacttctacagctattctgtttttcactttcagtatagtattcagtaaattgcatgagatagtcactacgtaattataaaattacgtaggcttgttaggcctcagttatactacaaggcaaaaaataaaataggttttgtgttagaagtttttgcccaactataggctaatgtaaatgttccgagcgcattgtgataggctgggctaagctatgatgttcggtaggttagatgtattaaatgcatttttgacttacagtgttttcaattacagatgggtttatctggacctaacatcattgtaagttgaggaggatctaattaagcatatgttatgcctttctgtaagagccgtattccagagtagtcaaatagtatctgtaattgaaggaaagagctaccttttttttttttttttacagaaaaatgccagcaaataaaggtagagagattaacacgattagaaaaatactattttgcaatacctaacaaaataattgattatagcaaggattgttaatggatgttgaacccaacagatgaaaggttgatcagtcttcagttgctattgctgtgtaacaagttatcccgcaactttgcagcttaaaacaaccattttaattttgtccatagagtctgtgggtcagatattaagacagggcatatcactttgcctctgctttgtgctatctgggactcagctgggaagattcaatggctgggaatgatttgacagttatggatggaatcatttggctggaaacacacaactagtggaggggtcaggctgataataccctaacccagtcagtgatcacttaacagtgtgagagttgatgcttgttgttggttgctacccatctggggctgttgactggagctcctatatgtgcctgggctgcttcatagctaagtaacctcaaggtatttgggcttcttacgttgtagttcagggaaatgagtgaccccacaaacaagaagctgcatcatctttaatgaccccatgtcagaaggcctacaacatcacttttcagtacattttactgggtataagcaagtaacaaatgttggctaagattcaagggaagaggacatagaccccctaccacatgatgggaaaataatttgcaggtatgttacattgcagtgtgaaagtggttatttgaatggtggcaaagtgtcaccttatggattactttatggctcaaagggaaacacacaactagtggaggggtcaggctgacaataccctaacccagtcagtgatcaagcaaagtactgctgcaaatgggacaaacagatactatctgccttttaatgttacgcagcatgagccctggaaaaggccagagcatcccgtggcatcaaggagccatcttggcactgttagccaggccttagtgttctcctgttggacataaacaatttgacagaacatcaacatcatacactgtcactctgtgatcaagatagaggaagacaaaagcaagaccctctgcaatcatgtctgaacacagacagaacaggagcattattcaaaccacagaaatgaccaaacattcccctttactggctaacatgattggttactgcctcattaccaattacagttttagcttctgccactttttctagataagatttatttattaagataaccattcacagattactctgctttctaatagcatctgatacagaccaaattcctgcttcttaaatcctcccccaaatccctaacataagctgaaatcctgtaataacccctttctagcactcttactgaggggccccaagttctccatgatgtgttactcccttgctgcaatgagtaataaatgcaacttgttctagttatacttgtatttttggtggtctttacagtactcagcattacttctgaaatcatcatcaccttagagaattctttggtactatcaaagtttaaaaatgcttatatattatgactcagcagtttggcttttcagaatctactgtgaggcatgagcaaggctgtttctgcaaatacatcattttttatagcaaaaaatgagaagtgatctagatgtccaccaatagagaatgcccaaataaaatgtggaatatcaatgcagcaattgaaaaaatgaagtagagatatttgttttgatatcgatagctcccagacgtgtttctgagttgggggaaagcacaagctgtagacagataatgtgcagcgtgctatccttaatgttttgcattaaacccccaagtttttgaaggaacagtttgctttttcttaattcatgactttaagctacttgcctttcctgcagcaagtggctgcagctccgtgggatagtgggccagttggaattctagcagagcagctagtgtggtgtgtcctgtctggcaggagaggactgcaaagcagtgggtttttggagaacgcgaatcacagtgatcttggacctccttgggtaaacattaatctcatttgggtgtctgctggactcccagaaggccaagagaaagctgaattggtgggttgttgcatcttccctgcctgtgagaaaaagcagggaggctttcttcatgttcctcagtaggagactgttggagggctatcccaaaggtctgaagacgtaaaagatccttttgaagccctttaggatattctcagccaggcccaagcctccttgaggctgcagaggaaattataacaagtgctttatatgcaggaggcttagcagccgcagaaaggaagttaaggcagagcagtcagaacacatgccagtttgacagcactgcttgcagagccatgagcttccagagagaagaggaaatacacggacgccgagtgcagtatgttcacacgcacatacaaacagcagctctaaagcagaacgcagttgttgtggagctgtatgacatagatttcagacaaatctagtagtgaaaaaagatgtggacagtcaccactgggcttggcttggaggcttggaagatgaatgcaaagcactgggcaaaacggaagaggaaattgagaaagagaaatgttttggaggaaacatctaggagacttagcgtactgataacgggggttccagaaggaacaaatgtgaggcagcattgatacaaaaacaggagaaaatttaactgaattgaagaaagatctgattctgtagtttgaaggggctcatgagatttggtaagattgagatccaagataaaaacacgtaattgggtatatcttattagacacggggaaatcaaaacaagcttcaaaaaactgcattgtcattggactttttttctgtagcactgaaaaccataagatcagagaatttatagacgactgggtaaaagggacaaaagccaagcttcctctacccagacaaaaaatcatttagctgttcacctatcagggtgaagattgatatttgagggtattcaagaattcagtgtatgtatcaacctctcaccccatttgaagaagatccttagaataaccaatcaaaccagtaaagaaatgggaacattggcctcaagatggtagacagtgaagaggagaattaacaatctgagcaaagtccatatgaaaatgatactacatactttctatgggatatagatgtatagatgcagctgaatgcatggggaaaaacatggatggtatgtaccaaaagctaatagtggttattgctggggagggatcaggatttaaggtagtgatcacagaggactcccgtcttttctgtaaagattttggttttatgtaagaatcagtctaaatgttacatgtggtttctttttttttttttaataccgttttttgttgttgttgttttaaataagctagatagagaccaggttataaagggttttgtgtgccttgctaaggacttcagggttgttaagcagggaagttacgttcatgatctgatttgcatttaaagagatacttggtggtggtggggaagggggctgtggggagggaggaagtagtcatcactctgtctggtggagagctggagggtgggcaggccaagagtccgttgcaccatgaggaggaacctagtaacagttccccagtagaaccacaaatgcttcaagctagaagctatctgtgagcctttagaatggtttcttaggccaaactttgctccacagtcttaatttgacataaatcagctcacttgaaaccaatgaaatagcctaaagatagtttgaaataaaatcttggcatttattttatttgctttttgagatatccattaatgaccagactttctctaactcttgggaaaacaatatagatttttaaaagatagaagaacaatttttgatggaaacattgaatttgagctgttgaagaaaaaaaattctctgggttttcagtacgttagtcttttgtaaaattgttgccaatcctatagaacttctattttgatgtgaaataatgtaagaaaattatacagcctctctgctgtgtttattgttaaaaaacaacagaaatatgttaaatggtttttaattccctaggactgggcacttggagtcctgcatgccaaaatcattgcagctataacattgatgggtcctcagtggtggttgaaaactgtaattgaacaggtaagcaaaatcagttttcagagaaagacattctggaattggttgtgtttatgtttggcagctataactcttatttcttatcttcctaccttgctgagttttctacattttttttgatgggcatatataacctttttttttttttttaaagacagcagtttagttttaccactgtaggggaggaaaataatttgttctcaacccttgttttttttagttaaaatggaaccctttaataaaagacaacagaaaaacaaaagtttattaaagtacatatttcatatatacatggagatacccagggaatgagtaatttcaaagaggtggctttgaattccaacgaatcttcaacaaagaataataaatttttagagaagtgacaagatgaaggaaaaggactttgagtctctaggggtggcaagtgaggggaagcaaaaaattggcagatgcggctccttagtaaagcttggcagtgttgattcctctggtgccatctagaggcccagaaaggcccaaagctctcttcagtgggtaatctttgtccttcatggtgtagggaagtggggtgggctaccttttgtctttatacatttatattctgcttctaggcaatagagggaggacggaaagttttcctgcatctattctttctcagttgcattcaactcaaaacaatccttatgcctaagaggcatatttttagggtggcatattgtggttttctatactcccatgaattttcatcaaccacgtttaagccatcctttatctgaaggttaaccagtagcttacggtatctagaaccctgttcatagtggagacaaaaatgaaaatacgtgctttttttctggtgaaggttgatattaatgtttctaagcctgtagtagatttggagtgggggaaaggttattgctcgaggtaataaaagaagacagaggaaaaaacattacaaaaggagagctgttttggcttcatctagctacatagtacctaagactattattgtattacagaactgccagataatttgattgttgtgggaataccttggaaaaggtagactgtgctttagcactccgataataagactagaaagtatggtaattcatttaaggaaaatttctatccaaaatggccaacataacagattttgctgctactttacgctttagctatatggcaaatgtacttgtggggacccctcttatccttaggccagtgccacataagtaagacataacagttctgcagcagtaaagtacacctctttttgctgtatgagaagtaaagacagtagttagccaagcatgctcaagaaaatctgttcaaaaagtgcctgtatttcaagattttgattcttaggagtaggggggttagggagccagcaaattgcagtgtgtttgtgtgtgtctctaaagtatgggctaattctgaagtccaccaggagtgtgatggattgggggcttctggcttcatatcccttcaggatcagagtgcaggccagtacactctagaatggccaggttagcctctggcccttgaaaaaggagcatggagatgggatttattcatactggaggctgtggaacatcattgatcttctaaataatttgttatcttattcattgttttctcttgcgtatgtgcgtgtgtgtctctgtaaatttaagaaaaatggttggaaatggttgagaaacactgggatgccttgcttcattgattaaaatgcatttgggttaactaggtgtctttgggaatggcagcatgcctttaaaaggttaagcatgtttgccattcaaattccgaggtgatggggttgagttatgctacattcagtcacagctaagagaggtttaagtgctgctggtgaggcaagaggagaagaaaataacagccttctaagccttgtttctgtctgcactccatctaaattttctgttcccagggttttcccatttccatccattctttcctctgcattactcttgtagaattttctggataagatgatggaaatattctagtaattcttggacttgctttttttatattcactatagaattctttcatactaaatttttaaataccttttgatttgttaaaatttgatttatgcaagcttttcagaaacgcttcctgcttcagtgttttctcatcatactcagataaaatgaatgcaatattgtataataacacaatattacatattacgtatctctttcataagatgtatgaagttacttcaagtaatgtggtcttgaatgaataccactgaatgtcatctggtattgtatagtgcaagtagagtataaattattctagattagtgtcttatttcatcacttagcagagctaactgcagagcgttagtgggtaaatacatttcttcagaaactcgtgggcactatgcttatgttgatataccagaatttgccttgactttagaagaagtaaccagtttgactatttttgggttggcagattcagttgtgtggagattgctgtattaacttggaggaatttgtcttgtatctttgttctaattgctttttgtaatgtttcaggtttacgcaaatggcatccggaacattgaccttcactatattgttcgtaaactggcagctcccgtgatctctgtgctgttgctttccctgtgtgtaccttatgtcatagcttctggtgttgttcctttactaggtacgtaatgctggttgtggagccttgaaggagcacttttattaacattggacattctctttacccctagtaaaaaggatgtctcactccatatgctttatttgtaaatgtgaatccagctaagacaatgatttcaaaataccacttttcttagatttgactattctgggtaagattagaggatcataaagctctttgatacagttcttttctctaccagaagataaaacttgaaatttacatgctgtacaaaataggcaggatcagatttccttcaggttgtcttcttctgactagaagtgctgtgatcatataaaattaagtaacagtgttgttgtatttaagttttaaagaaatattctttggcataaaagatccaaagaggagatgctaatgggcaacacgtttatactgaaatacactgtcttgttgattgtgtagtgaagactcctcatagctccttaaacccaacatattttcaaaattataagcagagacttttccttcccaaatctttttcttctccagaattccgtctctcagcagcaaacattatcatccaacaaattgcataagtcagaaaccttgaaggctatccatgtcaccttattctgtcctccatgtccctctggtctccaagtgtcccattcttccctgaagaatctggtctctcgtctctggagcctttgctcctgacttttgttgagtcattcgtctcctaccctaactttggcaccttcctatctggtttcccagccttgaacctgccatcactaattccttctccacactgggcacaatgacctttcaaaagaatgaatctcattgtacctctttggtgaacatttttttcattggttcctctgtggcctttaatgcagtccaaccttttggcatagtttacaaggctcctccttttgctttgatgtgggcttcagtttgacctcactccatgtcatatactctgagttttgattaaacaaccatggaatggcctcttatcaaacacacaatgtcctctccataactgtctccacattttcatttgtcttatccatctgccagaaatgaccccgtcctccctttaaccgtgagagaggagcttaaaaaaaacacacaaccaaacttgcagtgtaacatgtatacttgtatgttaccttactaggtcaagaaatagaacttttccagccctttggaagccctttgtgtgtgtgcccttctttaccttttgccactggtttgacttctaatagtctcattgcttcttagacagtaaagatattagccatgtgcagtagctacttgggaggctgaggtgggaggttgcttgaagccaggaattgaagaccagtctgagcaacatggcgagacccaacctctaaaaaaaataaaaataaattatctgggagtggtggcgcacacctgtaatctcagctgccctgcaggctgatgcaggaggattgcttgaacccaggagttcagggctaacctcaggttgtgacactccaatctagcccaggcaacaggccaagaccctgtctcaaaaaaaaaaaattgctcaacacaggtttgtatagagagaggctgagcaatgtatccctcagtctgcaggatggcatgggaaacagggaacagttaagctgagggcccacagtgtgcaaactgcatcatttcctggttccttctaagtagaaacttcaaggcttttatttggtttgaattgtgactatgccaagtatcataaataccatattaaaatgcaaatatatatttcctgcaaaatatatttcaaagcccattgctttttagttttttttttttttttttttttttttgagagacggagtctcgctcttttgcccaggctggagtacagtggtgcagtctcggctcgctgcaacctccacctcctgggttcaagcgattttcctgcctcagcctcttgagtagctgggactactggcatgcgccaccatgcccagctaatttttgtctttttgttagagacagggtttcaccatgttggccaggctggtcttgaacttctgacctcagataatccacccccctcggccgcccagagtgctgggattacaggcatgagctaccacacccagcgcattgcttattagttgaatacgtctttaaaattaaattattttgactctttagaacaatctctttactggttttgtctagagtaggaatgccctattttcttttttattctaattagcatatattatgttctgcccattaatagtatatagacttaagaatttggatttccaacccagtcattcatgttttcatttttaaaaattttattgtgagcatttctggaaagactttggaagggaaaaagagtggcaaatgaaaaatgttggtacctgttttgccctgtttagatgctttatgtaattcttacatgttattcttagggtagctttttaatatgttttgtcaactctgttttagaaatgggaaattgaggttcatagagattgagaatcttaccccaaagtctggtttttaaggagtaagagcagcattcagatttcaaactcagctccagagcttatgcacagcacactattgtggtgtttggaataatccacctgacggtattaattttctgaattcctcgaaagtacttgctctgattttaaagccccccagtcccctctgccaaagaagtattaaaactcatgagttaaatatagaaaaataaatacatgtgtgttctaaaagtttgaggatttttttattatataagcacagttttggttttgcttctttaaactgtggtgcagtagaaatgtatcaatgacaccactgcttgtggaacatgagaagtcatctcgtccagttcctttttttttttttttttgaggcagggtctcactctgttgtccaggttggagtgcagtggcttgattgatctcggctccctgcaacctccacctctcaggttcaagcgattctcccaccccagcctcctgagtagctgggactacaggtgcaacgccaccacacctggctaatttttgtattttttggtagagacagggttttaccatgttggccaggctgctctagaactcctgacctcaagtgatccgcccgccttggcctcccaaagtgctgggattacaggcgcgagctactatgcctggcctccttgttttacaaatgagaaagttgggggtcagaaagggctcatgacctacacagattgtagaaagttaacagacctggggcttagaaagcttgtctgccccagtccattcttctaggggaaggacatgtttacgtttcatgtcactgttatttcacatacactgaaagtttttcttttttggttttctaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaagtctggcgttctgttcgtctcttgtttaagtgttttcacttcttaatttatgtatctgatgtgacaaatcataggagggaaacatgctcagattctggatatacttggaggtgggattagcaaggtttgctgacagattgtgacatgtgaaggagagtggaatcaaggacttagttggcccaaacacagggaatatggagttgtcatttatggagctggaaaagactgggtgaaactgttttggagagggaggttttttttttttggtggtggtttttttttttttttttttgagacggagtctcgctctgttgccaggctggagtgcagtggtgcgaacttggctcactgcaacctccacctcccaggttcaagcgattctcctgcctcagcctcccaagtagctgggattacaggtgtgcaccaccatgctcagctaatttttgtatttttagtagagacagggtttcaccatgttggctaggattgtgtcgatctcctaacctcgtgatccacctgccttggcctcccaaagtgttgggattacaggtgtgagccactgcacccagccaagagattttttaatgtccattccaaatagtttttcagtctgttttcaaatgttctggtctgacagtatattaaacagttttagataaaaataagaagcctgcattagaaactagcagtgcctgcataagcccctcttgcttatagagggccactaggttactctgaggttgcacagagaggcttgagggttactgcaaaaatgttgtgggactctctgttttgaggaaaccattgaaaactctgtcacttgatctcagtgagagattgaggaaagccaaggaaaacaccttcctgggataatatttgacctttatgtccgaactgtaggctgaatcatctgcttcaatgggttctagcagagaaagtgagtttatggtttatccatctcagtcggccaagagagtcccagtttatacctgctgcctttgtgtcattaacactacccccttttacttgtgcttgtccccccttgcacaacaaattatagagttaccttatttattctgaggagtaagatttttgagaatgaaatttatagtgttcaagacttctccaaagcatttactgacagtaaaaaatacaagtacacttaggcagtcagagtacaaaggactgtcaactgaaagaaggggaaggggtattttcaatgatgaaaatcaacttcttagcactcaactttttggcagaggagtaaatactgcaaacagaatgacaagcaagacgtgccctcagggaactttctacctgcttctttctttatgctggatgcctgcctttctgcaccctgcccttctcagcctttgccaggggtctagacgttcccattgacctcttctttctcatgctctatcttcttctgctttttcctgtagcccagtgtcctctttcctcttttcccatctgttcctttatgcagaaaggtgttgaactgtagacttaagtgagggcatgtcttgtcagctgttgtatatgtactctttagcacagggtttggtctgtgggaggtgctaagagtgagtgagtgtgtgtgtgtgtgtgtgtgtgtgagagtgtatgtgtgtgtgtggtgggcttgagtatgagagagtgagtggtggtggaagagagggagttgggttcagagtctcctttctctgccactgaattactctttggacttgtacaatttaacttggtttctgtatgctttttatttacttactttgtcattgccataatgctgaccatatttttagtgtatcttgctatttagtcattactgtgtgccaggtagtgctgtgtatattttagtagatattgctcagccttcactgtttaaaatatttacaaaattctcaaagttttaaaatcagtggttggttggggaacagtggggtaaggaatggctaacttcaagaaaagaaggtaagacaaaagaaaaggaataaaacagtgacattatggataaagatgcagtaagattagcgtacttttaaaaaagtgacatattaagctactggacataaactgccaaaatatttccttaggcttgtgtgcatttacagaaaagtgatagataaaagtcaaggtagagaaggtactggtgaaaagtaagagttcccacagtgagcccttacaacatgctaagcctttgtcaccgggctgcatacactttccctttcttaaaacaatgctgcagcgtgggactgtcggtctcatttcactgatgagtaaatggaggaaagggacgaaggaaagctacctgacagcctgtcatgtgcaggtttcactctccctcagtctccttcactcaactctgtgggcttttactggacattctccctgatctgcatctctgcctccaaatgggtgcccttcacacttgtgcccagccacctacagcttgttgctttccagctttgtccctgctgtcctcttgggatcagcctgcaagccatctgctcacattaagtaaggcaggccttcagtgagccttcgatgcagctgtcgcccttccctggcattggagatgtctgtctccttgagtaggatctcctgccctgtcactccaactacagtaacatctgccttgtttctgcagccctgtggcctttgccattgccttctcctttcatcacatacataagttaggaacacttgccattctgttgttgaaccatattctcccacctcctgtcactcatactcactcactgcaatgctgtcttccctttgacttcactgaaatttctcctttgatttctcctttcttctctgtaactagaacttccagttttactttcatcccttcctactttttttttttttttttttttgagacggagtcacactctgtcacccagactggagtgcagtggcacaatttcagttcactgcaacctctacctcccaggtttcagcagttcttctgcctcagcctctctagtagctgggaccacacacacccagctaattttgtatttttagtagagatggggtttcaccatgttggccaggctggtctgaaactcctgacctcaggtgatccactcgcctcggcctccctacgtgctgggattacaggcgtgagccaccacgcccagccccttcctagctttctgatggtcatgtttttagtctgtctccttagatctgcccactaagttgttttataaaatctgaaccttaacagataaatccactgcataagtttactgtatccctcctggcctccacaggtctgagtttctgagaccccctaaaccactgactgaagcatgtcctccattgcacagcattggaggccttccagcctgtgctgcttctgcagcttcctacaaacccatacctaggtagatgtgtcagcctttacaggtgttcactcgggactccctttgacttgcccaaccattgacgagttttaagtaggagttagatttaaaaagacatatgaatgttttactctgtacattcatagaagagagtaaccaccttgtttttgcaacctaggtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgtgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtaagaaaacatgaactttatgcttcactgttagttgtttgtggaagttattttgtataacaccaaagctgttgtacatttcctactgcctgatttttttcatgtgtctgtgtttgtaatattgtatagtatcttgtgctaggtgaggaaattatttttaattttgataatttaatattcctagtgtgatcagcattgggagttgggtttcagtggggcatgtctatacttagagaaaaaaagtccaaatgaagattttcatgagtcagcccccccgcccgcccccaccccacacccacatcctctcttttccacacacaactatctgtttattttttgtagcagtggccgaaagtcctgcaaggtcataaatctttcagagtgacatcaccaactgtactgcatcttactggatttaggacttctgagatgcttgtgaagtatagatgtggttgtggtcttagattgacagcattagagaagactggttagaacatctggtctcgctggttagtgcctcgttggctgaggactaggtgtgcatttctcctagcttttcatcaggaaatcccaaagtttccaaagctttttgtttacagaataaaacttcaaataaaaccaattcattatttgtccagaaggaagcttggctgagctggccttttaacataggaatgtatttcgttggaaacattctgaaaaatctcagagaactgaacccttacaaactttgttttccctcataaccaaagcttcaggttagaagtttagaaaaatagaatggttgggtacatgatctaaatgtttaatgctaaaggtatatcgtaagggtagtgtttgtttttgaacgataatttagaagttctcatagaaagcgtataacataggtcttcagaaactataaaagaattttcatatagtattaaaatccatagactaaaatctgagaattttttaacatatgcaagtcagccaaacataagctaccaaaataaagagcaatgtgttctggctgttttatacttcaacaattttttccctaagtggtaagcaattactttaaaacatatttttaaaaacatcggtatcgggagctgcggtggctccggccggttgtcctggcacacaaggaggcgaggctatgcgttcgaggccaacctaggcaaaattggaaaaaaaaaaaaaaatcagtatcagaaataatgcttgacataggattcagtgttatactctttggcactttagagcagccttttctctcatttgaaataaggtctttgttagccctacctttactcagaaatttagtcctactataaaaaattaggattttaaaatataatgctgcctgtcatagtgtatttctaaattgctctctttgggagaaaaacattattattgaattgagcatataactatataactatataactatatatatatatatatatatatatatatatatatatatatatatatatatatatatatttttttttttttttttttttttttttttttgcccccgagacagagtcttactctgttgcccaggctggagtgcagtggcacgatcctggttcactgcaccctctgcctcccaggttcaagcgattctcctgcctcagcctcccaagtagctggtactacaggtgcgtgccaccacacctggcttattttagttattttagtagagatagggtttcaccatgttggccaggctggtctcggaactcctgactgcaggtgatccgtcctccttgggctcccaaagtgctgggattataggtgtgagcccccacgcctggccaacttgattatattaattttgggttttttgttttgttttgttttgttttttaatttttcaaagaatttgtggatcttggtataaagtcattggaacatatctgttttaacagcaagagatcctaggcagatacttcaaaaggttaaaaattcttaatcctacagaattttaaatgaatcttatcaatgttttgtaaacaaacaatatgaatggccaaaaaattgccctccattttactggcaggtaatttatattgtcttacttaagaattctcccctagtttttcaattgtactttatcgtgttgttttcaatgagataagtattttcatagggaaagcattttccagcataatatttgcttgggtagcatccgggttttagtatttaaccaagagccttttaaatattgaaaacccatagttcagaaaatgttagtattgctgcccttcttcacataaatttttttttaaattatactattattttgcttaattttatattgggttaaaacaaccttcaagaaggttaactaggaaagaagacctttttgttttatttttactatttatatatagaagacaaatcagcatttggtgatagttttacatgaccagttatcaaacggtcatagtatgaagtgtgcagttgttcattattagtaaattatgtttgatttttaaactatttagtactaatagttgagatgaaaactgaagaaaaatgccaatgtgacgtttgtgtatagctagccttaaaaaacttcccatgtttttaggtgacttttttccccctcttagtactctggagaaacaatgaagatgggccatctcaattccagatgtaaacaaaaagtaatttttatttcaacatttaatgtaactgctattattgtggattcttgtcttgtgtattttctttcccttattcaagtaatatagaataactttccttaaaatgatttgatccaagatacgtcatttctgtattggcaaaatgccactattaaagtgtaattcttgaatttaggttgaattgatgactttttaaaacaaaacaaacactggacagttctacattgtattgcgtttgcgaatgtgcgtgaacacacgcacacgtgcaggagaatgtagtgccataagaacactggcgctttttaaaactttccaagctagctacttattttcattttcagggttgagtactctaagctctctacttactgtgagaagttttctacattgtaaaattaaaagattatatttaaaatacttctttaggatgttattcagccatcaaaaaaaaacccaactaaaatgtcttaccagtaaagtattattaaaagcctcatttgtggagattcgctgacttccttggttaagctgtcttgtatttacttaatttgtcccctcaaccaggtgttttcttttcagcctgttactgtcctgtgccatttttaaaaatagccatcatgagtaagggcttctttaaaataatccctgacaatatctttggcattaatacgacataaagacaagacagtatatgtatgttttcattcctgttttgtacgagtgcctcattttgtagtcatgaaagtaacatagtaccttaaataaaaatgtaatgactaatctaaggtctaggaataactattgtagaagctaagtagaacacttagtttggggtgtcaattttctatcaacgcaaacaccttagggtacccagaccaattttatgtatatatattctgaaatgctccctttttaatgtggtcatttgttgccttctaagttgagaggacaaaactgaataaagtgaatgttaattgtagtctagtttttttgtttgtttttgtgttattgcaagattgctttaagattgcagaaatatgcattattagccagcatagataatccagatgttataataggaaggaaaaacaactccagttaaatgtgactgtggcgactcccttttatgtatacatttaaatgcatagttgcagaggacacatccctccccttctgtctccctaacttgaactgtagaccgtcctcactgggaagagtaaggccccacattttgtgcaatagcaagctactgcccacttctgcatgtctgctacgagatcagaaagtcagtttcactaaggttgtcttttagctgaatacttagagtaaaaccaatcaaatccattgtacatacctgaccatatgtcccagataaaaaggaaagacttgcgtgatgtttttttccttctgagtgccctgaggagatccttttgcttcagactatttctaatttttctttgtttataggttcagaattttttccatgattgttttcccccaaacaagtgcatttttaattactttaaatgcaggggtgatagaggaaatgctattcgaaccatagacatctttaatctgtgaagctgaaatttttcagcaaaggaaattgcatggtcaagttcagaaactggccattaatttcccccttccgctccacagttcatagctactcttgttgcaaacatgtagtgataaggagaactaacgtatcaaggggctgagagggtaacgttcccctcctcctccatgtttttattttggtgtctgttttgtttctagcactgtatttagtactgtagttgaatgaggtatgatgtctcccttcaaggaactcagaatggaacagaagcatgagcaaaagattgtattacagaggtatgaataaaatgccatggggaacacagagaaaggttcacccgggagagatggcctagccacttccttagtgactgtttggtatatgtaggtccccctgccattactctttcagccttctgcaatctagttctacttagtcacacacttctctaagaccactcatacgtaaacactacgtagaggcccctttttgcctcattttacattgtttagttatcattttgaaacttttcttcacatatgtaacagtgccggagtttttctgcttctctgtgtttgttcagtaactcttctttaggatacacctaaagatgagaagcttcatacccagtactcctcttcattcactcatatgtttttgggatcagtcccttctgctggctgtgcattggtctaatggaacagaatagagtccagaaataacccaacatgtatgtggacaactggtttttgacagaggtgcaaaggtcttgaaaaaatgatgctggaataattgggcatcagatgcaaaattaaaaacaaattgatccatatcttaacactggcaaagattaaagtccaaatggattatagttccccaaaactgtataatttctagaagacaacaaggaaaacgtgttcagccttgggttaggaaaagatttcttaaatccaacaccaaaagcacaatccatgaaggaaaaatcgataaattgtactttatcaaaattgagaacttctctttgaaaggtaccataaggagaacaaaaagacaagctgtagagtggcagaaaaatatttgcaaaacatttctgataaatgagttgcatctagattacataaagaagtctcaaaactgaacaagtaaacccattgtttacttaatcgctgtttctcctgagcttgctgcctctgcccctgctctctctccttttccatttgttttcaacattgaatccagaatgttcttcttgagatccaagtcagatcacaccaaccctcagaactctccaatagacgaccatggcactcaaaagtccacaatagccttcaatgctgggcaaaacatgaagcaccccttttctcccttctctgaccccatcacctctgtgttcaccctgctcctgccgtcctccctgcctccaaaacaggtcaggccttcgtgcctttgcacttactatttgcaatacccaaatgttcttcaggctctttagcctcttcatttctttcctgaagtgtcattctcactgaggcttatctaaagctgcagctactggggcattcctgtctcatctccctgctgtattttgtactcccggctctcttttgtacttttaaacatactatatggtttacctttgttgtttatatttgcatgttgtttcccacttgaatgtaagctccaaagattttatttttttaaactgaattattactgtattcccagaacaattccctggcaaatatttggtactcaatagtaatgctaagttagtaaataaatgatgaatttagaatcaaaataatgtgtctatggccaaaataaaacctgaaatccctgtcctatttcccagaggtaactgctgttaatagtttagttgtgtgcttccagacataccttcacagaatcatttatcacaataaaggtgtcatactatgca

SEQ ID NO: 787 - DNA, 86751 bp, Homo sapiens; identical to SEQ ID NO: 786

SEQ ID NO: 788 - DNA, 932160 bp, Homo sapiens
cttttgttactgatgtttttattttttccaagaacagttaacatttactaggcacctattggcctcagccacttgcatctaaagagcaaagctagtttacccgcggcccatgttcttttcgatggttagccttatttcttagctctgttaaccactattctaacgttagcttcaagttcagttttaataatctattccatagttgtgtactgctccctgccacatgaacaaaaagtttgggggaataaggcgagcagtttacattttctgtggatacttcaagtaattggccccaaagtgaaactgaattggccatggtttatcgtgttctgaggggataaaatgtgtaaggaaacggacctgtagagagggttgatatccaagtatgcgtgaatgtgtgaaaatcctataactccacttcaactggcctaatatcctgagtcactagatggtcagaagaatagatacagtacaaaaggaacaaactgatgtacatttatactaaaaaaccaaaaacaaagtttgtacaagatgaacagcaaatgaaatagcttctgtcaaaataaaatctcacacaggtaatttttctagtacgtggacatacatacacccacacacacagacacacaagcaagaatgtgtattttgtaagatataggttcttggaaatagacattcttagcaaatatggatgacagatcaattgtaatttattttcttttaacactgtatcatcataaagaaaactggtataaatgaaaaaatctatttcaaatatctacatctaaaattttaggcagtgaaaaagcactttgttgacaaggagtgtggaatgatgtatgttaattgtcagaaactgctgaatgccttgtttagttgtcacaaacaaattcacatatcagaacgaacaatactgctaaatattccttttttcctgcttttttttttttttgttaaaacatactgggagaaagtaaagaaaaactggaaatccatacatctttcaaaagtttgaaattgaagcaatatttagaaccatagatgaggaaacacggcggcattggtgtaatatacacaacgcgcttttcttctttaatctgtaatgtacatcaaatactttacaacaatgcattaacaaaaggcaagaaacatcttgctgtacagaggaaccccaatgcaacctgaagcctagagtcacaacggatgaagagagtaaacaaagcgtgagaagccgtcccccacacagtgtgtaaactattctgtgtcttgtgcttaacgataacccttacgccccaccggcccgaatgcctcgtctctcctcccatcaaccacgttcagtataaagcacttctcgttactctacagctcacgctagaaaggtgctgcccactgtcatatttaggatcactttagctttctactgatttccaagttaacttgcgattcatttagctttctaaaatagctcttaatatttccttactggttatcacagccttcctatggaacaggctttaacaaactaaatttgcaggagaaaaaaacaaaacagaaagaaatgtcttgtggtatgcatgcacatgcactgttcccggagcgcctgtgccctgctcctcacacccaggagtcgggggaggccgggtagtggctcgtttcatagttcagttcactgtagggacgggcagctgagtagaagtcaacgtagttgccggtggacttgagacccaggtgcatggtgtactcgctggcgggagggcgatggtggacctggtcctcgaagaaggactcatcgtaatttcttgtggaattctgaaatggctggtaggtctcgtaatcttttctgctgggctcctgtgggactggctgtgctgaaacctaaacgggaaagaagagccacactgggttacttggtttcccttgactcagcctgcctcttgccccggcacccaactctccttcaaagaataggctgtgtatatccaggcattcaccactgtggccctgcttctccaaaactgccaactgtcattggctttccttttgaaaattggatcctaggtccacgtgctatcattctacataatctttatcatggcaaaatatacataacataaaacagcttgctttaagaaatgttgaagtgtaagattaattaggtggcattaagaacattcacagtgttgtgcaaccatcaccaccatccgtttccaccactttttaaatcatcccaaacagaaactctgtgcccattaaatgtaattcctcatcccctctctctcagcccatggcaagcaccattctactttctgtctctagaaatctgcctaatataggcactgcagagagtgtttgtccttgtgtgactggcttctttcacttagcataaagtttgcatggtccatccatggtgttgcacatggcagaccttgatccgtttttgtggctgaataatattccactgtatgatgtgcattgctccactgatgaatgcactgaaggccatgactttacctcaatgtagcaaaactgcacttgcacccccatgattgtatatatataagaataaaatagtccatggtatgcatagaccacattttatttatccattcatccattgatggacgcttgggttatttttaccttttagctgctgtaaataatgttgcaataaacattggtgcatttgtatctgttctagtccctggggtcccttttcaagcacctgcccctgaaatgagcagaacctcccaaggtatagggtgaggttaaccctacagcaagtgcataccgggatgcacaaagctctgctaatgtgcagtaattggggaggagatctggtgtgaattattaaacactcttaaagaaatactgtttgatcacttttgggtggactcagtgactccctattaatttaactaaagttcagcacggaaacgttctctagaaattggtcttagttaatagataatgatttgtaattagcacgttgtgtgtaaatgaatgcttttaaaggcttacacataattcttctctcaagtaagtgaaactccctcttatatatgtcattgatttatactagtaatcaacctgatcttcaaagaagtggtgaacttcatcacagcagctgtctaggatgtcccacgtgtctagttagtggtagctgaatgaatgaggtttctgtctacctacagaagtccaaaagtccatagaggataaacctttgttagcctgagagctaacaaaggatgagaggaacatttggaatgaatgtgcaacatctgcaattaaatactgctaagtccaggtctactggactgcgttgctaggttggggtgccctttgctattctttgaagagctctgcttgtgtgctgctgaactccactccaacacagggctgttttccaagtgcaagacatgcaaaggctcagaatctagaagtttggaaaaattatacagggagggaactagatttgctgtgtttcttgttcagcagggcaccctattcaacatttagcaaattctttaatactccagtagtcataaatatttatgtgtgtttgtgtctgtctacatcaatatctataatctatcatctgtctgtcttcctatccacccaccaatccatccatccatccatccctcaagcaaactcccaccttatagatgagaaaactgaagcacagagaagttaagaaacttctccaaaacgtcatagctagtggtgttgtgaactggaactggaacatacggctggctgactctaaaacccaggtgttctaccaacgtagtccagtcccatcagagccaaggtggccaaaccttggaggacaggcctcaaggagctgactctaggctctaagataagaaagtcggtggacaaaagagaccaagaagcggtgtgttttcttatggatttttgggggccagggaaggcagtgcaggggacagggacatcttcaggaggagtcactcacaagggttatagctctcctccaaagtggcttctgctttcatttttttggttcttttgcacaacctcgttcaaattgctttgactgttgtcatgttctctctggttggtgaacatttgggagctgggtatcagctttttcagcctcttaccccagagaattaacttcttcattcatctgtactgttcataaaatcccacaccaatcacttctgaggtttggtgccccagtcccaaaagtgtgtacaaatgaactgtcacaggtgacacgtgtcactgctgcacccggagagacagaatttgctcactgtggtatttgctcttgtggtatggacatttctgtggtatttgctcttgtggtatcttgtggtatttgctcttgtggtatggacgtcttgtggtatttgctcttgtggtatggacgtttgctggtgaaacacatccacagtggaggaatattggctgcattttaaactttaagggaatatctgacagttgaaaatctggctgatgaaatgacccctcccaaagccctcctcacataagagctaaaaataaatgcattaaaaattgcacagtttgcatcagccagatttggatgagggatgtagaatgatgccccaatagagcagaggggatttctgaatctgggtgtctgttacggtctagagaagcccaggaatacgcaagcccgaagcttttgccttctttgccttaacgctgcatcttgttttggaaaggggtggtgaccagcagctcactccagggtcaatatgctcacgctctctgcgctctgttccatggcttctgtttctaccaagtcatctttgctgaactttttcctcaacagtagaatattcactctaaattatgaaggatagtgtcatgacaccttccaactctgttagcataatgacaaaagacttctttgggtttattccttaatgaatttgccaggaaactggatttattttgaacacaagggaaatagtagcccagtatagctcttccaacttttccatgtctcagagtgttcatagaaagactcagagtgttcacagaaaatgaaggaggccagatatgaagtatcagtggtcttcaaagcataatcccaagaccagcagcatcagcatcacctgggaacttgttagaaatgcagattactgggtcccactccagacctactgaatcagggcctctggcgatgggccccagcaatctgtgctttaacagccctttggggaattctggctcatgctccaatttgagaaccattggcacagaggtaaaaaaaatgggacaggaagacagaagaaccaagatgagtatttgcctcttcctggctgggggactgaaggaaacacgtatcctcctgggatctcatcttcctcatttctgcagacaattacaactggcctgctcacgtgacagtggaactaaggacaccaggaaggaactcaagattccggttttgttatcatttaaatattggtcatcaaaacagcaaagctctttgtttctagttcctgaacaaaaatcctgttgtcagctagatagataccgttcaacatgatatttctctttgtaattatggggtggactggtagaagctcaaaaggatgtttggaaagtatgcatagttaagtctttttttttttttgagacagggtctcgctttgtcactcaggctggagtgcagtagtgcaattatggctcactgtagcctccaccttccaggttcaagccttcctcctgcctcagcatcccagctagctgggactacaggcacacaccaccatgcccagctaatttttgtattttttgtagacacacagttttgctatgttgcccaagctggtcttgaactcctgagctcaagcgatctgcctgcctcggcctcccaaaatgctaggattacaggcattagccactgcacctagtcagttaagtcttaaagtgatgtctgtaacccgttgacctcagacattcaaaccaaagatcacgaactgtgttttatactactgattgtttcttctaggaggctttaagctcagagttcactgaaaatgtgcctgagtcccaggtcacaggagcagcacccacgtgtggccatgtgtctggtgcaggcgtctctttctcagctctcactgtcttttgccttatcttggagatccacttgaaactgatttccctccatgaattgcttccccataagctcagtcactacccagtgtgaagcctgtgagacctggctggtgactgagccacccgggagacaggagcgctcagcagaggacaagcttcgatgctgaaactgaccaaaccctggaggatccctcctggtgaaactgttccaggcgcaaagttctggggtaacttttggcccagggaagctcccaacatgaaagcattccacctagaatggttggttacacctctatggccagagaatccaagtcagggatactgtttatgagtcctctctaggactcccaaccggaagagagtgaaaacatgtcttttgaagggttaggatggttgcactttattgagtccccaaagagaaaactgcaagtgaagacaaggtttattcctataacatagtctaaaagaagtaaaatgctttctttccttcctctccaagttcaatggagtgtcattatgatctccttggaaatactttttggggaggggggggaaccctctctttggtggacgtttaaaaatggatgttaggctaagatagaatgatccaattatccacttcccttggctggtcccttacagggaatgatggtggtcctgagctatgaagataggactcagctctgccgggggcttgcctgcaatgcctcggtcctgacgagagatgcggagcttgctctccatccagggtggattttagcaacatttgcctgaggcccagtggccttggtgtttcactctgagactgagtcaagcacattctggagacctctgggagaaaggctatggctaggtggtgttcacactcatggcaaggatgccatcttagcacattaattctcatttgcttaaatgctcgggatctgcttacgtaaaaagaaggtgccccttagagccattatagactgtcctctaaatctagatggcaagcagtcttttggaacctactgcagccactctgtgagatgccagagacccctggccatgtcagggcgtttcttcaatgccaactcccggggaaggaaggctggtgcagagggagctggttccaatgaggagcttctctctacctgaggggactcaagatgaatctcacactcttggcggcaaaatcatggtcctattacaacctgacaagaatctgtaataattggcaataatctgcttactgtacatccagaatttcataatatttgctgcaagaagcatgattgatttccataaatgaagttggcatttctaatacattttgtttctgtttgcctttatggaggcaggttggcaagtgaatagttggggcctccctggtgacctggtgtctacagctcatgaccctatttatttagtcattggcttctttgcttttagcaaatactagaactgaggggaggctgattagatgttagcaacacatcaaataggccatgggggccaagccattcaccagggggtcacagacaacaccatatgttttccagagtgctgcacatggagtgggctgatgcccaccatgggaaggagagatgtatgaagtttctgatcaacgagggggaacaactgtgtcttttggcttttatagttcctgcagagccagagaaaatgagccttcaataaatgtttgcagagtaacacacacatatactctctctctctctctcagattggttccttaagaatctactgttcagatatatagactaaaggaatagaacagaggccttagaaataacaccacacatctacaaccatctgatctttgacaaacctgacacaaacaagcaatggggaaaagattccctatttaataaatgttgttgggaaaactagctagccatatgcagaaaactgaaactggaccccttccttacaccttatacaaaaatcaactcaagatgtatcaaagacttaaacatacgacccaggaccataggaatcatagaagaaaacctgggcaataccattcaggatgtaggcatgggcaaagacttcatgtccaaaactccaaaagcaatggcaacaaaagtcaaaatcgacaaatgggatctaattaaattaagagctcctgcacggcaaaagaaactatcatcagagtgaacaggcaactatagaatgggagaaattttttgcaatctatccatctgacgaagggctaatatccagaatctataaagaacttaaacaaatttacaagaaaaaaaaaacccatcaaaaagtgagcaaaggatatgaacagacacttctcaaaagaagacttttatgcagccaacagacatatgaaaaaatgctcttcatcactggccatcagagaaatgcaaatcaaaaccacaatgagataccatctcacaccagtcagaatggcgatcattaaaaagtcaggaaacgagatgctggagaggatgtggagaaataggaacgcttttacactgttggtgggagtgtaaattagttcaaccattgtggaagacagtgtggcgattcctcaaggatttagaaccagaaataccatttgacccagtgatcccattactgggtatatacccaaagggttataaatcattctactataaagacacatgtacacgtacatttattgtggcactctattcacaatagcaagcacttggaaccaacccaaatgtccatcaatgatagactggataaagaaaatgtggcacatatataccatggaatactatgcagccataaaaaaaggatgagttcatgtcctttgcagggacatggatgaagctggaaacatcattctcaggaaactatcacaagaacagaaaaccaaacactgcatgttctcactcataagtgggagttgaacaatgagaacacatggacataggggaacatcacacactggggcctgctgggggtcaggggctaggggagggataacattaggagaaatacctaatttggatgtcgggttgatgggtgcagaaaaccaccgtggcacgtgtatacctatgtaccaaaactgcacattctgcacatgtaccccagaacttaaagtataataataaaaataaaataataataataataaaaagaatctactgttcagttctcctcaaacctgaatgtgcacacaagcgcatctaattagaatgcaactgtgctgcagaaaatcttggacgggttagggttaggagccagagaagaatctctcctgtgtttctaacaagattctgggtaacattgatgctgctggttccccaactagactttgagtagcaagacactacaatgcatttcatgtattgcagaataatagaacttatttatgtgttcttttacaagttctctattgaacttgctgtgtctcctttattggtagtgatcatgtataatgaatgcttccttcctaatgcatttgcagggttacaggagctactccatctctgtccagtaattagacaattcctgtttagtgacatcttacagttgtctatttgggggtttcttttagttttgcaccatagcagaatacttgctttctgcaccagatcaagcatgaggttcaaaggccgtttgcacatttgaggctgttctgccgagtccaacacacacacacacacacacagagacacacacacgctgcaacaggcgtgaggagagggcctcaggggacgttgccttctttttcagttctttatgtatgttggatgaaagtttatgtttaaaattccaggttatttcacatgagtcacactgaaaaggaaatacaaacgtgttgcatttactttacctggttgtgtttgatgtcttcagcgggcgcaccataagaattcctatacaaagttgaaattccagtgttttgagctaaaagcaaaaggaaaacaaaagtttagcaaagaaaacaacattacaaataaggaatagttgttattgaagcaagttcttgccctaacaaagcttgttttcttggggaccattccaagtagaagacattctttggccctgaacacttcattttacatacagatattaaaaaaggagaacagttattctagaaaatccccacagcatgtcagccgcttgcaataatgttcacatcacagacagggtcagggcagatgctgcaaacagatggtcattttgtaagttttatggccttcttttctggtgaaaactggcaggtaataaaggcttgtcacctgcactgaagcatgcaggagtctgtatcagcagcttagcttttagccggagagtgacaagaataaaatttctaatttgagctcacagaagtgcttgatcatctttcagacagttcatttcttacagacccaaaggacgggcagggggcatcgcctgcatgtcccccatgtatctggaagcctgcggctttggaatcaaactagatgcagagggaggatcccactctgttgtctggcttgcctgtcgtctagacgaaagagatgaaggtctcctctagttgccagcagcttctgaaggcccagagagggggcctattagcccacttccttatgggaaacccttgaagctcaagccacccactcagaggaagggcacaggccaccactcccttcacagctgctgaagggtcatggttcaagaaatctttggtagaatgaccatatcacctagcaatcccactgctgggtgtatattagaaagaaaggaaatcagtgtatcaaaagatatctgcattcccatgtttattgcagtgctgttgacaatagcctagatgtggaatcaacccaagtgtccaccaacagatgaatggttaaagaaaatgtggtatatgtacacaatagagtactgtttggccataaaaagaatgaaatcctgtcacttgcagcaacgtggtggaactggaggtgatttatgttaagtgaaacaagccaggcacagaaagacaaatatggtatgttctcacgcacatgtggaatatgcggaagctaaaaaaaattgatctatgaagatggacagtagaatgatggttatcagagactgagaagtggagttgggagagaggaataagaggggatggttaatgggtagaaaaatacagttagaagagaaaagatctagtgtttcatagcaccatagggcaaccataattcacagtaatttattgtatatttcagaacaactagaataatggaattgggatgttcctaacataaataataaatgtttaaggtgatggtatctcattacccttatttgattgttatacactgtatacttgtatcaaaaaatcacatggaccccataagtaagtacaactattatgtattcataaatttttttttaaaaaagctttggaaaatgctgtcttgtgtcagtggggtataaaacactctaaaactaggaagggctcattgtttgcttccagtatttaggggataatgaagtaggatcactctacctataggccacaagagaaaggtcagtataacctctcaaggtctaagttcactccacccatgattttttacctaagagttcactacagctgtgcaataaaattcctcctggagaattcagcttagaaagtgagagccgaaagtccatttttccattttaaagaccattctgttatcctctctggttgaatgcatgtcactcctgtctctgtattatggtgcaaaccaccatctctctctggaccattgctaccaaatcctcctcgaaggcccaacttccactctgcccagcctgattcctccatccaccctgttaccaacagttagaatgctgtctttgtaacacaagttgggttctgtctctttctctgcttgtaatgctccaatgcccttcaccctgagacggctctccactatggccatgaggccctgcaaggtttgtttcctgcctaaaatcctaacacatttctccctcctctcctcctgttaaaggagtcccagctttgccgaccctccttcctcagagcgggccaaacttgtttagcttcggtgaggttgtctttgctgatctttctccctggaactcgcttccctcagacttcaaatgtctcctcctcccacgtcaagtgaagtaaccccttccgcctgcacccccatctcattaccctgatcagtttcttcttcctactaaacacagtgcagtatcatcttgctgggaacttgttatactgtttaccttatgtactgtctgccttcctcttccagagcagaaggcccttgagagagaaacagtctgtcctgctgctacctccgtatgtatcctcagaacctggcacagcacctggcctcagtggacacccatagagtaagtgccccatttgctgaatgaataaatgggtaaaccttagatagatctgccttcagagctataatttgctgatagaaaatgtcacttgaggaataaggtgaaattttgttttttctgttgctcagaattaaatgcatatattttttagaacgtttgcactattgcagtcttggcctccctccctgttgtgaaatcataaacagacactgagacgctctcaccagaggaatcttaaaagcacgaggcacagtttgtggcttctgagcctaggatgttaatactggaagttctttcccctcactcgtttaaacgagaccatagctgagactgaattacctttacagacacgtgaggcagaggaattcacagaggctctgccctcatatgaccgagctaatagtggactcacagaagaatgcctttctatttttctaacagcccccaaatacccaattcccaactgaatcaacacattgaagactagaacgactttcaaaggcataagaggccgggtgtggtggctcatgcctgtaatcccagcagtttgagaggatgaggcgggaagatcacttgatgtcaggagttcaagaccagcctggccaacatggttaaaccctgtctctactaaaaatataaaaattagccgggcatggtggcaggtgcctgtaatcccagctactcgaaacgctgaggcaggagaattgcttgaacccgggaggtggaggttacagtgagctgagattgcgccactgcactccagcctgggcgacacagtgaaactccgtctcaaaaataaataaataaataaataaataaataaataaatacataaataaatggcataagaaagacactgacaaaaaacaaacagaccattggatgaaagggtatgtgggaagttcagatgggaagggaaaacctccaggtgaatttaaaactcaggcagtggagctgctgggatgctgcagccctttcttgaggtgaactgaacacgtgaggttcccaggcatgcagggctgcaagaactcgctatggaagccggcatgcctgaatgaatagccaactggatttctcagggctctccagtggcagagaaacacttaggagagaagaattttatgaggcttcatccaagctagaaaatgaatccagaaaaggagggtgggggaagcctggaataaacacctagatggatctgaacttctaagagctcagcagaagagatgacagctccatcaaagagatgtttgcacttccagccctcataggctgcattttggggatgaagcttcccttgtggttttcatatcagagggaatgttttcttggcagggaatgaaacaaggaagatggcagtttttcaggttatctttcaatgcactgaactttaaatgttccgtagatttgttcttgaacaagaaaaagcattgcttttgatgttggggccacaagaaatctgattttgcaagtaaaccctggaatgatgggcatttgctaacatcctgcaaggtgggggttgtaaactcaatatccccatcaatatgtgaaagactggcttccacctggcttggctggggacttattcataccactactgaaagtggcaaaccaccactatcctcacttctgctatcccaccatcacctccatcaccctcactaccaccaccaccaccatcattgttgtgataataacaatcggcgtttacatagcacccattggctttagaggaacttccctatatacacataatattcaataaagatctcaatgttctttctggcttgctacatgattgagagtgtactcctgaattgcatttttaagtaagttagagcaaagctgtttaagcctctaaataagtttgaagaattacatacactgaaattgtcaagatccctgccattttctaagaagattaaatatcagaaacatagtaaattttatgttttattttattttgagtccagggcacaattatgtgccattggaactgttttgacataaacacgcacacccacacctgaaggccttttgaatgattctcttgggcaagagagttaaagagaaacatgaaactgaataataatgcagtcgatctcacaactgttccttaatctcagtgtatcatcccagacagctggtgatgtggctacccagggcaatgataactgcacattgaaagggtcagttgaatttggtgtcatgactagctcagcataatcagtacaaatgggatcctctgccgaatgtctagactccagggactcagaattcagattcacagctttctttgttcctgttcatctacgcggcaacatgtaaggggaaacagtgaatgtgaatagtaacctagagtccatgtaatgagttaggttctcccgttcaggaaacgtctcaggagcagcgctgaggtgttcccttgtagggtctgcacatggaggcagaatgtgctcctgggggcagggataagaaacatccgtttattatagttttctttacgcagctgagcagagttaacacggaaaacactgccgctggggtaaatgcatttgctattagaaaaatttatcttcgctgtcctggtttggaaggcattttaataaatcatccaatttgtctgctctgcttccctgccagtctacacctaaatactactggagaactgcctcctgctcttcagattcctctcctaagagggtctcagtgtctgcacggcgccctttgcgccccagctttatgaatgctctaacatggccttgttctattaaaggctcttcctcatagcctattttcagcagggacccatctccatgcccatgtggtaaagaggatgtggggtccccgttgaaaggtcctcagggctccggcagctttgcttttaaggtataactccctctacagccagagcccacatcctgcttcttggaggagggccatccagggagagggtgaggtatggagagcttggagggggctgtgagtgcctcaacagaagcatatacagagtgtacaagacgtacagactatacagtgacttaagggtaagccctgttatcagatgggctgggcatggcacagtggagggggcagagacagatacccactgtaccaattctggcctccatagagtcttggctgatgagaaaggaaggcaatggctgtgactgagatcgtgagggatgacgagcgtgaaagatgaatgcctccccagggaatctgcagtcatcagctctaaggaagcttctttgggatatgtcacgtaagaggttgtatcatggcaagaggggaaaatatctcaacagcagtttcatgcagttccccttaaatcctcctcctgccctcctctttccattccccgtccctcccctccccactcccctctcctcccctccccactctattcccctccccacctcccctcccctcccctccccttccaccttcttttcagttccctccattcctaatgcacagggcctaactacactgcctccatcgagtcccctccccagtgggtgatgtcaatgaggaagaaatatgtgggaatattctctctaatttgaaagaatattatgagctgggcaaacaagaggaaaggaccgataaaacatgggtagaaaacattttatcttagttatgcctctattcttagtcccaattcttggaaatcatcattatcaagctctcaagtgactggacagctgctaagtcctgctcagcagccaagcgcagccagccccgtgaagcctgatgtcccatatctctgccttgtcgcgggtcaagccaccaagttccaggagggggcgcgcgaggggcgctcacctgtcatggcatctttcctggaagtgtgttcgcctttagctccgtggtaggtggcgttgctgccggtgcactcgtagtctgttttcctttctttgaggctgatcatttcccgaggtgaagctggggcacttgctacataaagaaatcaaaagggggattttctgcatctcatcccacagcgtgtgtgccttccacacagtcagggtcctcactatgcatggtcccgcatctcaatgcctacgtgaggacctgatgggttttctttttaatttttattttttggcagttttggctcttgtccctgccccattccctcacctgtgacaactgatgctttatagttagagggcatgtgatttggaggctggcaactggggaccacatcctggggccatcttcctcagagagagatcatggaggggacgtgacctgcccaaggtgtgtggggcagtttaggaatgagactgcttttggtttcttcctttctcttctcttttccttccctttccttcccgtgctcccttccttaattagatgtgtttcagaagatctattactgatattgactaatccttgattaaaataaatgcagttttacttaaacactgagtcacctagaaactgcctttaaaaaagtcagaggaaacagctctctacacaggatgatttgtggggcaaaaataaccaagcccacaaagaccttctttgtctgtggctggggtgggctggggaggggcatggaggcagctctagttcctgctagggcattcttgctccagctttttgcataaacaccccaataatctctgaggccctccttacacctcagccactcactgcctgtctggctgggaggctgagccctgccgttcctcttacacccatttctaaagtgctgggttgtaattggaggatcctcctgggaaattccaggagtccttaaaaaactggtactagaagagaggaaaagctgaactcagaggcaaggaagtcagtaaaaggaggttgaattttcatgagtgactgaatggattggcagcaactcaaccttcctgccagtgcagaggggcactgggagaggttggcaggagccatgcgtctgggtgagggggcagctggtcgcgcaccccaccctgtgggcacctgcagctgtgtccagctccgcaggagctcaggtgccgtgtccttctgtcaggaagctctccccagctcccatagcccagggcagtgcttcagagccttgtttaccctcaacactcacttgagaatttatggatgcccagagcccatcctggaccttttgagtctgaattttcagtgacgggcttcagaatccatatttactgagcatacttggtgactattaaggctaggaatccctagagcactctgatttttaggataaatctctctttcctttgctagtgtcaaagctcctccccagccaaacttcagtttaccttcgagcttatcattcacaccctctgtagggtctctttgctccttgggtctgtggtcccccaaggcacctctcatgtcactgagtcatgtgattcagtttgtcacccttatatcttctatgtacaaattcctgtgctagccactgtgcaaggcagacatgcagatcacgtggctcttcctgaacttgtgcagctctcaatcgagtaaggaaatggatgtccaaataaagtagaatgagaggcagaagtgcccaacagacgttacagccaagtgctgggaagataaacatgggttgttgccaccctctcaaacctatcaaaataaaatcacgcctcaatgctcagctcttgaagccatcacgggttttggatcctggatgcctattagaattcattacctggaatcctttaaaaaaaatactgaggcttgaaccccacccaatgccagctggccagaagtcctgggtacaaatgcaatggcagacagggaagaaaaccatgcagctcagacagctgcagcaccttcatcacttgtaggacaagcctggagctgcaatgacttgatcaaggactgaacctccctgatccacagtgaccctgtgtaggtggagagaatgcccaggctctgctgtgagggaagagaggttccaggggagaggacaaaggctgggacttgggccatctctgtcccgaatgtgaatctggggagatgtgaggggcagccactgtgtcgtatgaagattggggttctgttgcttggagagggaacctctgcaagaacaactgagtccttagcaagctctgtgccctgtcactcaactgggctctgcatccagttcctgtctgctcgctggttcctcgctaacctcttccacctgctgcccccttctctttggttcaccatctttctcttccaggaaagtctctcttcctgcctttgcccttttgcctctgggtcttccctaataaaggttagccttttatgagttactgccacataatcatgaagggacaatattttaaaacctgttgaccacagcttttaaaattagaatccaatattgcccagatggtggtgtttattaaaccacatcaagtgtgtaattatctcctgagacctcacacacagcggtgctccaagtctctggtaaatcaggattaagttctgggaaaaatcaaatcacgcaaacaagtgtttattaggtgtctggatgtgcctcgcctaggaagtcctgaggcagcgcactgtctgcatggctggttgaacacagccctgcctgctcgcgagaaaaggctgcttctctcttccagcccttgccgatccatcatgtcgtttcattctcataacactgattggctcactgtaattcttaataatcactgctttccaaaagacaccatccatatgctttccacactccatgcgctttatctttttaagcctgctggaattacagaaataagaggcctaagaggccacctccatgcttctgagatgggtggacgtttccacaggtacagggggttcctgatcgtcacccagggttggactaaatgtgataagcaatgacagtacactagaaggatcagctttcacagagctgggagcgggccatttatttcagtcagatattggccattcatttctcatcatgttgacagtaaagtctggcgtggagttctgcaaccatcattctcgcgggtagggagaccactttgctgggcaatgctctctaccaggtcctcccaggtgtcatttcagagaataggatttcctcagcagggagagggcagagaagagtaggaagaaagctttcataaataagagcctacatagctgtcatctgtgtgggtgcatataacttgttatccatctttcactctcagaacaaaatcaaaatgcagaaatcaaaataaaagttttaaaaactaaactgtgaggaaaacagcaaatttatgccatttatattactaaatggtgtgttcacatttgcctttcatctttcctctgatttttggcatttcttaatgtgaattaaaaagggtataaaaatcaagtatttttacgaatacaagaagttcaaaatttaagcaataggaatgtgacaaaattagaaaaaaattaaatggaatgacatggaagttatagttggctacgataataatttatcagtggcatctgccggtttatcattaataatgaaaagccaattagatgtggaacagttatgaaagcatcagtgctatgtgtcaaatgtatatcacactgaaggaagaaagcacatttggtctcctcaactttttatcccaattatgacaaaatgcaactcaaactatttttattttatttatttatttatttattgagacggagtctcactctgtcacccaggctggggtgcagtggcgcgatctctgctcactgaaatctcggcctcccgggttcaagtgattctcctgcctcagcctcccgagtagctgggattacaggcgtgtgccaacaagcccggctaatttttgtatttttactagagacggggtttcaccatgttgcccaggatggtttcgaactcccgagctcaggcaatccgcctgcctcagcctcttaacatgctgggattacaggcatgagccacctcgccaggccaactcaaactattttaagttggaaaaattgtccacggaaaccccggatttgcagacacatgacagttttctttatactcgttcctcctgaattcaggttcattacgtgcatgtcatgcataagaacctgttagagaaggagatttgctctgagtctgtgtatacaaaacacagagtggccaccacagtacaaagaacagattcatttcctacttctagcgaaggtctgaatggaaggctctcctctgagtacgggttggctcacggactgggaaggaccgtctttgctcaacgagaaataaagcctggctggctagccacggcagcctcttacctgagcggttgttgggagacacgcgcacaggggagatggagggcgtgcgggaggaggagtagggcctttgccggtccctctcgatggttgaagacgaggctacaaagtggtattgtgaccatccatcctgcaaaacacagcacgctcctgttagatgggcaagacagagtgatttttcacctccggacatttttaagttccaagtatctggatttgcataatatttctatggtgtgtcagaagaggttcttgaagttctgcgctctcatggaggtgaacagagccaaatgtgaatgaagacacacctccttccctccagagagcctggcgggtagggcctgctttccttcatgaatgttgaataaatggtccctttacaaacccgctctggtcagaagcttcgacttcgatgaaaatacgatgctcagaatgttaggggacccggaaactgtctattttttgccgacctggttccagctctgcctggctccctcttccgctgcctcaagattttccacaagggtttacccctttgctcccaggacctatctgttggcaaccagaatccagggcagcgtcctcccttcccgtttacctgcctgtgtcctttccagccccaaatgcccaccctcgcctgtctccaagctggtctgctccaggaatgatatttttcaatatagagcatattcaaaatgcatcctaccaagcctccgttaggcttctgacatctagttaatatacagaaagcatctatactatttttccttataaaaaccgcataaatatatcacagattattttgtgaatttacaaagcataaagaagaaaataaaaataggtggtaattccaccctctccacctgagagaactcctgttaacctgtcatggtatttccttccagtctttttttcttttttaaatagattttatttttatcaaagtaacatgttaaatagtactaacattatagcaaagaaaagcagtcacctgctccacccccaaatcctcctttacagaggccattgctttcaattcttttagattttttatttttttcccctgacaacatttagacttttaaggggctcaatgctttgttctcttgggattgttcagagaatcttgccacacagttagcacctagtaagtaagctgggtaatatcttttaaaatcatgcacctctcattctggctttatcctatcagtcaagtagaacaggaataacgagaattagatacacaaagattagtcttggtgtatctaataagaattaggaacatggaaatgagtatgcattttgttctttattaattcatctatttatgttttcaatgatttttgatagagttttgagccccttaaaagtctaaatattatcagaaaaaaaagctaaagaattgaaaacaagtgccaatgtaaagtgggaacaggggctgggacagtgcctgctttcctttgctataatgtcagtaatattggacatattactctaatggaaataaaaccaaactaatggataccattatctgcattctacaggaagaatttgagccttcgaaagtaaataggccacccaaagtcaaacaatacacaagttacaaaaaacatattaatactaacgtggcattctaacaagtgcttggaaggaaaaaccaagccggattaggggatagacgagcaggggcggggatagaggagcggggtggggggagatggaggagctgggacggggatggaggagcgggggcggggacggaggaagggggcggggatggaggagcgggggccggggaaggaggaggggggcggggaaggaggaaggggccggggaaagaggaggggggcggggaacgaggaacggggcggggaaggaggaaaggggtggggaaagaggagcgggggccgggaaggaggaaggggggcggggaaggaggggcggggtgggtatagaaaagtaggggtgaggatgctggcatctctattttgtggagtggggtcagggaggtgctgtcgggagccttaacgttgcagaaggacctgcagatgacaattgaaccagaccctggtgacacagatcttggcttcccagcccacagaagaacagatgtgaaggccctgggtgggaacggcttcgctggtgtgagaacaggctcctgggactgaataggcgtgagcagggggccaggaagacaggaaagctctgggtgtccaggacagtttggggaggagtagccacagcaaagctgcttgggaggtcactcccctggacagaggagagatggcccaggcttgaagggtgctggtggtgggaagcgtgcagatctggtatccacactggagggtttgctggtggcatggctattggtgtgggaaagaggaatcaagccttaccgcagtgcttctggtgtgaaccacaggggcctgaggtccccttcactgagccaggaacaatgggagggagggaagcagctttagggagtggaactaggactgcctcatggggacgtatatggttaccgaagagggacagagaaggaagcaggatctgcaaactgggatctcagggctggaggcagaattttggacgtcagcatatagatattatttaaagcaaagagaatggatgcaaacctgtaagcgaatgcaaataaagaaaagcagaaggcagaggctgagtcagcctgaggacattccaatattgagaggggtgcaaagagtaggggaagcttcaaaggagaccaagaaggaacccagtgaactacaggaagcatcaggagggtgtgactgtggcatcaggcaagaccaaaggagcaatgcgtgaggaggagaaggagaccaaccgaataccgaggaggaccaagagctgcctggtggtctgggaggaaggaagtcctcgtgacggggacaaaagtgctttctttggtcaggttggtaaatgtctaactccagcggtcccaaaagataatgagaattggtgaaggggagacagtgagtacagacaagcctttggcaaagttttattttaaacggaaatggagaaatgggcttgaagagagtgagggctggagagatgttttcatagatcacctagaagatattgcagtatttcgtgtgctgatgggaatgactgaatgcagagaaggaaaaacctggggacataggagagaaagggaaaaatggcaggaagaacattctcaagacaggaaaggtggataagattaagtgagcaatggggtcactgcccacagaaacagactgtggccatggacatggggaagagactggtagatggggtgacaggaagataaggatattcactcttgatttttttgttttttgcattttcttatggaaaatgagaagaagtgaggtcatctgctgagaataaggaagggttggagcttagagaacagagagaagagagaaagggaagggaggaaggaaggggacggggatgtggagtggtccttgagttgggtggggagcgagctgactggccagggcaagtggccggggtgccggacagggctggaggctgtggcaatgaaccaaaaaggagctgactggtcagcatccgtgtgtgcctctctccagccacagtcagctgccctagggcaggtgtggagtgggtagagttgatgggtcatcaggcaacttggagagagacaagggaacgtcacggaagctaagcccagtagggaggaaaatgtaggtgctagagacgatatggagagtgtatattgatcagggtactggtgggcttatgagggccacaggctgttgggaggatacttcacaggtgctgggggttttcttgagggaggggagcggagatccttctcaaaagagcaatgaggagggggcaagaaagacgactgctccaagaaggacgtctgttccacctccagggtgggacacaagggagggagggtgggtgggaaattaaacagccctcgaggagggggctcggggggctgtgtcctcagggccgacaggagatgagcagaagaggtttgcgaaacggacacaggggattttgctgatttatttatttatttttcttttgagacagagtctcgctctgtcaccaggctggagtgcaatggcgtgatcttggctcgctgcaaactccacctcctgggttcaagcaattctcgtgcctcagcctcccaaatatctgggattacaggcatgcaccaccacacccagctaatttttatatttttagtagagacggagtttcaccatgttggccaggatggtcttgatctcctgacctcttgatccgcctgcctcagcctcccaaagtgttgggattacaggtgtgagccactgtgcccggccaattttgctgatttttaaccacaggttaaagagggaaaagaaatgggaggtggacagaagacaggtggaatatatgggggataactggctgctcagagcctttgatcgaggggtccaagtaatgatggtcgtcccaggaggcttgggtgattgtgacagctgaggtgatgagagatgaagggtgtaagttacaaataaatgcctccttagggaagggtgggggtggtaggtaggtatcacggcaggagaaaatgtctccactggagttctgtggggttctctgaaatcctccggagggtggaggcaaacacagaggaggagcagtcttaccaaaaacacgttcaggatggaagatatttcaacaatgtatgtgtccattacttatgtatgggaacgattaaaaacattttttttaggccaggagcggtggctcacgcctgtaatcccagcactttgggaggccgaggcgggcagatcacgaggtcaagagatcaagaccattctggccaacatggtgaaaccccgtctttaccaaaaatacaaaaattagctgggcgtggcagtgcgtgcctgtaatcctagctactcgggaggctgaggcaggagaatcacttgaagctgggaggcggagattgcagtgagctgagatcacaccactgcactccagcctggcaacagagctagactccatcttaaaaaaaaaaaaaaaaaatttaaatccctgtcttttgaaggaaatgctttgtagagggcagaagtcctaaatatgactgaatggggacagatcattttatgtttgtctcattgcaatgtagaaggtgtgctttgggattccaagtagtggctcgggacagtcgtttagtcaaaaccttggcttctttggctatgaatgtgatgatattctgtgtggtattaaaggtgaacaaggtactttacaatgtgaatattggctaaatatttattatgttctaagacctaaggacacactagacctaaatgtggcacagctgtaggactggtttcacttggtgagacatcagtaggtttgttagcattgctctcttatgcaggtgattggagatatgtgttgctcagcaactcagatttcatgatgtttagactatactgcaaccatttaagtatttacatttctggaaatgtcagaaaactgagtgtaataacaaaattgcttacaaaggaactcctatatggatgcactcaaaaaattttcaaatccttcataaaatcaaatatggaaaatgcaaatgcctggcagaagtgtggtcctgcaggtaacttgtctgtatgtgattgggttagtatacaactgagggtgatgacagcggagtgtggtgggagaaacggagaagcaatccctgactcagaccctctgaggatggccagggactgcatgcctgtgggtataggcactttgaatggaggggagaagggagcttaaggaatggggcagagtaaacacccaataaatatcttcgttagagctgtttcctgacccacagctcagaagccccaggaggaacagaataccttctacactgcaatgagacaaacataaaatttgtgtgctgtgagaagaggtgatcttctccatctcccctctctcattcatcgatgcagagtgaaggctacagtgactaaactgcacaacttcaacactgctatgctcaacaatgcccagaaaggactttaaaactttagttccgatgccacatacagttggccctctgtatctgtgggttccacatccatggatttcaccaacctagggtggaaaatattccaaaacatattgtctgtactgaacatgtacatgttgttttttcttgtcatccttccctaaacaatgcaattattttcatagcacattgtattaacattacatattataattaatctagaaatgatttaaagtttacaggaaaatgtgcgtaggttatatgcaaatactgcaccattttattaatacagccgggacttgagcatctacaaattctggtatccttgggaagtcctgtaaccaatttcccacagatatagaggagcagctgccaaatgtcatggaaactcatggaacactagatgctagaggctagggtgcagctggcccatggcatagatcaatcaccactcattacaaacaccttgagcacaaatctcatggccttcctcatcttttattgtataaaatctttagtcattcaattaaaataatgtttcactttttaaataagaagggaaagttattgctaagctgacattccttctattccactagccatgtatatttttgttatctagccagctagcaatcaatctattattcatttgcttcccactgtcactcagaatggcttggaggtggttcacataaatatatacaactcgggcacatatcatttcaatcattatttgcctctttaatcactgtattttcttgttaaaatatcaacttattgtaggccagagacttcttttgtgaattctgttatattgggcattttaccttagctcttctttgcaccacctgtacagctcataggggttagataagaaagcccagggaagaagcagggagagtgaagaatcaccacggtaaccggggaagggccatgaatccttcctattgatgataaagaactcttttactatctgtcgttcaccttcaacagactgacccacaagttgtgcccttcagctgaagacgcagctaagctgtcaaaaatgtgatatgatatctgtgcctcaaattggtttttatttttaacacattacacttaaaactggaggttgttaaattgttccaagtatatagagatagaaatccaaaaaagaagatgagttcaaagtcactgaactttaaattgccaccaggaacaatctgatgttctttatcttacaccctttagctgtccctccaccactttcagcctctgtgctcaagttttcaatgtgtttcttatgaaactttattattccccaaagctacaatcgtccatacgggcatttccaatgtgcacgacaatcgggcgatgttcatccccacagccccactaccatcggtcttcacggtatttctaggacgtggtcagtctgtttagttgatacaggtcttctttttatggatttcgacggccctgaatctataacactctccattttatatttctgaacatcctgtaaacatcgccaagaagaatgtattagtagagagacttctactaacagtttgaatgaggggactaagtagctttcattcggactggtctacaggaggttaggacaacacacacttgagccacagcttcttattctagaaattgtgtggctgagcgcagtggctcacgcctgtaatcccagcactttgggaggccgaggcgggcagatcatgaggtcaggagtttgagaccagcctgaccaacagggtgaaaccccgtctctactaaaaacacaaaaattagctgggcgtcgtggtgggtgcctgtaatcccagctactcgggaggctgaggcaggagaatcgcttgaaaccgtaaggcagaggttgcagtgagccgagattgtgccactgcactccagcctgggtgaaagaatgaaactctgtctcaagaaagaaaaaaatgtgcacgacattcagttcagatgagcacaggagtttgttagctttgtatgcaggggatgagctagaactgtctggcaaggctcaaaactattctcatgaatatcttttcactacttggcttgctaaccctgggtgtctcagcagatagagaggtggaattagagagctgtcaggagttggcccttctctcacaattactggtaagctccatctcagcttcttttccacacattaagggcaatgtgactcatcaggctggggagttttaaaaatagtaatgcctgggccccagccctgaggttctctttaggttattccgggtagggcctgggtatccttattttcaaaagctccactcctcccccaaatggatgctaatgaacagccagggctgtgaaccattggcttggggtttctttgcataggtgtcagtgacaagttggggcacattttttaaagtgctaaatcccaggaggcccttcagtctccattcccaaggttgacttctatagtaacaaaacaggtcaaaatctcaggccagagaggtgccacacacactgagccccaatcacacctgatcacccagcatgcactgcttatgagactcaatttcaaacatccccacctttgatcaggcagctctatgacatagcagggcaccttgtctttttctacctgttaaatcttatcctgcttggttctgtattaggcaaacaggaggcaggtaatgcatgttcattcaattactattgccaaataaattatgccaccctggtttggggggagttttcagtaatgcaaccagttttctttccatgatagtaataaaatgcttttacatcacaatacagactttagcaatgcaggctgtctccctagctgtgaggcagcaagggtgcctcatttatttctgaagccgtggtatctagcatagtacctggaacacagaggtgcctaatcaatgctagctggagtcaatgatttaagatgacagtattaattattgtaaaatgaaatgataatcaatttcacaggttttatagctagcatccacggttcttacactctattctataagaaataaatacattcagagccttagaacctttttcttttaattgtagctcagagtaacctcatcagaatcatcttctgctgttggtagatctgtcttttatgacatactcgcaactgtgctaaaggtagtgttagcttaggtaaaatagtacctaacaacaatcacaagaaaagtggcctttggcttgcctgctctattttaaatggtaattcctctccactgaccatgtttcagtgtgagtacatacaattgcctcctctttaaccggtctggaaaataattttgaagcatcattatctctgccacctctggcccctgggtgggtgctgactcagttggagcacacagcttgtccctccacctccagtgcttcttgccccatggagctcagaagaagatacaggtacctgcccatggcaaatgcattcagttccccacaaacacagatccataggggaatcaggaaacaggataaaaggggagagtatattacctttctcattagctatgccccaattccttttagggctgggtacagcagtccacacctgcttccagaatgtgcctactaaactgaaggggttggtttctggatgggtcaccttgtgggaatattactgggtagggaacagtgatgaccagtggtgctccagaaaacatgcagagcatgtcaataagagagtggagagaatttagatgtggtggaatgagaatgacccatgtgttctgaggctcccgcctccctctatgaagggacatcctgccattttgagttgagcaggtgagagcaccctacttctgctgaatcacagaaaggatggagaaggatactccttgatggaggaggaggaaaggggattagggagagaagttggctcattccatgtaatagagtttagagagaaggtgggaggggagagtgaatatttcaagggctgctcaaatgaaggttgagtggatttggtgattatggggagagaaaacaggctaaataccaaatcctcattaaggtgtttcaacagatgagatttagcagaaaatggaattttgagttacgtgcatggtggcttctgaccctgctcctggaagacaacttttagaaacttgaccctgatggggtggagggtgacccagtgaatagccacagctgtgatgatatggtcaatgttgatgtttctattgataattttgtttccaaagagagttttggaaactttgtcttctatccttagaagttagattcatcaactattttcttataagagacttctctgacccaggagcttcaagaaataattaactttgaaaatgaacaatgcttgtttatttctactggggatattaattggaacccaaaataatgactaggacactgttggcctatgtatggcctttttctacctgttttttaaaaagttctggaagttttttaatgtagcaagatttggcctctaagcgaggattcctcagtggccatacacagactatttggtactgaagtcacaaacacaagcttttcaccttagctgtccttgaaggctctacagcccacaaagcttgtcaagtctaattttttttttaagtgacttgagatataaagaaaagtgtggcaaaaatctgttgggcttttagtaacccaagctcacccatgcaccagcctgtaacactcagggcttagtacttacattcacaagcaagactacttcgctggggacctatttttcagatgaaagtcaaaacagaaatcattgccttaggtaaccagctaagacattaatgctcacgtatcagaagcctgattgttcaaaattgtaccagttttccagtcatttttgagtggaagaaacctattaatgtaatcacattaagcagagaatgaaaatatttcaaattagtggcatttacacatacacttccttcttatttcaagaaaaggtattaaatacaataaactgaaggtagaatattctgatgcacagtctgtgtgactaaagaccaagccagattttgcttaactacaaaaccttctgctcctctctgctgtaataaaacaagctcccatctatttttaaggtaaactgtttgttaaagattcattaaaactaattccatcaacaattccaagagctattagagttaaatatttaaactaaattttaagggccaaaagggagtatttgcagtttaatgtacaaataaataccacctgacataccagttgctgtcattagtttgtttcagctctgttgcttctaatgaaatttaattaaattgatttggatacttaaaggtacagtacgtataagcataaggatcttgtgcaacaccatcttttaaaagcaaatactgtgtaaatctgttttaggaattcaatttactgctactgggctaattctaaagaaccagtgtaaccaagaagatttgaaaagttggaaaaaatgtatatgatttagtagaagaaagtataccattgttaaccgctaggagttaataggtaccaatggaatgcaaaaaaccaaaacaaacaaagaaacgaaaacacctgggaaattgaaataagaccatatcagtcctcttacctccctggctttgcttttgaggccttaaaacaaagatctgacttggatgagctttaacaatgtcctctgtgtttcaattagtactgcaaagttaagttcaggataaaactgaacagtccagtcttcagatttaggaatacaaatgtctagcttctaatatgtcatttgagcatttgaacagtcagctattttacatatacactcatcactggggaacaaattcgatgtttacgctgggtctcaacttcaagttctctatattccagtctccttcaaaatgcttctgacaggccgggcgcagtggctaatgcctggaatcccagcactttgagaggccgaggtgggtggatcacctgagatcgggagtttgagatcagcctcagcaacatggagaaaccctgtctctactaaaagtacaaaattagctgggcatggtggcacgtgcctataatctcagctacttgggaggctgaggcaggagaattgcttgaactgtttcgtttttgcagaggttgcagtaagctgagatcatgccattacactccagcctgggcaacaagagtgaaactccttctcacaaaaaaaaaaaaaaaaaaaagaaaaatgctaatgacaatgtgaatggaagcagagtcactgaacatgccctctgctaggcttacactctggggtagctacactggtgcttttattcaataaaaattagtaagtagctagcaccatgctgagcacagggcaagaaaagagagactggcatggttgttgaggggaagatgaaggagaaacaggtgttcagacatgatcacatcaatagccaggctgtaagagccatgaaggaaaagtacaggttattgggaaggactgctattagccttagagagctggggaaagtcaggaagtttttctggagggtgttatagttacactggggcagcaataaccaggattggaggcagagaaggggaggcattcctgggggaggaattgacctgtgcccaggcaatgccaaggctctgaggtggaaactgctttgtacctgcagaggaagagcaaggggaagcaagaacagcgtggctgaggcaaagcgatcgcaggcagggtggacggaagtcagcgcagggaggtgagcaggactttgtgagaaaatggaaggtactgaagagttttaatcaggagaatggccaggtcagatcgggatttttaaaagtatattctgaatgcttaatggaaaatagactgaagatggtaacgttgattccagaaaaccaattaggcagtaatattgtaccaggaccagggacagatgatgatggaagtaaggatgggagacatagttgggtatgggagatatttaggaaatatatcatcagggtttgtgaaaaatagagtggagataagaaagaaggaagtattagttggataactctcagatttctgaaaagaacaacaaggtgggttgggtgctatttactgagatgggcaaccacggaagaagaatagatttagggaatatactgagagctaagcactggatgtatggacagttacagctgatgagccatctaagtgcagatgtcatgtgggtagttgtatggatgggtttagtgttaaacagtgaagaccagatagagaaataaatgtggatacaaactagtcttcaaatgcatttaaaaaccatgggagcagggtgcagcaaaccaccatggcatctgtatacctatgtaacaaacctgcatgttctgcacatgtatcccagaactcaaagtataattaaaaaacaattgtcttaagatggtagtggtttgtgaagggatcttgcctatatgctgtgaagttctcatgagacaggttctattaaaaaaaacaacaacaaaaaaaccatgggagcagatgagatcatctacattagcaggtatagggtcccaaacaaggatgttgcagggaagaccaggaccagggtattggcaaaaaagactgagaaggggcgctttcccacatagagaaaaataagaatagtgacaaagcagccagggaggaggctgtttaacagagaaagatgtgtcagggcctccccagtccatgcccttttcttcctggatgcccatctagaccacatgtcccagcctctccttgtggcagcctttcacacccacgtgatggagatctagccaatggaggtgaggcagtgggcatgtgtgttgccaggtatagctgcggcccttacggcgtgccagagccacagatggaaggaggagtctgggtcccgagtgcccacatggagaagagctgacccatctacttgaacacctgtccaggatgactacaggagcaagaaaataaactttcgtgtagttggatcattagatgtttaggtctgcgtgttacagtggggagccctccctaagtcacacaggcaatgagactcgttggatgctccagttaggagccctttccgtggaggcatgaggactgactgctaggggttgatgagcacaacagaatgtaagaaaggcaccatgaatgaactccaaccttcctagaaacctcattgtgaaggctggaccatgggagagcagaaagtgagaaggcagaagatggagaaggatggggagaggacatttctcaaacatcgtaagatagaagcacgaagagcatatgtatctctaggggaagaatgaccagagggagaggatgaagaaacaggaggaggaaaatggacaatgtcaggagaaaacgacttaacaagaggcctggaccataaatagggaataaatatatatttctattttaaaatagaacccaataaaagtaagcacaaagtgaaacaatcaagaaaaaattgctaaaacgcatgccactgtgtaactggggaaaggtaacccaatgtggatgtatccacttcagaatttccagaacctagaagggagcagatgatccagcaggtactcagtaaatatgcattgaaggtacgaatgaatgtaagctactaggagtggccatttgctagtaggattgacaggactgctctaagaggaatcacatggtattaaggagaataagaaaatgggggtactatcgcatagactggcatagagaaaaacccaattgctgtatacttttattttatgctacataccttaccagcggccaatctgtcatctggttaaatggagcactggcggtgaggacggcatgaacagctctctcagagcagttcatgggaactgtgagttcactcagctttaacctcgggaactgctggcagcctgtcacgggcacgtggttatgacaggacacgtggcaacaacaagaaacatctgagacagttccacattctgtgacctcacttcttcccttggttgttgctaatgttcttatattgttccagctacaaaacggagtctgaaaacgtacagttctctttccatcgaactggctggcctccctgcatagggcaaaggagtcatggacttggggccgttttcaaggttgaagccaattggtaattactgtggaagtatttccaacgaaatgacagcactgtgggatctcccaagaatgtggcttttataaaaactgggcacagatactcaaaaggagcattggtgctgttgcacacatagcgtggatgtccacggaatgaacatctccgtagcctttcttcactttcgcaccgtgtaatgaaactcggcttttcagttaagcccctagacagggagatgtgggtggccacttgattaagaactggaagtatttacattcttgtctctaaaagaaaaaggcatgccctccctggctcttttccattccagttgtttggaatgtgggcaaactgatagccaatgtggataatacagatgagggcaacactccagaggtggtgagcatggagttaggaggagccaaacccctggctctggcaggcgttatatcagactttgatcattacactcaggcttttatgtgagagggagtgggagactgaataatactgcctcccccatagaagatgtcaccatcctaattcccagaaccggtgaatatgctaccttaaatggccaaaggaactttgcagatgtgatgaagttaaagaccttgaaagggagagatcattctgaatatcccagtaggcccaatgtcatctcaagggttgttccttataagagagatttggggggtcacagagcaggcagtacgacaacataagcaaagaaatttcaaagatgcggtactgctgcctctgatggtggagaaggaggccaccagccaaggaatgcaggcagcctttagaagctggaaaaggcaaggaaacagattctctagaaaacttgtagataattaaatactgatgataaggtagtatgccaggatgttaatgtaattttcttatcgtctctgttctggctaaggtcccaagcaaggcaaagaataatagatgcccccttgccccactttctcgaagtcttagaccttccactcggagttgcaaaaatggtggacaaaatagggttctgcagtattagcatatgactcaactccagattatataagattaggctgagggtggaagcggctggtggtgagaacttccttggaagtaatcaattggttggggattcctcagcctccctctccagaagcccagggagtggactatgtaaagaccttcaccatgagctccctgaagtttgggggtggcaggcctggtgtcttcagtggcattagcggggcaatacagagattcagtgccagaggtgaactgaccatggagccatgaactttcatgcccgcccatcgcatgggccccttccagggtctgtacctaattttatattcataaagtgtactcttcttcttaaataggacttccaaaatgacaaaagctacaggggcacaaaatttgtatcttccctggtctgtgtgtagtctgaggctgattgagaattctgaggcggatggctgtggaggtcaggcatccccagttgggaggtccttggttgcagggtggtacttctgagcaacccaccccactgccctcatgagagatggagctagccagcagacatctcccatgggcagagtgtaccagagccaggatataaccaagatggtcaggttctgctctcctctccttgagtctcctttcccacttagctcaacctcattgggaggcattgagacaggggaagccacagcttatgagaaggggagggagaagagatggagctgggaagagagaagaaactgatcacgctgtctctcaagcacaccgagttctcaaagatgtgatatcacccaatctactggatccaccagaaaacgagggagtaagtttgagttaattgccccaaagtaagtgagaagaatggatgtagacttacattaaacttactgagtttactagctcctgatctggtcctttgattctgccttttgtctctggggtatttttgtagggtttgattcaaaaatgttacgagcgaagccttgtgaaatggtggaattatagaggaagtgtttagtttgggtactgctatatgggatttcccctgacttggggatctatcccagcaacagctgtaacttagtgacttcttgtttagcaactgccatgtgcattgatttccacttttgcacaattgatttttgcttcttttcccatttgtgcctttgcttttggacagatatcatatgagtgtctgagagttgtctcagagaggtcaggagaccttgtgaagaaagaccttctttgtcaataccaaacatcaacaagtaaacgtccagatttatgaaggagacagtatggtagctgagtttaaccttagcctttttgttttctacccttacttgacatcaagtgatttagaaaagaaagaacttgaggagctacaattgcaaaccttgtggacactagccttgggttgttttaaaatctggctgaaagtccttatgttcttccaataatctgttgttgaagaattttccagcacagtaggaagattaataaattcccattaagcaatttccttgataaaatgacagctctacatttggtagtttatttctatagaggatttactgctttttcatccctatcttagatacccagaaagtagaatctattaattctcaaaatggcaacatattggaagacatattaaagcccttcagtattcctcacccttcatactgcaaagcttaaataaaattatgaattttgactatattgtgtttttcctcgacaatatttcaaagtatctttctaattctcactggaatctggtattgtttttcaaatgtccagcagatgagggtgatggagtaatgttaaacatgagaacatgacttcagtttgcagggccatggctactggctcatctatgtagagtggtcagtctcccacaagcaagctgcgaaagatgacaaaaggctgtattcactccttcatccactctgatttggacatgtgaggaaatctacaggcattcccttacccatctataattacttattgatttcttgttttgtgagtgcaatggccgcaagagccaatgaaatgaatccaagagcagtaaggaaagagagcctggtgtgagacaggccatgaagggcatgactccactcccatcaaagctcattcttcacttgctgtgcaacccaagagtctatcttctctgacaataaaaggaaggacattgaaagattagttttacgttttctttctctcatcacgaaggcaagagtgaatacagtgtctctattcagagaaatatgatcttactctgtttcaagcacaggcagtctggcattcttcaagacatgagctcactgtgcaagataacaacattgtgtgtggggtggagtggaggggggcacaaccataaaaacaccagaccactaatattaggagggataatgcatctggtttctaaccccattgcttgtcaacaagaggttgggtctgacgtctgatctacctgtgatttgatccatacgcttaggaactatggattttatttattttttatttttattttttgagacagggcctcactctgtcacccaggctggagtgcagtggtgtgatctctgctcaatgcagcctccacctcttgggttcaagcgattctcccacctctgcctcccgagtagctgggattacaggcggattgcactgccacacccggctaatttttgtatttttagtagagatggggttttaccatgttggccaggctggtgttgaactcctgacctcaagtgatccgcctatctcggcctcccaaagtgctgggattacaggcatgagccaccatgccccgcctgaactatggattttaattcattcggagagatactgagtggacgctgttctctctgaagcactttgagattcttagagcaaaatgagcttcaggaccataagctgaacattggaaaaatcatctaccactttaacaacagggactgccctgaccctttccatagtaactttacagggtctgtttgaatggcctggcttgtcttccaggcaagcagtccacggagaggcaagggcacggaagcatgcaggtagcatcccctccattctgatcaccagctttcagcacctagcactctctgttgtaaacatgggactctgtttcctataggaatatcgctagcaggcagagctgcatgggagaaaggagaaagaccgtgggaaagcagaaagacagtgggactagaggagacagagtagagagaccagggggagaggagctgtaaaaatgtaggcagaggtgactagtgatgatgatgatgatgatgataaaatgaaatcctcagatccaaaccttcagctgcctgtggacaggatggcagagacggcacttgccaatcaaacagcttggaaaagggttgttgaattaatggcagcaactcccatggatatattactttccattttacaaagcactgtgatgactgctgttccatttgagacatcagcaatccactgaggcaagtgttatggctttcccatcatggatgggaaaaccaagggagggggtgggattgagggagagatgcccacagacttcatgaaaggccatgaaggttctttaacacaaaggtcaaggaaagatacagacttggatacataaagtggaaggaaggcatcatggtgacccaggcttccaaacctccaaagatctgagggcttgtcccgctgcttccagagaacatgctgccaggtctaagaatagccagagaccattttaagaggtcgtttactttcctggtggctcttcatcaggaatggctgcttatcaggtacagataaccggctgccaagcaaccctagcgcatctgaaacctggtgaatcggagggctactcatggtgttccgcccctcagcagaggtggccagagggctgccggaagtcagttcttacactgatggacaaggggtctcaagtcacctgcccaaggtcatgctgctggtaagtggcagggctgtgctgtggacccctggccatgcactctttgtatttcaccaaattgtaggatgagcctttcagacaccaatgtgatctccagttttatgagtagaagttgagtgtccctcatcaggaaagcatagtctctgtctattctcctctgcttcaaacaagcttggaggaatacgttcattttggggtgctatattaccaaagggataccaacaaacttacatgcatttggcaaaaaaggatagcatggtgaaggctgtggaaaggctgacatattagaattcagcatgtgatgggattcatgctaaccccaaatatggcaccttggcatttgggaaaacaacagaggcagaaagatctctctcaccttcccctcacgcttcttcccttaagcaggtcataaaaccctcattcgagaggtgcctccttatactggagcaaaggaacagccttatctctgaactcacaggggcccacagaggaatccgtaagatctccttgtttatcaacattagatcatacccttttgtcctccaatcagacttctccatgggtgtccactctccatcaaacttaagcataaaaatacacaagtttacctgtttctttgggcctttatttccttacagaggttctcatataattaattggcatgcaattatctcatgtaattttctaattatatagataattttgtatgcttttctcttgttactataatttgtctttcattataggggcttcagccatgaacctagtgatgggtgagggaggatatttcttttcctcccctacacattttagacctagaaaagaaatgaccttgtagataaagatggctagcttcaaatccaggaaggctattgcagagaagacagattagacttttccagtacagcttttagaggacagaagttgcaaataatgagatttttgcttaatataagtaagaagttttggatgattacagttaccccaaaatgggataacatgcctcattaggttgtgattacagctgacattaaagccatttgggaagaaaatgactgctggaacggtactgcctttcttctcctgccacaaaccttttgcaggggttatgcagccccctgtccccatcctccctggcagggggctgtggcgatgggactgagctctcaccccggggtgtgagcccgagactggcaacttctgtgccacttgccctcccctctcccctctctcaccctatgggctggaatgagaagtgggcagagccagggtgctttgcttacacaggcaggaatgatgtttcttttgcaaggcagagcaatgtgacaggcatcaaggtcacctgctggccttgggccacctgcctgagcacgtacagctccatgagagggaaagggatccctgtgtagtctcagctcctatagttttgggtcccaaccaatgcaactacttcttggagatgttgtgcagattattaaggtatcatctaagaatttatacatgatgatttctataatcttttaattctatgacctccccctcacccatcttctttccttcaaaaccagccatcctgacagttccccaaccatagtcaaacataagcaccctattatttcagtcactccatttctttttaagtcccaaggttctaaaaagtcaagaactttccatctcctacttctcttgtaccccgacatccagtctcttcccatggcacatcgtcttttcctttagaaaatatcctctgcaatgacacaaaacatctaagttctatttgcggttatctaaacttaaagactggctttaaaagggtgatgcattctttagcctgcaagtgatcacattctcctacatctgttgatgttccattagggcaaaataacccagaaggccaagcttcacaaaagtcaaaggttccgatgatacaaatatgctttggttccaaatgcagcatgaatcaaacatagttttatattaatcaatacacccagctggaagaatattctgatttgaatcagaatgtgtctccctagataacataaagtaggtgagctaatgaaatgacattctggcctctgtacctgggttcgacaagaaaatgagcatgacagatggcgccgaattctgttccacggacatgtaactctcaatccaattcccatctctcccctcacactttcccttttatccataatgtccttatctcttacctcctaattatgcaaactccataaatgcctctccagatttggtctataagtttctttcccttaattcatgctttaaaatttgtagtatgtaattcagaactgaatgaagttgcccattatagtttcatatttcatctttacccctagtacctccttcccatatcttatgttttcctttggaacgcttcctttgctaagcctagaatagatgtttaataaatagattcgaagcatggataattaaaagatatggatcagacattttttcaatgatatgcaaattgtcagtgaagaacaaaatagaaatctatttccccactgattaaaaacaattcataaagatgaatgaatttggttttctcacaaaggagcttttcaaaaggaaagcttttttgaattttgagctttgctattagcagcacttatgacactgggcacaaagatcttcctttcatttcacaactgcataatttggtaattattaagaacagctctttctcgatatttttaaatcatgggtccactgaaaacatcaccattcatttgtccagtccatccttcttgaatctcttcaaatgaaacatattttaagcatcttcaactcttgagttttagctccattaaattcctgtcaacacattctttttttcatggaaatagacagacaattatgctttttgaactctactaacaacaatgaaaaacattaagatggaagactcatatgactattcaagaaagagcctggagagtgtctaaaagctgcttcccttcaatgcacagaagtatcagaaggtttatttcagcaaacaggaaacgttcaggatctaaaggaaagagggttttatttcaggcagtaatatttcattgagcttctggagccactgattcagaatggccagttcctttctaatttataccatgttcctcatttctggctgcctatttagctgaaggactctttcctgggcgagacttcatttgcctcctggaggaattcaagaaggaattaactaaggaggctgggataggaatttcaaacaaaatagaatggaagccaaaacattgtagataaaaggcttatgctaacccattatatgaaatgctttgggaaggacttaacagttgtcccttgagccatatgggtttaacactgtgggtccactaatatgcagatttttttcaaccaaatgcagataaaaaatacagtatttgcgagatgcaaaacccatgtataaggagggctgactaatttccatagggccttgaatattcacggattttgctatctgccgcagtcctggaaccaatcccctgtgtatactgagggatgactctcattgatctagaacttccacttaattttgcattctgtttcaacttaaacacacttcctcttagggaacaggaaaattttgaaagagaaatatataggctacactttataaaacttcaagtgcaaagtaatgaatagttaagggaagttagaaaggccttgggggaaatctagaaatagactctaacttagttgagacagctattaaatatttttttcccccattgcttagaaaaatacaaattttccctctggcaagatgggtctcattccctatgatgtgagccccttactgtggtcccacgtccctggccagtgagtggccggtgacctgggggatgggggctatagatggggatggaggcagcaatgatcttggctttcccactccctgcaagtggccagggggctgcaggtgggtgctgtgggcagttgctgatggaagcccaggcacccttctgtagtcctgtttgtgcttcctgaatccctgcatggaaaccaatgcctatgccattctccccgcttattggtgatgtcctctatcccctatatatttttttttttgagatggagtctcgctctgttgcccaggctacagtccagtagtgcgatctcagctcacctcaacctctgcctcccaggttcaagtgattctcctgcctcagcctcctgagtagctgggattacaggcgctgctaccacgccgagctttttatttttttttgaattattagtagagactgggtttcaccatgttggccaggctggtctcaaactcctgacctcaggtgatctgcctacctcagcctcccaacatgctgggattacaggtgtgagccactgcacatggccttctacccctatttgttaactcgaatttaaactcccatgcttgctggccttgtcacaataaaacaacaacttctgggaaatgttaaaaaaaaaaaattctcccctcctaaccaaaaaggaaaagttaggcaccccttattgagcagattttggaaatgaggccttgaataaaactttctagatgtgacttttttctcttaagggatttttgagccatgttgggggtgaagactctttggaggtatgcgatatgaattcctgcctgccttgtgagaggaacaaatgccgagcatcttggtgatccacgtttgtcactgggagcactgtctttttccttctggccagtaacactgtgaggttctcaggggcttagtgacgtgggccagacagttgagtctcctattcagtgttcctagtttgcagtggttcttgatttcctgaattacgtgctctgtttctctctttccatatataaagatatatatacatatatatatatatctttccatatatatatatatctttccatatatatatatatatatttccaaaattacttgttaacatttgttgatttttttttccccaaaatccctctgtcattacttgttagtctactgtagaatactgaagctcaggaaaatgagcttattttcttttctgtaagatgacttagggtaagaccctgtgagcacaggtctgtccagtccagaaagttcatggatcttaggagctactcaggggacacattgcctcttttctggcttcttcactgattctcgtttcagttgtgtttcaatgactgaggctgtgggaaagtgccctccacgtctgtgacgcctctcagggtcccgtgttgagtgtttggactcagggcccaggtgaagccagccttacctttttgtagagactcctcagatctcggtactgccacatgctgttgaggacctgagatgcagccttgaccacttttggagagtgtctgatgaagaaaagacaggaaaggcaagatgtgagtgggacagctgtgtcacatttctgtaattcttgtagtatttcaaacctcttcattattattatatctattatggtgatctatgatcagtgctccctgatattactactgtaattgttttggagcaccacgaactgcacccacctaagacagcaaccgtaatcaagaaatattgtgtgttccgactgctccacagactggcccttcctcctctctctcctcaggcctccctcttccataagacaaaacaatgtagaaattaggccaattaataaccctacaatggctcccaagtgttcaagtgaaagaaagggttgcacgcctcttactttaaatcaaaagcaagagatgattaagcttagcgaggaaggcacgccacaacccaagacgggccaaaagctgggcctcttgtgccaaacagtgagccaagttgtgaatgcaaaggaaaagttcttgaagaaaattaaaagtgctaccccagtgaacacacgaataataagaaagtaaaacaggcttattgctgatatggagaaagtttgagtggtttggataaaagatcatatcaaccacaacattcccttcagctaaaacccaatccacagcaaggccctgactctttttttttttttttttttttgagactgagtcttgctctgttgcctaggctggagtgcagtggcgagatcttggctcactgcaacctctgcctcgcgggttcaagcgattctccttcctcagcctcctgagtagctgggattacaggcgtgtgccaccatgcccagctattttgtatttttagtagagatggggtttcaccatgttggtcaggctggtctcgaactcctgacctcgtgatccacccgcctcagcctaccaaagtgctgggattacagacgtgatccaccgtgcccagccaactctcttaattatatgatggcttggtgaggtaaaaaagctacaggagaaaagtttaaagctagcagaagttgattaatgacttttaaggaaagaagatatttctacaacataaacaaaaatatttgtgtgatttgctttattgagatatttgctttattgcagtagtgtggaaccaaaactacaatatctctaaggtatgcctgtaattcctttgacttaaagacagagaattttagatcctttcatgaatccagatgaagctgcatttcattctcatataatcgatgctgaacaaagattaaatgtgatgttttgttgtattttatcatttagctaaatatttgttcatgacaatagccaagcaactctagaaaaacatatattaatattcaggtcgtgatagtgtagttgaaatacaattagtgtgcaaaaatgcttctgagtagaaacaaaagtgtagtttttgtttctatcttttgcatagttacaaaaccaaaagagactgtgaatgtgtaacgaacagcaggttttaacctctcaattaaaatgccaatacatcacagtgttatactaacatgtgaaggttaaagaaactttgctttctttttagactttaattttgatgcattcactagatggatgccatggaaatttctacctgaaaaactcttctaaatattgattgaagggcttggacaattgtgtgtttctaatgtgacaagtgattataacccaagccacaatacacagttctttactgacagtaacagttaagactgttaatagcttttccgtcttatgacaaaatatagtgacacattcaacactacttcccatataactgttaaaattggggaaaaaaaaccaaatgtattcttgagacagatgaacatgatagaatgtccataatgtatgtttaaaatgatgtgaaaagaataaataattaagatttcaaaatggcgagtataagactactataagagttaataacaattacacaattggagtttgatcttcactagagctgtcacatcaggggtggtgaggacttcagttggtgcagttcattgtggctgtcaacacagctgtgccagcggtgggatcacagaacactagcccccttggttgtgtccgccagacgctgtgagttgtgcagttctgatagactgtgattggcaactcgccaatctgactcattaacatcactgcacatttaagcttgtatatatatatatgtatatataaagaacatgtataaatacataaactagagcatcatagcaaggcacgtttcttccatctgtgttttcccatactatcacaaataaaaatcaggtttgaactgaacttatttctagaaataagtttttaaggaataatttagggtgggcaaattagcaatcattttataaataagctatggtgtatttgtatacctaccgttcccaattattaaattatcctcagttccaaaaatttgattttcaataaataaattctatttccttaaaatttgtctagaagtccatgggaatctccatacctactattataatagaattgagtcagaaatggtgagtttcatgctcaaatttggagcaattctcctgaattcattttgttttaagagcagtgaaaagcaataataaaactgaagtgtaggtaggagacgaggataaatgtagttataaaaaccttgttttgatctccaaattagtcagtatatatataaaaaaagagataagctacatgaaacagtgaatgagactgactaagcaggagaactgtaaccaggaagatgcttgattcaatccaatttaacacttcttattaaactcgtaaatccaggctgttggcattggaaaaagagataaaggaacaacaagacagaatgagcgcctattctataagtaaattttcagccaaattaaagggcatttatgagatcatctttagtgaaaaaaatcttcccattaacaataatcaagattggacctggcttatcaggaccttagcaacatggatctgtattattttatagatggtttcttcaagtgatttgtaatatcatttcatagatggtttcttcgagtgatttgtaaattagtttcaccaaataattttatttgaccataggactcaataaaacttttttttctctttaggcccatttagtgatgcttattgcagtaggaatgctcataaagttggagagaattaatatatgccaaaccactcctcaaagctctctaactgtataattcagagaaaatactttaatctttgaatgtctcatgaatatagacaagaatatatcagattgttttgcagactacggttttattgtgtgtgtgggtgtgtatgctcaagaaagcattaccatattaagatcttaatgctcaaaacaggtaagcacttcaattagagattccaaaggtctattgaagctaaataaagaagaaaaccatatggtttcctgcctacgtaggatagcactttattgtaagtacaatatcataagatatagctcaagccaacagtctccactgcgcaattattatatgagtccagtggggcttttctacttaatatgagaaaacattcaaatccaaatgcaaaattgttgattgagcctatttggaggtctctgggtgcttaaacagaaactccgaatcttctataatacattggtactatcctgaattaagtgaaataatgagacagaatttccagaaagtttcaaagtgcgtccctcaaagtgtttaataacaacaaactatttagcatttacatgtaaaagaatggggggtgggggtggcttggcagggaatgaaaagtcaagaaatagactcttgataacaaaatgtttacccttttaatcttatttaattacatcgagggacttccaagaggcaaaatttaattaaggttagtgaaggtttctgtaaaattgacaccttgctgatataccgatgcgctggcttgtgaagctattttccagctgtatatagtaagatactgttggttcttaaaaactaggaggcattcttattcaaggaggtgcagttgctttgacaccaagtctcatctctttttgttctatctgcacgaaggccctcctttctcaccactatctgcactgcctgggaaatttctactcattctttaagatttgattatcaactcttccagctagcatattgtgacagcctctcccttaggtttagattggaaagtataggcatagtgacttgttaaattaaatatttgccccacatctcacagcttgtaagggagggtactagatgagaactgagttctctgactccatcatgccctgtctcctcccccatccttcctgcatggtgacttgctatgacttggtggctactgtgatgttggtaaggtggacctgacttggttgcagagctgaagaggcacagagcagagggatgtagagacatcatcaacacacggacttcccaccacagaggaacaacaacaaaataccttcatgtatccaggttgaactcgtgtcgctgccatgtggaaggagcacatgggtgtgctggatcgtcaagtccattttaccaacagtaagagagaagactggaaaccatttgccattttccttctcttgattctcagagacaaatgctttccagtgacagtcatagtactacccgtcatcaggagttgaaaggcacattcagaaccaattttaccaggacagagatatggcgtcaccaggtaacttacttatctcctttgcttttggagatgccgaccaacttctcgatgccaccggcatcccgtaaggccttggcgttctccatgttcttggtaatcacttcgtgcagtgtgcagcagacagctgtcactgtgtcatccgacatggccttgcttgcagtgttgttgctgttgttccctcctggaagcctgtggactaggtctcgcatggcgtatttgcctggaaaagaaaataaagagaagagttgaaaggaggtcaaggtgaaggcagagatagtggcagaggtgggtatgggggagaagagaatacgagaggccacgtttatgcaaaattgtttgtttcccatcactgaatgttccctattgggtagttttacacacatctacagagaaaaacagtcattcctcatggcagtgcatccactctgctgctagattgacctgggatcaaatcactggccaagttatttcatgcctctgaagcctcagttttttcaatctctaaaggaagacaataatggtacctgccatacaaggttgctgtaaagcataaatgagtgaatgtatggaaatgaacaaggacacaggactccataggtattagctattattatgttcttgcttgatgtttatagaagtcaagaaaaatgtatgggaattctaacataaccctcaaaaataccttaatgaaagctatgttgcggcctgtattttttaaaaacagtcaaagcaaaaatgtgtggggaacatgatcacatatgtgagtactgagctttgattcatttaaagcaaggagaaacactgaaagcaggagagaggtacttgacaatctataactatgtgtcctctgaactatagtaacctgatgctgtttgtctctctgatgggattttattgtgtagttctaccaggtaacacttactaatttggtgtgtttttgtgtgaaaaatataatacaatccaattctgcttccttaattcactttaacattattaatcttactattcccaatgacaaaggtacttataatgacatatttatggagtacttttagtttacaaagcactttaggcattaccaatagccctgcaagacaattaatttatcccacctgcagcttccatttctgctcctttaattgacttctggaagtaagtaaatgagtgcctgtagcaaagctggctgttctcacatttttcagatggaattggcaagtgcctaaagttagatccctttcttgtctcccatcccccaattaggcacatttagctagctcctaaaggctgtttgaaatatttcacctccatgtacatatctataaataatagtcttcttctgctatttaattctctggtgtatggtgcctggcagcaggaagggaaccttgtgggagtaggcgatgatatcttaattccaggcagtgatacataaaacacaggcccttgtaattttggtatctgctcttatcctatgtttaggtggcttattttagcttagagagaaaatgctgatacttaaattactgaaatagaaaagtgtgttcattcacttgatgatagctgaggaagtgtctgacaaaaatggtttgcctgcaaacccccaaatgtagcatatttattttctaatgacagcacctaaaatagtttatctatttatcattaaatcagccttaactctggttaagagtttactttcgtagggctcagcatgctggagattctaccagttcattaacccccacaaaccattagaagacaaatttgagctccacagacatgaaatgatcaatgtgttcctttttcctttttcttataaggaaagtgatgaaggaagggcaaaataactgaaaaaatactccagtcattgtatatacggggacatttacacccttgactgtgtatggaggactggtttcatgaccttggacactgtcaaggttaaaaccaaaaatgaagagagggttaagaatttggctgtagcattttttagttttgttggtattatcattttgaaaattatgtcagataaatatgaagatgtagtctcatcctccatggctttccaatccttgagtcctgattaagatgcgggtctccctgtaatgttagtttatttatagataataagtagatggcagggtacccaacccctgcagagcagcctcttccactcaccccaatgtgccattcaagtactatcattttccatgtgccccatggtatggaaaagaccaggagtcactgttatatttaacttaccccaactttactgtcgaggaaactcattggatttatcttatttctagtatttccaatataggttactgacattttactaggcaattggagatttttcattaagtctatttatcagtctactatttatcagtctatctggaggaatatattttagtccaaatttttgaccatccaagtaaagaaacaaatcaggtaatattattccacggagaagaaaacctcggggcagtttgttaattattttaaaagtttacaattcttttttagcctttgattatgtgttgaaaaatgctgtctttttacagtgaaatttaaatcctatcttcacaagaaatttgggtagcaaaaaaagatttttagctctttctagtgtttagaaactttgaagctgattagggaaataataaaatgtgggacatagaataattacagatgcaagtgaccttgtgttgtatgtttataacagtagttcagggaagagacaagttagataggactggagttattatggaaggcttgattcaggaggtgtacatttaggattttttcttgtatgtcaagggggcaacaagaacaacttgatattttacaaaaagaattctggtgcattaagaaggaaggtttcagaatagtaaaactgagggtggaagaaacatagtctttttcttgacaataatgttctcttcttctagacttctagtgaaattataagcactacaactcaaggtagtgtgcttctataactgttccatatcctgtattttctttttaacctaagtttctaaacacttgaaagagctaaaaagctattcttgctgcccagtaggaggaatcttgattcctctccttctactgtttcaggcagacttttgggtctttgaggtctgagatttcttcagagggtaaaagaagttaattccctttttttgtatcacattggcaacaggaaactgcaaagtgggtggttcaaactttttttatagtttcacaccatcaaggtggtcaaattgtttccttttctttttagagagagaaatggatggaggtagggttcttttaggactggggaagaaagaggctggatcaccaggtggaggttgtgggcagttcttcacagtcccagggacagaaagggcacctagagcccagctgtggtcctgtggtgcactgagattctctgtggatgcagagcataagcttcctcctgtgtttgagcctggcatggggcagaagaagtgcctgtcttggaatgacctgcttaggccctcaaaaggagcaggcaccagtaaccactgcaaatagatgactgctccagctgactactccaccttcttcttctttttttttttttttttttttaagacagtctcactctgttgtccaggctggagtgcagtggtatgatctcatctcaatgcaacctccatctcctgggttcaagcgattcttctgcctcagcctcccgagtagctgggactacaggcacatgccaccacacctggctaccttttgaattttagtatagatggggtttcaccatgttagccaggctggtctcaaactcctgacctcaagtgatctgcctgcctctgcctcccaaagtgctgggattacaggtgtaagccaccatgcacagctgactctaccttctagatttaatttgattaaaagatatgacacagactgaaaataatagagtgattcattcatttggcaggaaactataatatttcaggaacaaacaagaacctgtgactacaaaaaggtggtcatgggaggatcaaggacatgagagcagccattatggaaattcttaagaagcaactgacagggcttggagcccagggaaatgttgaggtaatgcagggaaacaggattcagagatttcacgcgggaataacacagagggtagtaaaaaccaagtgaattttaaagcttaatattaatggataaattgaatgttatttttccacacaaagaaaaacatgcaaaattagttatattacttatatgagagaatcacgtaccaaaatcccgtcagagagacaagcaggtcatcaggttcaaagaatacctggatttatgaaagcaaagtggataccttgccttgcttctattttgaataaatgtgctaccaacgatccactatcatggactcacatctgaaaaagggaaatcatggtgctcgcttcggcagcacatatactaaaattggaatgatacagagaaagattagcatggcccctgtgcaaagataatacataaatttgtgaggcgttccatcttttgtttttttaaaaagaaaagcttgttctttgtcagatcaaaacaatacaaaacaagactgtaccaccaccactaccacaaacaaagtcactctttcttgctacagttcccaatagaaatgaatccttgggccatttcttttaagttacttagtctctagtaacaatgactatatgtctgatttttgcaatactggtaagagactaccattggtgataacataattgtgcagaaaaaggactgtattttcatcaatgatggactaactgaaaccttgtaactttgctaccctttccactgtgtgtatgtgtgtgtgtgtgtgtttccttcaaatacctgtattttgtatttggtgaaccagttttctaaatccagattttcttgaaaaactgcaagtaaagattattttctctttacagtgcttcattctcgaactcttctgttaagcattgttgggcacaccaaggtaccccaagggactcactcaggagacctaacaaaccatgttgcccaagaaaggcactccttgcagaccgcttgtgcagaaaggagctggtggggatttcatgatgaggtaacagccttgctctcgttgactgcttcggtttccatgttgtgtttgtgactttctgtttctatttctgaactaagcctgtatttgttactgatgtgcatactaccatttggttttcgcattggtggcaggaatgttgagtggtggtcttatggtctaaagacctgcattctctaaggcagcagacaacagggaagtcacttgagttccttcctacacttactatagatctcttctgatcactgatggagtcctatgtgtagatggtctttgttgtgcaccattataaacttaaatgtctcaaactgattagagaaaatatatttttccagaaggtcagctggactggagagcaaccccggatgagaaacatcacaactcctttgtcttcgaggtttaagtagttctatggccctcctgtttctgcagctgctaaaactgatctgtgggtttttgctgaggtgctctgagtttattttttctaaaaaacttctttattgcagtaaaatacttataaaatttaccattttatccattttaagtatatagttcattgatattatgtagactcatatcattctacaatcatatatctccaaaactcttttcatcttgcaaaattgaaactttaaaagcatttaaacaactccccaacccttcccttcagtccctggaaacccccattctactttctgtctctttgaatttgacaaccaggtacctcatataaatggcatcataaaggatttgtctttttgtgattggattatttcacttagcataatgttcttaaggttcatccatgttgtagcatatgtcagaatgtacactctttttttctttttttccaagcagggtctcattctgtcatccagggtgtagtgcactggtgcaatttcagctgactgcaacctctgcctcctgggttcaagcaattctcattcctcagcctcctgagtagctgagattacaggtatgtgacaccccacccagctaattttttgtatgtttagtagatacagggtgtcactatgttggccaggctggtttgaactcctggcctcaagtgatctgcccaccttggccttccaaagtgctggcagtacaggcgtgagccactgcacccagacagaactttcttttcaagactgaataatattccattgcatgtatatatcatattttgctattcttctgttgacgaaaaattgggttgatacttcattttcactcttgagaataatggtgtgaacacggatgtacaaatatccttttactttcaatctatttctgtctttgaatctaaagtaagttttttgtaggcaacatataattgcatcatatttttttaatgcactctgtcaatctctgtctttgattggagagtttatccatgtatatttaaagtaattactcataaaaagggtcttatttctagcgtttttctgttttctatatgccttgtagcttttttgtttgtccctaatttcctgcaccactatctcctttgtgttgattgttttctgtagtgaaatgttttaatttccttattttctttcgtctatatagtttaatgattttctttgtggttaccacagggattacatttaacattataccattataatttgaatttataccaggttaacttcaataacatacaaacactttgttcatttacagttccatctcacacttttcagttattgatgtcacacaattacatctttaaacattgtgtgtccaaaaacataaataattggtttttaaaaacgaattatgtagaaaatttctctttaattatgtagaaaaaaatgtggagttaggaaacaaagtcacaataatgctagcctttaaactagtaattgctttttcttaaatgtactgaattatgtagaaaacaaaagtagcattataaaccattgttaaaacaatatgagctttataattgcccatgtatttatctctactaagatctttatttcttcttatacctttgaattactgtttagtgttcttgcatttcaacatgcaggactccctttaggatttcttacagagcaggtctagtggtagtgaactctcttagtttctgtttatcagggaatgtcttaagttttccctcacttctgctggacataggattcttggctgacagttttttttttctttcggcaccatgactatatcaacctactacctctggtcttcaaaattttgattaaaaaatcagctgataaccttattttggatttcttgtgtgtgatgagtcacttctctctgctttcaagattctttatctatgtctttcaacaatttgattgtaatgtgtttcagtctaggtatctttgagcttatcctatttgaatctcattgagtcttgaatgtttatatttatgccttttgttaaatttggtaagttttcagccattatttcctctaataatctctctatccctttcccactttttttctcctgagtcttttgtagtgtgtatttgatcttcttgatgatgtccacagaacccttaagctctgctccttttcttcgatcttttttctttctgttctccaaagtcagtaatttaaattttcctgtctttcaactttgctgattctttcttctgcctgctcaaatctgccttttcatttctttagtgaatttttcatttcaattattgtacttttcagctctaaattttttggtttgtttttaggttttctatgcctttatttatgtttccattttgttcacacatcatgttcttgactctcttcatatcttcctttaattctttgaacatctttaaaacagttgttttaaagtctttgtctagtagatctacctttgtgccatttttcagctatggtttctgtttttttttttttttttttttagtttgtttgttgtttttccttgaactggtcatacttccctgtttcattgtatgccttgtggttttttattgttgttgaaactgaaaatttgaatgtaataatgggttatctggaaatcagattcttcctcttttccagggtttgtaattttttgtttttgttttgtttttgactgttttaggctgtctctgtgttgagaattagccttaagatcttcacagatgttttctgagcatgagagtttccctgggcatgcatactggctctcttatttctcttgtatatgcagttgcttttgaatatgctagtctttaatgactggctcccaaaaagggaaaagaaaaacataaagtggatgaggagggtgacggtgtcagctctttaaatcctctgaaaataacttcagccaaagatagaggggcttgcaatcatggtatgggtatgtgcaacaatggctgcttgcctctgtgtttgtgtcactgtagtgagaagcagcaatcagcagaaagaacagatccacgatatttagaggacggggtcttttgtgtcaaccctggtttctgccagctgcaagtaagctgctctaggaacatgtgcacagctgcctgctacagggctgaggggtgggggatgggtagctactgtgagctaagctgagattgaccaaatatactgtactttactgtccaagccttctgaaatttttaagtcttcaatagactccagagtttcaaaatagttatatcagtgtgatggttaatattaggtgtcagcttaattggattgaaggatgcctcggtgggctggtaaagtagtgtttctggtgtgtctgtgagggtgttgccaggggagattaacatttgagtcagtggattgggagagacagacccaccctcaaggtgggtgggcaccatccagtcggctgccagcatggctagaacaaaagcaggtggaaaaaggtgtgataagatggcttgctgaaccttctggctttcacctttctcccatgctggatgcttcttgcccttgaacgtcagactccagttctttggcatctggactcttggacttacaccactggtttgacaggggcttttgggccttcggccacagactgaaggctgcactgttgtccttccctacttttgagacttttggtgtcagactgagccactgatggcttctttcttcatcatcttgcagatggcctatcatggggcttcaccttgtgatcatgtaagccaattctccttaataaacttcctttcatatatacatatatcctattagttctgtccctctggagaatcctgactaatagacagattctgccaatgtgattgtgtccaggtggtgagacaaattcctggtgcttcctacttctccatcagcctagaatcctctcccgtctctgaatttacttttcatcaataattgatgatataaaagtgaggagctgatttccatgtgattggatgtctgtaagttagtgtgaaaaggattaaagggtttttttccttttgtatataaaaggttgtttgatgtttacaatgctggaatgttttgtctctcatttctcttttgggaagtatttggagcttaatttatagaaatctgtcatttgcacactataaatatatctaatttaaacacagtctatcatcaaaggggaaaaatatatgcaaaaaatatatattttaaaactggttagtgtggcttacagaccaaattggtgaagcattcaaaatggtattgcttagttactgaaaatgtctgaatgcttgttaatgtgggaaaagtctcttctggattgtccggagatctctgacctctggaaacatctggaaggttctgagtgcttatttttttttcccctaaaacaaaatacatggaatactacttagcaatcaaaaggaacactatgtgctacaacgtgaaaagatttgaatggtattatgctaagtgaaaaaagccagtctcaaaaggttctatattgtaagataccacttatataacattcttgaaataacaaaattatagagatggagaacaaattaatgattgctaggagtttaggatacttaggaagactgtgactatgacaagatggtacaacaaatatcattgggttgagggaataattctgtattttgatagccttgatggttacacaaatccacacatgtgatgacactgtacacatatactgcaatgttaatttcctgatttattgtgttatagttacataagatatagccattgctggaaactggctgagggatgcataggacccctccttactatctttgcaatttcctgtgaatccataatttttttaaagttaaaaattagaaaagtcacacagaaatatagaaatatgccaataaacatgtgctgacaaaaaggtgttaataaatcttaaaatgtatcccctggttcaatccacaatggacttgacaaggattacaaaaaaatagcacatatgagataagaagacatccagtcagaagttcctgaatcctccagcttacccaagagtttgctggggattcttctgttgtatgtgtataaacattttctgtgtctagaaattggtataacttttctattctctggatgagactgataaatggagctcccaatttgattggcttatgtaaacaagtaagtccttgtatatgtaattacaacaagaaaactaaaaaattgccaatgaaaatactctcagaatgctttaagttgctggtcctttaagaaaaaaaataaaaatctggccaggcttggtggctcatgcctataatcccagcactttgggaggccaaggtgggcgaatcatgaggtcaggagttcgagaccagcttggccaacatggtgaaaccctgtctctactaaaaataaaaaaaattagctgggtgcagtggcgggagcctgtaatcccagttactcgggaggttgaggcaggagaatcgcttgaacctgggaggcagaggttgcagtgagctgagatcatgccactgtactccagcccaggcaacagagtacgactgtctcaacaacaacagcaacaacaacaacaacatctttcacaaaagcttatttcaaggaaaaacacaaagaaatttcacaatgaattaaattaacagccttggtagctaggttaaaaaatttaaagcaaagaaataaaagttgataccaggttagcaaagacaaggtaaaaaatagtactaagacacttcaggacctttaaggatatttgaagaggtttcaatatttagtatctaaggtaaaaagagttgatgcagtattttcaggtaaaggaaatccttgcaaaatcagactgatttgataatattaggggaaaaacagagatgtctttcccctggttttatcatttcataaatcttttgttagcatgatctgttttataaaagattaggtttgtttcctcaatttttaataatacgaatttttaagatttccaattctaggtttattaaacagataagctaatattattatttaaacatttaaaaaggttaacgagtgttcagctagattgaattgtaataactgctgtttcatgaaggagtcgctcttcttcaccttagggaattccacaacaatctgttactgagttactccaccaaattcctctgagtaaaattcttagtgtcctctttttgaaaaaacactgtccactaaacacataggcacacacatatatgcgcttcaaatatctgcaaatgtacaaatgtcctggacttgttcatgttgctaattcatgaaatacaaaaacaatatatcagactgttggaggaaggacattgtgaggagtcacaggcagctttctggaatctcagctgatctcaagtgcacacaggcaactgtctcctagccttctctatgtctgtgaggaaacaactcagttacatggtttcaaagttataactcatgaaaagtagatgctgcatgtgttagttttcttcttttttttttaatgtgatctttgtcattttttattgtgtttattgggatcttgttttttttgttaagctaactactagtggtctgttgatcttttttttgcctcttttttaaatttattattattatactttaagttttagggtacatgtgcacagtgtgcaggttagttacatatgtatacatgtgccatgctggtgcgctgcacccactaactcgtcatctagcattaggtatatctcccaatgctatccctcccccctccccccaccccacagcagtccccagagtgtgatgttccccttcctgtgtccatgtgttctcattgttcaattcccacctatgagtgagaatatgcggtgtttggttttctaatgctgctgtaacaaatcaccacaggttcagtgctttaaaactagatacatttattatttcacagttctgcaggttagaagtacaacactggtcttactaggcttcaattagggtgtgggtagattacggtgtgggaaggactgcattctgggagctctaggagagaatcattttcttgccttttccagttcctagaggccacctgatttccttggcatgtaaccctctgtttctacctttaaaactagcaacaatgggcctttcttgtgtcacatcgctctgaccctttcatttgcctccagctgctcccttttccacttttaaggacctttgtgattacattgggcccactgggataatccagggtcttcttcctatctcaaggttagctgattataaaccttaattccccttggccacgtaaggtggcacagccacaggtctgggggaataggctctggacatctttgggaggacattattctgcctactacactgtactaggtacaatagttgtaaaataatatgaatgtgtctgtaagataatggaatgcatttttgtttatcgaggaagaaagtgtgtctaaggttaaaaaatctggctgtgtgttaatatgtaaaattaagacatatttgaggatgtgcaataagttatggaaaggttgagaagaagtgaaccttatttgtcttggtttataatgcctggaaataatgaacttgaaaaaaaaaaacaatgaaaggtgtcacagtcttttataaagtttgtgtaattttgatgagtttacttacaagatagagaaaaggcctgtgaactttctactgcaaatgttacatgagtagggtacaaaaataatgaagttagtgttgggttttctctctgattatatttgagtatatactctgttttcagtaagaaattgtgaagaatagtctgtgcccaaagaacaagagcttcttttgtcactaaaatcctcctacttgatatcgtgttaattttttttttgcgcttttgttactctcgagtcacttttagcaaaatttcctcacttgtggaaatgctagagttcaatcttttaaattaatatttagcaaaagatccttgcttatgaaaatgctagagttcctaataacttctttaaccgttttattataaatattatcattctgagccaagctgaagttacgtcttgtcttcagccactccagatttacactcatatcttgcatcccagataactctttttgaaattgccttccacaaatctgcacccccacagtcaaactaatacaactttttttttttggacagagtttcactcttgttacccaggctggagtgcaatggcacgatcttggctcgctgcaacctctgcctcctgcgttcaaacaattctcctgcctcatcctcccaagtagctgggattacaggtgcccaccaccaagcctggctaattttttgtattttttggtagaaatgggatttcaccacgttggccacacacctcggcctcccaaagtgctgggactacaggcatgagccactgcgcctggcctcaaactaatacaacttttagaagtatcttctacatctaaaccatctttgcggtttctcagaaaacttccggtgacactaaagatttttcttcttcactttatgagaaaagggatcctagaaataattggctatgttcagcatttcgtagatttttatttggtttaatactatgttgagagctgtcctgttcatcaagaatccaatacaaaaagacctgccaagacatgaaaaaatgaaaagctcaaccaccacttaattatgatgagtaaaatatgagcattatgattatgcttcagcagtgatgaccttttcattgtggagagaggcacactctccttcatgttaaagaatggcacaataatggtcaacaattttttaaaagaagatcccatttccacatttaaaatagccttttcagttggtggtaatccaaacacacattggatggaataaattaaaaggccatggagattgttctgtgccctcaccactctcatggccgtcactgactaattatttatgaaactaaactggcctcaatttggatattagtggttataatgagtaaacaaccagacctattcagccttagcaccaacaggtggtttctgattttttgtcacacgatcctaaatacccctgccaaaaccatgcgtcagtattgatggctgctggaagaaacatcacaacagctcgattaaaggactctaacaagttctttcgacacttcatagaatagaaaattggatcttagttacacgcatccctatatcagctgatatcaccaccacatatgaagactaccaagggactgagtcaggagttccagaacttgtttgcactggaggcagaaaactttgagaaagtggagtgcctactaatccaagatcaacaaaacaaggattaattacctcaacaaaatgatacaaatttcgctgtgattactgttctgatttgaatcgggcatgttatagaagccttctgtctatttcctctgtctccagtgcttgatctaacaggttatgcttataaagactagaataaaacattccttaaatggtatcttctaattaatccttcaaaactcatttttaaaatcctttaaaaattttaaaacagatgatgataataaattatcaggaaaagctaataactataatagtcctgcaaatatcatgacatatattgattggtctgaaactatacaacaactgaaagcaatagttacattattatttaactattattattactaatctgggtgtttttctttagccataggccttcatatttacctagaatctgtcctccttcctaccagaatgtaattgagtaaatcaaatctgtgataatgaccatgccagagatgttacatttaaagggaaatataatgtaattagacatgacaagctcatttaaaatgagtgcatttcatatgtggggttaatgcctacaccatcctcccaggacactggcttggttcatgttgtgtagcttagggcaggggtccccaagccctgggccatggaacaatactggtccatggcctgttaggaaccaggccacacagcaggaggtgagcagcaggtgagcgagaattacagcctgagcttcgccttctgtcagatcagtggtgtcattagattcttacaggagtgtgagccctattgtgaacaatgcatgtgaaggagctaggttgcacacgccttatgagaatctaattaatgccagatgatctgaggtggacactttcatcctgaaaccatcttccccaccgacctcagtccatggaaaaatggtcttccatgaaactggtccctgctgccacaaaggttggggaacgttggcttagggaatcccaactctacaggcagtatggccaggagcactgaaaacttggagctcagagagatggaataatctttgagacctaggtagtggatgtgaaacctggaagaggtgaactttgaatctgaaagttctggattactgatttcagcaatccagaatcaaatatttctgccacagatataaaagtgaccacaaaacaaaagttaaccctcaagatttaacatcatatagctctcatttttataaccatgctaaggggtctttgtgaatgaatcaacactgcttgctatacctatgtctatacagctggttcaataagacaacatatcaaattaatgatcacaaataggaaaactgctaaccaaacacctgtggttaaatctattttaggggcagaacgtcagcattataactgtaaaggcaaaccagtacccagctctgcacctgtcatggcagcgtgcacatcatgtgcttgtcacagtcctcattcagggaaacaggacaaagccaagctcagggaaacaatcccaaagcaagcaagcaagcaagcaagcaaacaaacaaacaaaacacacaatcgcctttctactgtagtcccaaataatgaatctttgacccatttcctaacagttgcagactccccaatcaacatcatctctgacattggcaataccaatctgtgacaatgtgattaccttgtgagaaaactgctgtttgcccagcatgacctgactaaatgtaaccttacaaaccaaggtaattttgtacttagttttaaatgtagacggctggtcttaattctggctcccctgcaacaatccataagaaaacccctttctcatcttgatgctttttctttctgtcttcctttcacacagtggacgatggctgtggcaacaccaaccctctggattgatcataccagtccccttttcccagaaagggacctgttcatctccacatctgcccctttgctcttgctagattcaaataaatatttcaagagatgccttgatttttttaaaaaatgaatcttcttttataatctgcctgttgttttaattgattagagatttattcaaatagaaaaagagagagagaaggaatattaagaagagaccagctggagccaggggatcaaatagttgcaatgggcagaggataagacaaattctagaaggtacactaaagttccttatgtttttttctaataaccattattttaaaaaacaagtacaggccaggcacagtagctcacacctgtaatcccagcactttgggaggccgaggctggtagattgcatgaggtcaggagttcgagaccagcttggccaacatgacgaaaccccatctctactaaaaatgcaaaaattagccaggcatggtgacacgtgcctgtagtcccagctacttgggaggctgaggcagaagaatcagttggacctgggaggcagaggttgcaatgagctgagatcacaccactgcactccagcctgggttaacagagtgaactctgtctcaaaaaagcaaacaaacaaaaaaaactccgaaaaaattagctgggcatggtggcgggtgcctgtaatcccagctactcaggaggctgaggcaggagaattgtttgaacccgggaggtggaggttgcagtgagctgagatcacgccattgcactctagcctgggtgacagggtaagactcagtctcaaaaaaacaaaaacaaaaacaaaaagcacagacctgtagcacatataagatcctatttcacatgcccgaattggtaagcagttagtctgagaaaatgattcaaagagtaactcaatcctctgaaaagaaataacattgaatgaggcagaatcttacaggtttatggcatacggtatgcatttctttcaagagttgttatactcaaataaataacctattccatctgtttggaagacaaaaggaattgtatgtttcagcaccttgtctcatccaggggaattcactgaattagattctgagaaattctcacactgttgaagtgtgaagaactaagaaaatgagtagaactgtgggcaagaaggtggctgagatatgcatatttaactagtataagaatggttctaaaaataaaaatggcagttaattaacaagagatttgctgaagttcctttttgaactagaaataaattgatttttgagaaatactgaaaatgaggcaagcaactaatatgatacattttaacaggatttaaataatttgattaactattaagcatgataaccataaaaataattatctcaattcattgactaattttagcagaaaggaatgatgaaaatttaaacttactgattctagcttcaggagagaaacctatgaagggtgttttatttttaggtcaagattgctatctagcaaagacccaagaactctcctaagatgaaaatttcagaagacaattgtctgtctgagacagatgagatcagtgtttctctgaagaaaagtttgttttcaggaatagagtctgaaattagtcctccaacctgagcgacattggaatagcagtaattcattgattactgcaatggcttaatgattaattatataatcacattccctcattcttgcttttccaaattgatttacacctctgccaaaataaaaatcagacccaattaaggatatggagagagggaatcatctgttggttttcttcatatgctgttactcatagatgacattatgtagtgttctaacttttttaagaacattcatattcattatttccatttgtgtcttacattaccctagggatataaaaatggcaggtataatttccaatttatctagaagacaaatagaagttaaatggtatgggaaaggtcacagagctgtctcctgagctttggtgaccataagtctcttaggcagaagctcttttctccagcctaaccctcctgactccttcctctgagctcttttcacagggatagactgcctttaccacctgtgtgacaccttccctgtcatgcatttattcagccagtcattccaaaaacattcattgaagttgcatctagtttgctgatgtatataatttatccttctatcatataaactgaggataggatgatagctaacaaacctatgtctactgataataaacaaattgcatgaggcttttgaccacacaaggtaagaaggtacaacagcactttgatcactgaaaattgcattcatatttatcctgttgcagttgttatttacttctatgcaggtctggggaatactagttttaaaaggtgctatgttataaatagggtttcactgcaacataaatgcaggaaatactgtacttgatactcatctcagagatttataatgtattagcaaatttactttgaattagcaaagtaaaggctctgagcagaccaacagacacaatgaagccaactgttcaactttgtttaagcacaggttttgccaaacttatcagaatagagaaacttatgagaatagagaaacttatcagaatagagaaagcagtcttgggcatggcatccattccatttccagagaagtgggggtctgaggactcagtctggggccctgctgctactgttcttgttcctttgattaagttttcatgtcaccaagtgcacacagatctttacaccacagaagctgtaatttcacaacttaaattaatgttgatgaaaactagaactaaaagaaaaactcttactatgaaaaagggatggtcagagaagacgtatgttagtctgtttttagtgttggctgataggagcagctcaccccaatacactttattcctaaatgcatctgtcttgttcttatgttatacacgcacaccttgttcacagaggacttcgtaaactagagagatatgtggcattaaagaaggatatgtaattatttgcttaaaatttcatcttccttattaaccaatgagatgtttatggatgaattccaagatggttctcaaacagaggaagttcactgtacgaaactcatgtaattttgttgcccaagtcaatttttgtcctgggacttaccagccaagccaagtgctggtttccacatggcaattctacttctaatgtaaattatagaattgagctttggataccgggaagtctttggtggctttaggtcactggttcaccagggtctgatttggcttataaaaaacctgtacatctaggatttcctccagagctgaaatagacccaagaaggcagcaagcctggtgtggcttggggtggttggaccatcacttcatctcttttcctaacacatataatggggccctaatttcatgccaggtgcctgaacttttccagatcttacaaaagccttgtcccccttatgtttaggaggtaatcttctttcttagatgcaagatagtttagatggttcttaccaacaaaagagatagtatcctttctcaaaaaatacttccaatcacttgtcttcacttcgagattggtctttaatagtgttagcttataaaattttttatatctaggtcagagcttatttttttttttttaggataaaggaattgggcctcttttgtatttttatagtacacagaatttctatttcaagagaaataacatgagaacccaaagatacttaaatgtattttagtaaaattggtttgtgctttagatatttctccaagtgtcctagctagtgaaaacactattcctatgaactgtaagaatgtctcaggctatataatattgactgtatgtttgttagttaaccacagtagacatttttaatgaaactgttagcattattattactctacccaggattccagcattcatattgtaggcttatgtcgtatgcataaaacatacaggatttacatgtgatgagtttaaaactttggtagttgtatttgcgctatactaaaaaaaatcagtaactgtatgttgtaattgtatgaactgttcacaagtagataggtagaaaaaacataaggtatgatgaaatgaataaaaagagaccaagtagatataaaaacagaagcaaaaaatgagcttagaagaccaaaaatggaccaaagtttattttaactaatttcactcaattaaaatgacttattgttatatctgagccaagtgatgacccactttttacaagcaatattaatatggtaaaatttcaggaaaagaaaagaagctgcagtgctgtggcaatttctttattgagatgggatttcacttgtagcaaaggagaaagatttgatgagtaaaagagattgcatggaagattaaaaaagcaggaaaatactagacacagagcttctgtaaatcacttggctcaaacctcaggaaagtgttcagtgtttgagttttctcttctgaaattgcaatttttggaaaagtttaagtatctatttgtctccctcactagggagcccaggcaggggatagaggctgtcattcacacttggctgagagtaactggcccacaggcacaggccctgcatcttccagcaggttgtacagcggggtagcagcctctgcccggcaggactctgatggtcctgcctgtctgctctcattctgcaatgaggtaccgtgacaggaggtcctttcccttggtaagaatgacttcctagcagtgtcaccttctgaaatgcagacaccaaacatgccctgcacactgccctgccactctgtcaagcccgtttggcatgatctgacagacgacagggaggtgagtgatcatctgctaggattgcaggagcctacacattggtagacaagtagcttaactattattacacagtgactatggtcagcctcatcaaaccaaaccaaaccatgcaaatccatacatccatccagcaaaaatagaggtcttcatattatagaacgatattttctatgtacatttcataatccgatataagcagtccctcctaccctattttcaaagtgagtagaaacaacacatgcttgcaaaaaaaaaaaatacatatatatatatatatataaatgggttgttggcttctttttaagtctgaagattcagtgatgtttgtttggttttacaaaattccattagttaaacagagcttatgcagcatctgttttccttccagtgtcacattgctaaggtcaagttcaggtgagcatgtgcctgaatacagatccaggagcagagtggtggacagggacagggaaagatggtggtgctcaaaggaaactgtcactggagactacagcacaggatcagctggtggttctgctattcctcatgtgagtcaggccagagcagagctggagaaaaatgtaggacttcaggggtttcagggtagtgcccccttgggccaccactggggaccctgagggcccctgaaaatggtacttctttcttttcctttccattagtttcctgtgactgcttcagtggattattacaaacagggtgacataaaaaatcagaaatgtatccctcacagttctggaagtcacaagtctgaaatcaaggtatcagcagacagggccatgctcccgcctaaggctctaggggaggcctggcatttattctggtggctcctgacatttactggattggggctgtgtcttagtccatttgtactgctataaaagaatacctgagactgggtaattcgtaaagaaaataagtttatttggatcatggttctgcaggctgtacataaagcatggtgccagcatctgcttttggtaagggcttcagaaagcttccacccacagcagaaggtgaagggaagccagtgtgtgcagagatcgtacggggagagaaggatgcaagagggagggggggaaggtgccaggctctgtttataacaatcagatcttgcaatatcgaacagagtgatactcactcattaaggcaccaagccattactgagggatctgtccctgtgacccacatacctcccacaaggccccatctccaacactggggactgcattctagcatgagattttgaggggacaaacatccaaaccaaatcaggctgcatcgctcccatctctgcctccaccctcacatggccttctcctctgcgtctgtgtcatctcctcttgtgtctcttacaaggacacttagctttggatttatagcccacttggataatctaggatgatctcatctcaagacccttaacttaattgtatctgcaaatactctttttccaaataaggtcacactcacagattctggggacttagacttggacagatttttggggggccaccatctcacccactacactttccttatctcctctcccatccctcctttatcttaaagaatgttcccttcccttctctgtcctctcttcctgtcttccactgataagttggagactcaggaccttcctccttggtggttttaaccagaaatattaagtggctggtcccctgtctgtgctgcagggcagggtggctgctggctcagcagctgttggggctacttggtgtgggatggggtggaaacgggtatgctgccggttctgggttgaattgttaccccctcaccaaaattcttatgttgatatcctaacccccagtccctcagaatgcggccttatgtagcaacagggtcattgctgatgtaattagttaagaggtcatactggagtggggtgggctcctaatccaatatgacagagatccttacagaaaggggaaatttggatccagagatagatgcacacaaggaaagcaccatgtgaagatgaagcagagattgaggcgatgcttctacaagccaaggaacgccatctattgacagcaaatcagcagaagcgagggcggcagcctaggacagattgtccctcacagccttccaaggcaatcgaccctgtgacacgctaatctgaaacttcctgcctccagcacatttaacccatgcagttaggggcactttgttataggaaccctattaaaccaacacactgcttgacttttgggtttaggtacgtttcagagctgctactttgaagaagagaccacaaagaacagttctattttgctttatttgacaaataatcatgtctcatcagtcatatggaatcccacggaatttgccatttcacttttaacgctgtctgaaatctcattgaatgatatctcaacttggtatttaagaccaaataagcaaaagcaaataaataaaataaataaaaatgatgcttcagttaatcacattggctgccatcatcactgtcactaccactggattctgttttgtccaaatctgttaaaacaaaacaaaacaaaacaaaacaaacaacaacaaaaaaacaggcttcaagctccctggagttaacaaagcacagagccagcactgacgaaatggcaagctcaagaccaatttctctagaaagtccttgacagccacagaaagcccatgcgttttcatgggcataatcaccaacattattggggacagaaaataaagtttaaaattctgtcatcagtgactcttctcagcagagcctcctcatgaatttccggagggttaatgagctgagtttcatgaccgtgagtgcctctgtgaaagccatgcttctctcagagagatgagtgtgcacacaggctcttcatcttggaaatgaaagattacttgcacatggcactccggctgcttcagaaagcagggaaagctgccagtacacacctctgcctgtccaggaggatgatgtcacaggaagcgggactgggcaactggttctacaggaacgcagggacccaatcacatcacatacagttccccaccaacagcgatggcaaaaatgccttttgtattgttttcccacgtaaaaggcattgttttggggtctgagtttaaaccaaagagacacaattatccaccaaggggtgtgctggctagggaagggacggagagagggacaggatatgtgtatatttaggggtataaagagtatggctccatgtctacatacacacagatgcacagatacatgcatacatatgtgccgtgactttcgtttatcagcaggtcaataaaaacatagaaagatcagtgtattccattgcttgctgctctggtataggtccagcgtcaccctaataaatacaaatcacatacttcaatcctagcagaagtaggctgggggcacaagactgtgagtgccattttttctgttgaccatgtcatgtcgctagctccctcttgcttaccaggtaaaataccagctcttgggactggccaacaggacccctgcagggctggggagctgctgtgttcctagcaggtgaccctgcttgtaattttgtaaatatgctccaggagatgggactctcaggtttaagtcctgttgttttcgcttcctgcattgtttgctcctttgtctggttaacttcaacttctccgggctcaattcaggggttccaccatttagggaggctttcctaaatcgctcctcccaaagctgcttctgctggccgcttcaccatccccaaatcctggcattcctctagcacagcacaagggtccattcacttcagtaccctccttgaggcaaggaaatacaggctctttatcacctgagctcccagaacctggaactggcctggatcaaggtccatgttctacaaacactgccctgaatgaagtgtcatccaatctctgcatctacttagccatgaacaaataaaacaggaccccacccaaaccaaaccatggcaaacagtcaggtatcccaaggtagtttctaagactgaagcataagctattccctgagtgagggtagctgccttcagagatttacatgatctcaaatattagtcctaaatttaatgtgatattgttttatttccccataaaaatcttgcatgcatatatttttaggtactgcatttagttgcctgggaaacagcagggtctgtgcagagagaaggaaatgtttcagagagcgttagccacagaagagtttctggaatattctctaatggtgcaaccatccaccccatggatgcataacttaaacagttgagccatgtaacatccctgccccacactgcccctgtgttgagctgacaggtagagtcatctatggcaactcaagcacagatttgtagagggtcacagcagtgctatatccagctagtgtcatttggctggattgcatactagacttgtgattttcacatatgtgtagacataatctatgcctactgaaaaagattggaaggaatagttcttttggagaaagacagaatttgccaggtttccaggtctccttgagagacgtctgtacaagatctggagccgggttcctccagcttggcactgttgatattttgggctggaccatgctgtgttgtgaggctgtcccatagcctgcaggacagacagcagcagctctggcctccacccactaggtgccagtagcaccctcccatccacaccagttgtgacaacaaaaaatgttttctgatattgctaaatatctcctgggggacaaaattgccccatgttgaaagctattgctctagagattccgaggtaagacgaggtcactgctggaaatgggggaaggtaagtcaccttctgaaagtcaagggatgggcatttcaaggagctaaagggaggatcctttttgctaaagcctcctgatatctattccatacttctcacctgcctcaataacctcctaagctcctggaacgtcatgcctcatgggcttttggaggcttttgtgtgattagaggggaggacaagggtgtgatttggtaaaactgacataatacaaattgcttgtcaaatttcctctcacttgtctgtggagtgcaatagtaggaacatttgcacagagaaaaataaatgtctaaacatgcattggcacagacagtacactaactttcaacctaatgaaagaaacctaatgaatgaaaatgtaaggcttgccaaatgtgttatgataactctccagtgccaaggaaatatcaccctccccacggataccctggcaagcctgcgagtttaccccagtcagcaggtgcaccaaccatctcccctgcattgtaggtgagtgtatctatccctcattacaaggcttcttgaaattccttctgaactttctttctggaaatgctatccattatccaggcacccaaacccacccctttgtgcatggaatgtgtccaataaataactgggtttcataccacttgtgcaaaagcaacataaaaagtgctttttccttaaggggaaatatctcaccatttatacctcctgggagttagtagtttcatttaaatactaactttgtaagccacaagcaattcgctgtcttagtggagggaaatactcttctgtccatgttgctacatacagactactgttaacaaataagaatggagatatttccagtgccaggctcatagtagtgcccaaccaatttcagtgaaggagtctagcaagttgaacaaagtgctacttcaataatctattcctgaaaacttgtttttaatgtggtttagaggatacaattgtgcatgtatattttagcctatggaattttaactggatgctctttcttcttccctttctaccaatttctggtagatttctttctactttcaagccatgttctttttccacccaggtctattggtccctaggccttgagacccagagtcaataacaccttccctacaagaaacacacccagaagtgtccaccacctcaggtcccagtgaaaagaggtccaaggagatactaagctacgttcaatgtttccctttggttaactgcctgcttcttacatttccacaatgatttcctttacaatttgtatctactgctacaaatggcttatagatgtagtaccagaaggagaaaaactaataatagataattttctcaaaattacctggctatatttagtttcatgacaattaactaaaaactaatttaaaataaagtataatttggaaccagagctctattacgttataactctcacatatgtccccatggagagactgaatatgcaaatggacaatggtcagacaatgcataaaaacagaactttgacccacaacctgagcatcctgcccaggaaaccaactccttacctgtaataagcaactcaggaagcaagcctgctattagtttcacagaaagacagattgccatctctattcagaacttgtgcaacatttggccccagatggccaggacgtgattcataaatgaaagcttccctagtttttgtctctgcttccaactgaggaccaaccagagaaggccaggcatacaccccaaccaatcaccaggggtgctccacttctggttggctcataacatctccgtgctatcagcttccaattagggcacaactgaagcttcccttttctccactataatatttaccactcttctgcctttaagtctctgccaaaacacaagtgataatggccagcccccttgctataggaagctcagaatagacagcctttgcttttctcctttggttgtttatttccacaaagcctgccctaccagaacaaaagcgcattcattcttagtaaattgctagtgaatttccttctcaagggtctcaaaaaggctctttattaacatatactgccatctctaggatgcagtacatttgcccaatggccagagctctagtgggtatgggtacctatgaagcttagatcatgcagagagatatgagttaaccaaaatagaagagaattttgggtgggggacaagcaattagctatatcagaatttggctggggcaataagaatataaaaatggagacacagctccctggttaattttagtagccttgtagaaatttgagataaactgacaagaaccctggccttcattgacaagagctttagctgcattgtaagccactggttcaagctcatgcatttggaacttctcttgattgtatctacatctcttaggaaagaagtgaggaatagaaaaatacaaatgtttgagactaataaagaagtatgtaagatatgaaaattcatctaataactgagaaatcagaattgcaaaagatttttcatgagagttgagtcatttcctctaatttttagaattaggtttctttttttaaagctatagatcttgtaatacctgttctctatgaaattagagcatgaatatccaccaactattcattaaacaaatatgtattgatagtctgatattttgttggccttggacttaatcaaaaggcaagtaagagtggcatgatcagatcttgtgtcccaaagcaactgagaataaacttcaaaataaaatttgattttaaaaatactaaatttttgtttattgcttcttcactacgtaacgttgtgcgtttaataagcactgtctgcctgccatgtttatcttctatgagttcccacagcacttaaagcatgcacggtaatcccagtgtttgtgactatgtaaatgtggtttcaagcgggccggggcttggtccttgagagcagagagtccatcatgctttccatatcaagctggggtggaggaattgaagagggtgtacaggtgtggactcaggagccaaagggctgttagatggaaatacattttagatcattgatggttttgtactacctgtgcttctatttcttctcaatatcatctggcttttttttccatgatgaaacagagcaatttttgagatgtgtatatactttcagttcatggagaactaaaactatgtaccctcctaaaacttctgcccaatactcccctgacacacatacagctagacaacaaatctacatgcagatagaaatggttttattaccatcacttaattacccctgtcctcattaacgtcacttactattccaggagattcttgccaatgcaaataacttgattgttcaatccagaaacttgtagaaaaacctactgactcttccatggaaagtatcaaaagacagtttgtgccctaagacatactgaattcctgtttctaccaatcctgaatggtggcaagtcttagcattgggagattcaccttaaaccagaattcaaattctccacaaaatctcatctccctcctcccaggcactgccaaagctcccttgagtgctgtcccccttaccacagtaagaaataaattcagctttgtttcagcaacaggttgtgttgatgatctttagggcggcggccctgggcaccatggaggaccactttttcactagaaactcaagcagataagggcatctgaggcagctgctagttggcaacacttaagtaacactagaaaaattaccgaataacacttcgggtttgtatattttcattagtgaggcttatttttggtctgtgttcataatgcttttttttccccatgagtcaatttatttctttgtattagaacaaataagacttatatagggcagtggctagttcagctttagatttaatcagtctcttaaagatatgacttaatgtaggcaatttactgaaagtttcaaagagatatattacaataagaaaaggatgacagatgtgatttgctgtaagctcactgctaggctgagttaatctcagatgactaatcaatttggtctcatttgaagcttaaactaaaggtgcttttctcttttcttttctaataatttttcaccacaggctttgatgtttttgtatgcagaggcaagcttatcagagaagtttgagacaaaaataaaaagtttacgtggtgctatgaatgaaacagatgaatttcaatgtctataggaagaggttgagctctttggaataaagcaaagcatattcaatactgaagagggaattcaactacattgcataatgcactaaaatccttcctgagaatcctcatctcaaaggatttgctgaaaaatatattaatacattttccctgagatttttcatggttcattgagacacctagagacggctcttttctggcgtgcaccatttagacagtgcagcgctaatgggtattaaagacgcagcactgttaccttgaagatacaagctcatggaagatatatgtgcatggggccacaaaatgcatttgatcttctactttgtgttcatgtgtttgaatttgtttaaggcaagcttattttggtaattaaagcttaggagttcttggcagttttttcctcttaaaggaataataaaactggctctctctttttatcaaactctgcacatgtgtaggagaatataatgacaggtacttgggattccagcttctgtgtggttgcagattactctttagtggcgacactgcttcattgttccattatttaccagtgggcttcttggaagaatgcagatgtgatgaccaaatagaaaaccttgttgaaaggagtaagttgctttttgggaaaaattaagcatctgcattagaaagatttgtgcctacaataaaacgaaaataaaaaagggttttggagaaaaggcatcatcacaataggctggagataactttaaatatactgaaaatgcttaatctctttttcacagaacagaggtgctgaaaaacctttgcttgggagcctccaaggaaccgaaagaagcccatgaaagaactgaggctaagagcagcaacacggctactgctatgaagcacgaggacaatgatggcagtgaattaactcagggcctgccaagttccaactattattctaagtattctctgtgtcttcaatggcttctaacaacagccctaggaggtcaacactgcagttctttccatcttaaacatgaagacacaaaggcacagagacagaaagtaacttgcccaagggagtcaagctagaaaatgtacaacaatgcccaacacttagccagaaataaaaggtatgcaagaggaaaagaactaagaggagtattagagaagacaagggagcagtaagaagcacatttcctactaccttcagcagaggctccctgcaagccccaacttgtagtttgggtccactgggatcccctcagctgctcccgccttcccgccagtccccacgcttgcctcccatcgttcatcatctcccagctcctccttgaagaccgcacttgccctttgctgggcactgctgaaactgaagtttttgagcattttctctgcgaaagttgaaggcttgctatagagtcagggtgatttaacattttctgaatgactccaggactctttggggagcatcatttatttttctatattataataatattctcacaaagagcttctgccctacactaagtggtcctagatagttccacgcttgtgtttatataaagagcctttacatttccatcctctcctattgcctatttatttctcattactttttaaatattctctactgttcaatgtttgactgagagccttaatgtgttttctgagagcaatgcatgggctctctggcagctctgtccctggctgaagctgagcaatgccaagggtcccattttccacctggcataggaatgctggcttgaagtgtggcaggactgatttcttttcttgacaccacaggcttgattgaggaatgaataacggttggagaaggtagagttaaggacgtaggtactgaatgaaccagggttaaggacgtaggtactgaatgaaccaggctacctaaacaagttgtgtggaagtcttaaagaacccatcagaatggcataaaggttactttaaacttaaaagaagccttttctgagcttccttcattgactaaaggctgagctttctgagaatgcagctgccataagtcccctctgaggaggctccagccaagaaggagagactgactcttagccctggggtgagacatggcataaaccaaactttatcagaactgccatacccccatttatttcccctcgaagcccatttgtttcaacagaagccctatctatccacccttcccctattaagctggaatataaactactacccatacccgttcagtgagttactcattactgagtacttccacacacaggtgaataaaccttgtcttttctcctgttaatgtgtctattgtcaaattatttgcagtctcccacctccatctccccagttaggacctaagttagtagagggatggcctggagtctggagctgggtgtgctggggcatgtgctatctaaagtagccagtgctgtggaggttggctgtgattgggggtactgggctaggtgatctttggctcatgtagggaggagcaagagacagagagaatgagctgctactggcctacaccctaggtccttgtggatggcaggtactgccacaagccacaggcagggttggctcacggtgggatgtctctgtgtgctgaggacacagaaagccaacctgcaataaagttgggcttgagctgatttcctggctgcagaacaaaatcccatggtcacggcacacatggtagtgcaggttctcagatacactgacccatgagtactgaattccaacatgagtagttgcaacatgcagtgacctggatcacggagatggggcggagtgtctcccaccatcaggcttttgctaagtacatgcttgaataaaaattagaagtttaaacaatgacttttgtttctgagaataaatgtttcacatttcaatactattagtgaatctttctgaaatggagaatctaaataaatgcctagccttgagtcacaatacgtagtgatgccttgaacatagaatcactttgttaatgttcattgactgattatcttggatttctgctaaggaaatattgaaaaatgagatgtagaaaacaaatggaaatgaatctgggaaaaagttttagtgtttagtatatattaaaacctgatgtgatacatatagctcatttcaaaataatgacatatttgcccctccaatttgctaaggtattttaaaaattattattttgttattataatttctagaaacaggggtctcactgtctttcccaggctggtctccaactcttgggctcaagcgatccttctgccttagcctcccgagcagctgggactacaggcatgtgttattgtgcccagcttgcttaagtattttaaattcatgggctcattgcacaatcttaatagcacttgacttgagttttgaaggtcctaagaacttttgtaagtaataatttagagctcagtgagaagcagcttcatatgaatggaaagggcagtgccattcataagaggaaatggctgaactagctagggctaacactgcaatgcagatatgtgatgctcagcctgggctgtgtatcagaatcccctggagggcttctatagatagagagaagctcaggccgcatgccagagactcagattcaggagccttcaggtctggtcagggccagtgtcactcttcatgtctgaaggtgatttcacactgagtacctttcatttaatcatttgtgtgtggaatccagtcttgtgctgcattggtgtgacatccatctatctaccactatcattgtcccttgatctgcactatagaaaatcacatgcttttgccaaaatctctcctccagctcaggtctccaagtataggacagctatctcaagaccaacattctggattgtcaaaaccagaaaatggtttcattgataaagtaagcaggaaacaagagaaaacaggaagtttaatgaggagtatattcatctaatggggtgggttgttgatatggtttggctgtgtccccacccaaatctcatcttgaattgtaactcccacaattcccacgtgttgttggagggacccagtgggaagtaattgaatcatggggacaggtctttctcgtgctgttctcacgacagtgaataagtcttatgagatctcatcattttaaaaatgggagttcccctgcacaaactctctctttttgcctgctgccatccacgtaagatgtgacttgctcctccttgccttccaccatgattgtcaggcctccccagccatgtggagctgtaaatccaataaacctctttcttttgtaaattgcccagtcttgggtatgtctttatcagcagtgagaaaatggattaatacaatacattggtaccagtagagtggggtgctactgaaaagttacctgaaaatgtggaagtggctttggaacttggtaacaagtagaggttggaacaatttgaagggctcagaataagatagaaaaatatgggaaagtttggaacttcctagagacttgttgaatgtttttgcccacaataatgacagtgatatggacaataaagtccaggctgaggtggtctcagatggaaatgaggaacttcttgggaactagagcaaaggtaactcttgttatattttaaaaaagagactggcaggaatttgcccctgccctagagatttgtggaactttgaacataagagagatgatttaaggtatctggtggaagaaatttctaagcagcaaagcattcaaaaggtgacttgggtactgttaaaagcatttggttttataagggaagcagagcataaaagtttggaaaacttgcagtctgacaacgtgatagaaaataaaattctattttctggggagaaattcaagccagctgcagaaatttgcatacgtaatgaggagctgaatgttaatccccaagacaatggggaaaatgtctccagggcatgtcagaggtcttcacagcagcacctcccaccacaggcctggaggcctaggaggaaaaagtgatttcctgggctgggtccagggtcctcatgctttgtgcagcctagggacttggtgtcctgcatcccagctgctccagccatggcttaaaggggccaatggagacctcaggccatggcttcagagggtgcaagccccaagccttggcagctctcatgtggtgttgagactgcaggtgcacagaagtcaagaactgaggtttgggaacctctgcctagatttcagaagatgcatggaaacgcctggatgtccaggcagaagggacagggtcctcatggagaacctctgctcgggcagtgcgaagggaaatgtgggatgggagcccacacacagagtccctactggggcaccacctagcggagctgtgagaagagggctaccatcctccagacaccagaatggtagatccaatgacctcttgcatcgtgaagctggaaaagtcacagacactcaatactagcccatgaaggcagctgggagggaggctatcccctgcaaagccacaggggtgaagctgcccaagactatggaaacctacctctcacatcaggatgacctggatgttagacatggaatcaaagcaggtcattttggagcttcaagatttgacttccacactggatttcagacttgcatgggtcctgtagcccctttgttttggccaatttctcacatttggaatggctgtatttacccaatatctctaccccattgtatctaggaagtaactagcttgcttttgattttacaggctcataggcagaagggacttgccttgtctcagatgagactttggactgtggacttttgagttaatgctgaaatgagttaagactttgggggactcttgggaaggcatgattggttttgaaatgtgaggatatgagatttaggaggggccagtcacagaatgatatggtttggctgtgtccacacccaaatctcatctagaattgtaactcccacaattcccacatgtcatgggaagaacctagtgggaggtaactgaatcatgggggcaggtctttcttgttctgttctcacaacagtgaataagtctcatgagatctgatggttttaaaaggaggagctcccctgcacaaactctctctctttgcctgctgccatccacataagatatgacttgctcctccttgccttccaccatgattgttaggcctccccagtcatgtggaactgtaagtccaataaacctctttcttttctaaattgcccagtctcaggtatgtctttatcagcagcgtgaaaacgaactaatacagtcttgtacatcatccgtactacagagctgggttttagctatgagcacagaagcatcatgaatctgttggaaatttgaaggcagaatcaccatgatttcccatttcatgtcagtcacagacatttctgaaaatagcttgggacaaaaatcatgttgtttataaaaactcctgtggcatacagagctacatataagattaaaaaatcattcacctaccaccaagattcaattgaatgaaaaaaagtattcaatttataagaaaaagtatcacagaaactctttttgaaatatatgtgtatatatatagatatacccatacacatgaatatatacattcataccatatttatataaaaaatggtaattttgttgaggcttatctaggatttgaagaaaaaggaagaagtaaaatattttttcctgcaaaataaggagagcttgactacaaggtgtctaatggtcctctatcaattagatttataacttctgggagcatttgcctccctgcaggctattctcacttctaaatgtttgacagagtctcctgccaagccatgcacacagctgaaaaatggaagataagttcacaaccacagcatttgcagggacggctcaaggggtgggagctacccccactgcatttataaaggtactagcaaagaagcatttccattcattttcattataatatattccatggataaataacttggcactgcacctatgggcccctaaaacaatttcctccacatggaaaactgatcaagacagaatgactaggtacgtggtcctgtgcacagggattcatcaagtcccagaagccatatagtaaaggatgactacacacacacacacaaattacctgacagataaaaatttcaggagtaagatgtgaccattcggaataataagcctaaagaaataaaagtaagacagataatacccaacacgagagtctagactcgtggatggaaattcagacttctgatcagtctcaactgattggccttttcctcatgtcccatattttttcctggggtggataaacagccaagatgcctcaacagtagtggcatgaataaatctgtttaagttttgttcttaaacaagtaagaggaacttaaaatggcttcacgtgatgacctacagtcaacctaaaataatctgaacatgtgtggtcttataattttcagtatcatccacacaaggaaacattacctcttgtcttctttattccaaagtaaaaatgaagacaattatgtaagaaacctgtcttgggttaatgagccaagaaatgcttatctacctgtggatgggcattttattttaagatgagacttcctgtagatgtttctgtacttagagattaacataattggaccatgactttaactatctttttttttctttttcacactgatgacacacagattaatatctcagtcctgagctctaaatgaatattgtcggctttctacgtggcatgtcccctttcatgtctcacagatatttcaaactttcagtccaaaatcaaagttgtgatctaccatcccctcccctcctctgtctttttttgccacttacggcattttgtatttcatccatcagcaaaccttgctggttccaccttcaaaatactttttctacccctgtgctacaactctggtcctggacagcatgagctctttcccagactcctgaatccaagtcctcactgctcttccatcttatctactgtctagtgttcaaccagcagccggagaggacttttagtaataaacatctgatcatgctttcatgagccaaaactctcagagaaaaatccaacttccttatccaggctgaaaggtatcccgcactcaccatcagcatctctgacctttccctgcctcgttttccagctacaacaacattgaccttgttcctgtttttgccacctgcgaacctctctcctgcaccaggggttttgctcttgctgctcccttgcccagatggtgtaaggtctggctcctgtccatctcttaggatttacctcttcatagacttctttcctgaccaccccattcaacattcccttccccttgtcactctctaaacccttaccctattttactcatgtctgaagtggaaagtagatattgttttctttctcttttttttttagacaaagttttgttcttgtcacctaggctggagtacagtggtgcaatctcggctcactgcagcctcctcctcctggattcaagtgattttcctgcctcagcctctggagtagctgggactatgggcacccactaccacacccggctaatttttatatttttagtagagatggggtttcaccatgttgggcaggctgctctcgaactcctgacctcaggtgatctgtctgcctcggcctcccaaagagctgagattacaggcgtgagccactgcacagggcctgtttgcttatttttgagactattttcaccactaggctgtaagctccacaaagcagaaactttgatgtgctatgactggtacatagtaggcactcaaaaaatattggtcaaatgaatgaatgaggagataaattaattccacatcttggaagttagtacacaaggataaaattacactaaacccttgaaatatccaactatgtattagcatattttgccaactgtattaaataatcacattagactttcatggtatgaacaatgaattgtggcacttctattttgaaagctggacttgtttatatttaattagtccctgggaatttttaaatactgtactcattgtcccaataatgatactctatatgaagataagaaattatgatctagcataaaattctcactgtagtcttaattagcttcaaatgcaacccctaaatcttgcctggtgtttcataccacacagttggctgcttttctctttacgtgagctccctctggggaactgcagctcaaaaatggcatttgtggaaatgacttgggaaagcccgagctaattcatcagacaagcacattcttctaatgttaacccttgactacatgggaacaacgccaagctcatagctatagttccactgggggcaggctcccctggggcagactccaaaaggagccctgtgtgctgtcggggaccgcgtaaaggcttgccagggggatacagggtttggggttttaagggaatccattttcagattctcgacctccttatgcactctgaacaaaactgatctgcctgaaaaacgtgcttgcatgttctttcacacgttcccttctcttgttttacaaaaccaggtcaattttctccctgctgcaatggcaaacattctctgagatgaagccaagggtattgcttaatgccagtgtctgggttaaggaggaacaaccatgatgatggacaattcatcgttttcttcaacggggcagtttccagttctttaccttcaacaagattgaaggaagactgaacaaagttgacagttaacagatcattaaaaataacttgatgacggatcccaatgagatatttaaacatcaatgcataagaagttcaaagaatcaagtagcattactataaggaaagaccatctattctctttaccttatatatatgagtaatgtttctcggtatttaaatctataaaaacaacaaaaaagagaataaaatgagacaaccttgttcaatcaagcaataagttatattatttttgaatatatgaatggatagggaaaaaaggctcatccatctggtgaatgcatttccaatacaattttacattttatattgaataactttaatcaagataaatgatatattattttgatcaattttattctgctaataactacagtaataatctgtaagaaagttttaatttaaagcctaataccataagaaatatttacaatatatcttaatttgtataaattttgtttgcaaagagaatgagcaataagacactttaaagcataaaatacattaatcagggtaaaattttcgggggaggtagaaagcttatatgtttgaggagcaaaaggaatgacgtagaatttctaatattgataaataatctgctcacatattgttgaagaagatgatgttgggtactaaaccactgtggtatccagatttttaaagacatatttaaaagagggatgtgtcagttttatttttaaaatgccacccgggaaactaaactatattcctggcaacaatttaaatctaaaaatgtgaggggggtggggttggggggcatagctttccaaaagtcttttagagagttaacaaggaaaaataaattgcatacccctactcttaaacattctgttaatgatttgcaatcattaattctatcaatacgctgacacaggcatcctccagcctgtgtgtggtcaggccatgctggggaagcacagagatcctccgaaagaacagggcatcttctctcaaggagattaccagcatgggtcagccagacccaggagatgccagcaacaggataagatgactttagaacttcagggaacttgggggtggggagggctggaagaaatggagtcctcttaggcatttataggaaggtcaaggtgaaggcaaggtgtgttcccttccatttctttccatttcttttctccaagtaaagataccagcttgtttcagccaagttgtcgggctatttttatgcacatatttgagctccctcttttctgtgtttaaaataaggaatctcacacgccttggaatttagaaagaaaactaggcagagactagcatctagtcaccgcataactgagcagagactagataacaatcatatagactgtgaaaagtcctgaacctggagacttcataaccaatcagaggctgattcccaccatccgggaggaagaacagggctcagagtggaaggatgagaagagaggagtctgcagaagatgtgccttcgagatagagaacattccatgcgctccctcccctccttctccggtaactgtccccactcttcacatgcagtaagggtcacttgggattgcttatctattctgcagaagacaagaccaaagttggcctacagctgtttaaaccccctacctcatgcctgggtctaccagccctgtcagctctaccatctaaactcatccctttgtctcttgccaaagcaaaacggagatatagttatttttcctaaaagttcatcagaatgcttaaaggaaagttataaagtaaacaaatttataggaaagtctgtgtacctgtcaatcacactgttactatctagactgattccttatctaattagactaactgggattttaggcagtggtgatttgttttttctgcacccagttcaagctggtcgctcagcttccttcaagccacctaggagctggtgggttacagattaaccagttggaggggtggttgtggttgttcttgttactgctagttattgtctaagctgcagttttcctgcatttcatttttattctaaacatttctacatcttccactccatctctgctttgagttaacgaggggtggaggtggcctttggagacaactgggaagctaaaatgcaggtttgctagaagtcctgctttaagccaagctggaaggattttataacctgattcagtcacctgggcctttcccacgggtgcctaataactgtggatgcagccatgattataagtatgaggtcactcacctacttaagatagttcttttggaaactgtacttagttatgcaatgctcagtattgtttgttgctcacagaactttactgcttgatccagtagcacagtcacacatatgtgtatactttaaatatttatccccaggagccctgatactttgtcattcaaattcttttagcgagtgctagtcctttgcctatcagaaagaagctcactgaataattcctctattttcccctatggagatgctttagaaaaaaaatactcccttttcttcaacaaacatccttgccaatattcatcacccactctatctctttttatctgttacctcttccctctgaggactaaactctgatttttttaacatgcccaaattcctatctaaaggatttggggagtcatgccctacaaaccataaattctcatcagatgggtttatttaatcctatatatcgtgatttactttccaatttgactctggcataacattatgtgacaaagaagaaagtcaaaatattttaccccaaaacatgtttctttgccatattttgaaatggtcctgcagagctgtcctttgtgagggaaaatttgcatctgtaaagaatctctgctaacataactagatctttttatcgcaggccctccccatcctgaagagattaactgagagtctagcaccctttaaaggtctgaataggaaacatttgtcatctattgtctctaagggcagccattataagacttcaaaagaaccttggtctccacaatcttttatctttttttttttttttcagatggggtctcactctgtcaccaggctggagtgcagtggtgtgatctcagctcactgcaacctccgtctcctgggtttaagagattctcctgcctcagcctcccaagtagctgggactacaggtgcacgccaccatacccagataatttttgtatttttagtagagatggggttccaccatgttggccaggatggtctcaatctcttgacctcgttatccacccacttcagcctcccaaagtgctgggattacaggcatgcgccaccgcgcccagccttccacaatcttttaacttaacctgagcatttccttcctattgatcccaggcctttagacaagctcaatcaattgtcaaccagaaaatgtttaaatttacctacagcccccctcactccctcctcccccaccctgacccctgccatccccaaccaccccctgcactttgagttgttccacctttctggaccaaaccaatgtatttaattgatgtctcatgcctctctaaactgtataaaaccaagtgcaccctgaccactttgggcacatattctgaagacctcctgagggctgtgtcatgggccatggtcactcatatttggctcagaataaatctcttcaaatattctgcagagtttgactcttttcgttgacacctccaagaccaacagcgagactcagtgagagtgaaatacaattgcaatcgtgttctgatgggctaagcaagctgtcacagaagaaggcaatgctaatgccagaatgtggtctcaggtcaatttaggaatattcaaggcagaccagagaattactccttgggtctcccactgtctatgtttccttagttcagcagattagcaatctgaccaaaaagcaagaccaaaggtttgatcttcaaggggactgattagctcctcccagtgcctgatgcagccatataccaaccccagagttattctgcacacaacacatgctgtcagtcagggcctggggaagggacagggcctggggaagggacaagagggaagagcttatgaaaaatcctgttgccatgattcaaaagcaattcaaagcaaacactgcctcacatcccctctatatatcaaagagaacacattttaaaaatcgtccaggtattgatataaggtagaggagagtataagcagagaatagtgtttaagaagtgatacgtagctttaattcaagaaaagtagttcaccaaaatgcagtggtaatactctagcatttttggagaatggtcaaggcagggttatagctctaagtattaaattacatattttctgtttatttttcttctcctttgcttgctcactgaaatgctgaagaaatactttccttactcaacccacacctaaacagagacacagcttcaaagaaaccatgggccaaagcgcaagagggaataaccagatgctgcctgaaggatcaggttcttaggtcccagaggttagccaagactggagctgggaaaaggtgctgccaggaaaagcagcacctccaaccctgtggtctaaccaccttggtcacgtgtaggcatcctgaatggtgagaaacttagacaccttgagtggggcaggaaaccctgccctcattgaagaattgagagactccctggagccttcccagacccctctacaattgtcagtgttatatttgcattttaatgtttacaatgagctctttaaacccatcctcttgattaaattggtcttcaaacataaggggctttattaagtggaaaggtagagacttttgctgaactgaagaggctcatgatgtcttcatcaaagtgtgtgttgtgaaagattatattaaaatataatattcctactctctctatatatagtatttgcaacaatttaagctggttttgactctagggatcaatgacattagtggcaatgttggctgaagttggctattccattagaagcaactatccattacataaataatataaagtttggatcagcaatttctggaacaaatttttttgtcttttctaatcagagaaatgggatatctcagaggaaaaatactcttaagtttaaactttaataattataaaatatttccaaattggaagaacacagttttccaaaagattagcaggcaatttttatttatgatggatcttacagactcaactcagtagttctcaaccttggcaaacttcagcatccctcagggagccttgaaacaagtactcatatctaggtggctctgggtcaggctcaggtgattccaccgtgcatccaactttaagaatggtgttctttagaaaggactttttgtctgctttggtttgcagagtaaaaataaagcatgtagttctatttttataagtttgtggtggtgatgtgttcaagttaaggaaagagagtagagggtaagtaggtctcagttataaaagatgctctggtataggttataatggcaaactgatttaaattacttaggaaatctatgtatgacaataaaaatttggtttataaaaccacaatattatgacttcaacctattatgcattacaacacaacttaataagaatctactaggccaggcgcggtggctcacgcctgtaatcccagcactttgggaagccgaggcgggcggatcacgaggtcaggagatcgagaccatcctggctaacacggtgaaaccccgtctctactaaaaaatgtaaacaaattatccgggcgtggtggcgggcgcctgtagtcccagctatgtggggggctggggcaggagaatggcgtgaacctgggaggcgaagcttgcagtgagccgagatcgcaccactgcactccagcctgggcgacagagcgagactccgtctcaaaaataaaaacaacaacaaaaaaataagaatctgctagacgacagaacagatccgttctgggggttatagtagcaaagaaggaagacactgtccgtgtccgtgttcccacagagctcatattctagcagaacagtaactacgcaacgtgtatcttcatcacaacattaatacaatgctaggcatattggggctttcaaaagaagcacaaaaagtaaaaatagagaaaggtattgttcttattcctaaagagtgatcaggttagaggaggagatgacactactctacttgagtcatcatgaacttatggtgttgtacacagcattccttaaattccttaagtgccaaactcggggggtatacagattaacacaaagaagtgtaaatagggcaaaaataaatctagagcactcacagaagcttgtaaaaagggtagggcctgaatttgtcttggaatatgggttaggagtagatagaaaaggaggtgaaagagccatcagggtaggaaaatggctgccatgagccatctaagtgagttataatgaaaatgttatccgtagggacagaggagagagtgtccaactggaaaggaggctgtgaactcagaaatggtacatattgaggatggatagagacagtggatgtaaaattatacaaggcctgaaaaatataggtagtacaatgatccaaaaagctggcagctgagcttcacagcagacagggaaacaaaggaaagagagagagagagacagacagacagacagagagacagagagacagagagagagagaagagacagagagacagagaaagagatcttatatggctcagaaaactgataactgggcaatagtatacggagtatagagaaatctttggaatctacaggtgctcaacttctgagcctaatggtagattaaatactgatcatgctcttgaaacatttgcactcagtggtaaactgaatttaactgggctgcagctgggctgaatttaactaaagcccagatatagttaaagcatgcattagattatctcagccctctaccttagcaaccccgtagatgaaatgaggtgctttttaggaggaaagaattaccaacttcagtctattcaaatctttcaacataaaacgtccggcatacaataacaaatcacaagacttgcaaagaagtaagacaatatgaccgaaaattaagagaaaataaagttatcataggcaaatccacaataatatagatgttagaatatgtagataaggactttatctgtgatatatttgttaaattatctagtgagataatggacaacatgcatgaaaaaaattggttaaattcagcagagaaatggaaactataagacataaccaaattgaaattctagaattggaaaatacaatatcagacaggaaggatttatataatgcctttataaaggattgaaaatagcacatggaaggaccagtgagtttaaagatagattactagaaattatcaaaactaaagcacaaagtgaaaaagaacaataaaaaaatcttaaactgaagatctaagacctacctacaggacaatatcatgtagtgtaatatacatgtaattgaattcccagaaggacaggaaagtgagatggggtagaggaaatataataatcaataatgaccaagcatcttgaaagcaggtagtataaaaatacatactcagggaacaacagtaacaactgacttctcatcaaaagcaatggaagccataagacaacagaataatatctttgaagtgctgaaaaaaattattctcagaattctaaggagaggtatcctttgtggatggaggcaactaaagacattttcaaaatgacacaaagctgagagaatttatcttcatcagacttgcactataaaaagtgctaaaggagtttcttcaggcagaagggaaattatatcagatttatacaagtttattgcaggaagaaatgaagaggacgtgaaataaaatggaggagaggtcttagatatagtgtgtatatggagagggaagaggaggagtgcgtaggggaggggagggaggaggaagggaggagaggagagggggagaggacaaaaaggcccaggacacagcagtgacgtaaagtggagaagaaaaggccaaagaggggagaaaaatggagaaggaaaagagtaggaagaacactaggaaagttttatcttaggaacaaaggtacgtgaatatgccaaatgctgccggaaggttccagcaagtttggaagagagacatatctactgcactaagaagcacaaaggctcttgggggcctcaataaaaatttttactaagaaaaaaatcagggctgggcacagtggctcatgcctgtaatcccagcactctgggaggttgaggcgggcagatggcttaaggccgggagttcaagaccagtctggccagcttggcaacaccttgtctctactatgaatacaaaaattagtcaggcatggtggcgtctgcacctgtaatcccagatacccaggtgcccgaggcatgagaatcgtttgaacctcggaggctgaggttgtagtgagctgagattgtaccactgtactcctgagtgacagagcctgagtgacaaagtgagaccctgtcttcaaaaatttttttttcaaaaaacgaaaaaaaaaaatgaggcagcagagttcactttgtgtcattcacatcaggaaacactgactagtctgtaactggagtaccttgcaaaggtaagcgtggcagcagtgatgtgggaggggggagtgcagactgggtaagaaggggcagagggcaggaacccccacagagtgcgcgtgtgtcctgggcttgtcatgctatgggctgaaactgaaaagtaaaatgctgaggggtagtaaagagaactcaagaaactccctggcaaagtatcaataagatatcacacttggtttactcacttgggataaagaaaaggaagaaaagaaaacaaggaaagtttctgttcatttctatcactgggaaaagaaggccaagtaaaaactggggtttatgttcgaatctgaggaagaaaggagatggtgactggaaaattaaacctagtgagtttctaacattttaagaggaataaggtcactcccatagacactgggggtattagtctgtggaggtaatagtcaattaaaatgtaataccaccagtttccatttcatcactataactttcctttctgaccaataaattaaactgttcaagtctcaaggtgaggaccacagggatttgtatcttttgatctctcttgagcactgaataacctctaatgttaatgttgcagtcttagtgagccttaattgaaagtaacacactgcacattaacatatatgtgcatcagcccaggctatactgcctgaagttcagtagcctacatcaaatgataagaaacatacactcactttgggattgaaggctattatatgcttaggaaataagccactctatgcttcaaatccattcattttacctgacattgcttaagtacattataatacacgaaattgaataggaaaattttgttttaactttaaaaaaccaagtttcccaaatggacagtatattgttacgaactttctggttatgagagaaacaatgtccgaatttcaactaattttcttgaatgaactttcaggacattttcatgaggagctgttgggaattgcttgattctctcactcaatgtccctttgactggagtctggcaggatgaacaacacgagcttttttcttcttcaggcaattggtttaggagcagaatctgtggttgctgctcatgccaggtcacagaccagcatcccatatccggcctcaggctgcccagacactgggacactggcggggctgcatctccaggcttctgtctccttcctggtcccctggtgtatgcccgggggcttgcggtgcccttcctgctaggctggctgtcccctccctgctgtctgcctccttctcttctaactgccttatgcccccaagggcagcaccactggcccatctgattgatggcaccagcctggagccttccttttagctgaaacccaattacagctgtccttgcctgctccgtaattttttgagatccagtataataaatataatcaaacatcagccaggatggtttaaaaagaattcatctttaaacgtttaaactcatttctaatccattaatttttagtattcaagagtaaaaataataatttctttccacctgattgagacttttgtttttaacaaggagagaagatagcagtccacacatagaagggaatacaatgtaaaaacattatcctgcaaacgtctattttctgtttttatattctcaagatttggctgtggtatttgaggagagccatttcatttctcatgcatcctcttttctaaagcttttcttcggaaactgtttggccagacataaaatgaacacctaaacagtccaaataaagttaggtcggctctccgtctcttgctctctctttgaggtctctaagcctttgggcagaagtcctgaatttgaatcaactggaaatgtttcagttttgtctttttccccacatggagtatttccaagggacaaatcattaattcttatttaatagaataatgattggctcttcaatttatttataacttcccttttaaggaattcttatcttcccgacccagctgccaaaattccccaaaaggtgtcccaagttaattaacaaagaacccatggcttcaccgaaaagggaggcagcattcatgaaattaggttctggggtttaggagatgggagctgtaacataggcacctaatctgaagatacaaagttccagccaaggtacagagcttgccttctgtctaaaatgtggcttgtgaaatcaagttattaaaacaaaccagcagagagtgctccaacaaatcactttgtctaagaaataaggtttctttttaaaatactaattgaaattccaagtgttctaataaaaacgacatctgtctgggtctgaagaaacatattttgaaaagcagagaagatatgtctctaaaatttcctcagatcaacgtaataaagtgaacttacatatttccagtactaaaaacagcacgttgccttcctgggttgcactggactttccacagccttgtatctttccctggacggaggtgggattcgtcagggccaagagcacaagtaaagaaggtgcctacagtgccacgtgatcagtgaccctcaagaggtctgtttcccagaatggagcacccatatcccagaacgttctgtcacgtgccagccattagcatgagacgcaaaaataagaaaacacatgggtatctattttaactgataggactctaaatgtttcttagagccctctgtttctcagtttcgccagcagacagtgggggtgcaatatgatactctgagcatggagaggatactgactcaggtgcgtttcaatcctagactgtggaatttagacggactttgaggaatgatgtcctgagtatcatttgtaaccatttgtcattgaagtggagacacagctgcagggatctgttcattccccagttcatgctctcatcattgagggtttggttaaaaaggtatctcaaagcttccatgaagagcagtatttccaggtttagaattcctagattccattataaagctttatatgtaacattcaggacagtattgatataacgaagattttccctgttctcaccacccctcactccagttctccaaaggaaaaaacatttctcactaagtaaagacctggcatggaggaaggagtattgtaattctatgggcatcaccgttttctttattcagtctttattttcactcaaagacagaacatttttatgtcgtcctttaaatatcaccaggaatctttgtccggaaacagtctttacaatgtgcagatcaaatctattatttgaatatttaaaacattgtggtaagtaaaggaagcttgaaaggatggccctaattccccctgcccaccccccacctccttaacccccagaatgaatgaaaaggatgatctaaagatccatgtggggaaaggaatagcaatgatttttactacttaaaaaataataaactcccaggcaagaaaccacccttattttgttcctgattttgttcacgtgggaaaacatgagttgtgtaatgctcactacacaggggggcgctgtgtagcgcccttcccttccatcttggttggtggatgcctgtgtttgagaagcagcagattccccctaggaaatggccctattctgaccccagagaaagtcagatcccatcttgtgctccttttgaggttggaatggggagagaaggcattggctggacagaagctcagctagttggtaaagtgaaaagaaagcccagcgtgaaaagtggattatagaataggaacatatgggggcgtcagtcaaaggaagattcttacacagcctccccaatgtggtgaagcagccatccaaatgggagcagaatgtagggaaacagtcctgcaaagcacagaaggatgaggccaaaggatgatggcaaactgggaaagggccaggctcatgacacggaggataggtccttctcttcagcctcaggagggtgcagggagctaggaggatgcttgcagcatcccagccctggttcgcctgctggaaactgtggcaagttgccaccacccggggcagccagtggaggggctctgtgagctccgccagtacccgcagggatgcggtggccccgccaacaggaacctttggcagtgattgaatcacacacagaaagcattactatttcctttccaatctcaagcctcttccacagtggcagcagaatgagtttgattagagtctggatttgagagagcatctaagctttatttctttcctctgttctctggacaccgtagaaagagacagacacagacatccctctaccccttcctctctctatttggattccccaaacctcctccagatctgctctttgaataaatacgctgtgttatttatccaccagttaattcattcagcaactacataccgagttcttgttatgagcatagcaaagtgctagacactgtcagacataaaagtaaatacatcacctgatgcttgcttattatttcatttggggaagacatacgcatacacaaaaaacataagagacaatgtgaggataaaattacacaatggaaatctaaaacaagtgagaaggtttcttatcaaataggtgctgcccacttcagctctgggtgcagggagtagcctttatcaggaaaggccactgcaaggtgggctttgaatggtggtggcaggtagtaaatgcaagctcatgttatgctttaaatgtttggtttgagtttgttttgttggcagagaggatgggatttgcctaaaataagtgtctgccatctacaccaggaactgtccatgtgccgaaatgggtggcattttgctaaactttctgttgaagcaatacaatattgtttgctcttttcactgatgctaattattaccattccttttttaaaccttccatactcagaaggataattaacattttttgaaggttgcaaagaaatgtatggatgtgcattaacctcggctactattctatgccagtaggaagaacacaaagatctatctatagcatacttattgctgtttcccagagacatacacataactatggaaacaacccaaatggaaagccaagggagaggcaaagcgtgtttcattctgctagtgctactgtatgattctcattagacctcatgggatagggtgattattgttcaatagcctatttagagtttccccgataatggagtctaagaaagatgaatgattccttagctgcaattgtggagtctgcttcccccaacctctcattaaaagaatgatctacgaagaattctattttaaactgaaaatccagaaccaatgatggaaaagaaagggattctttctgaaatcctgagtgtctgcatgcatctagtaaatttatagagaaaagaaactggctgtttgattcttggcttttttaatagaaaaccccccttttttaagttaatgttttatttaatttccttaatgttttgctgacttggaggtcattttaagatgacgacaagcaggaaatattcggttcagtcattttttttctggcaaatatttattaagtccctactacagattgggcattgttctaggtacatgggatatgccagcaaggaaataagagaactctctgctcttaacaggcttaccttacagtggggaaagatggaaataaaacaagatgaataagtaatacattatatattagaaggtaattggggctgtggagaaaattaagcagggaaaggagctgagggtaagattttaagtacggtggcctgaaaagcttctctgggaaagacgtgagtgaggtgaggactgagctgcatgaatgccaagaggaagagactccaggaagcagcaagttcaaattccctgaggcaggatctcagagcatgtaatataggaatcacagtcaaccagtggcctcagaaaatttattaatttccagaggactaggtggggttggagaggtcatagggagcttccacatctgccctgcaaagacttgattttacactgagatgaggagggtttggtgtgaaggagtgacgtgctctgactaaggtttcaacaggataactctggttgccactgcaataggagaccatctagggtgaaggaagcacagggagactaggtaagggggtgctcaggaataagccaggagagggatgatgagagttttggaccagagagaaagcaatgaagatgaagagaagtgttaaagtctgcgaaaattcagaaggacaaccagatttgttgatagattaggtatgaggtggattgcatacgagtcaaagaagacgccaaggtgtctgtcccaggtctctgcaagaataactggtcattttctgggggaatactatggaagggtcaggtctgggagagaccttggttgtggacatgctatatttgagacactcataagacatccagtggagaggatagagcagacagttggacacaggatctgaggttcatgctggagatacctgtttggagtcaccagaatacagatgatcttcaatgccatgaaaccatatgatgtcaccctagccttctgtgagaggtgatggagaggagaggaggtccaagattaacctttcattgttcttcactcaaagtcactgcagctttcttctgtgtataaagttctgtatagcattttcctacaaaaaccacttgggtacagtatttaaagtaaaatagttagcaaaagtcgcatttcctctctcttaaatacaatccaatgttgttcttgtcaaattctgctattctcagtcaagaaaaaaatattgatttcataaagcctgtgacttagatattttcccttctactttcaaatgactggcttcatttcccatctggtgacatttgatagtaaaggtttcgttgaacacaggcagtatagtggtctaaatattcctgtctccgagagaagactagataactggcttttgagaaagaagagatgcctaggagctgtcaaaccaatcaatagttcactattttgttatattttaatccaccaaaagaaaaaaaacacacatacaaacacacaataccaagtagttagtatccaggcagtagactgattagctattgatttttttctccatttttcagagaagggataggattttattgggaatcccagtgctgtcctgtctgaaacaactgtgcaacgaaaaaaagaaaagagtatatgggaagagtaccttgacctttggagctaacgacctactttagatataccagatctacacaattcacagataacccttaaattaaatgcaaactaagtgtaaatagcaagttgcaagcttatttcccgctgtataatgaattacaagtatggtgaatctgttagacacagatttgcagcctggccttgcagtgaataaataaatggctgaagagctgcaaatattatggtttttcttggaggatatgatggctattgtgaaatggcaggagaaaaagtggctgcttcccaggtcataaaaggcttaatataccactatctgtaatttggataggggaaaaagaaccatgtaactataaaaacattttgtctgcaatttggagtcacacttggtcttccagttgccccaggaatggaatcttgagctctttgcctattgtcacctaatttctcccagttcccaagatcacctgcacccttgccacgggggttggtccagctcccttctgctgagcctctggatgctacctactgacttctgttccctgcattcaggctgccagatttcatgctgtcattggactagtgaccctacagaaatgatatccctaacaccagatgcctaccagccagaccaatggcctgtggggactgtgtcatcctctgagaggtttcagtagattcatctttctccaggagatcaatcagccttggccttggcatcttcccacctacagagggaggcatcagaaggcctctctgaccttggctcccaacactcgccctgccaggtacacaaggtcccttgaaggcctggagcccactggcctgctcccagttccctctccagggccttttccctggattcttttccccccaaatacctgcatggcttcctgtctcatctcctttgagtctctagtgttacttttccaaccacccctatcttgacctcgcattgaaaatcacaaccctaaactggatatccacatatggaagaatgaaactagacttttacatagaaaaatcaactaaaaatggactcaagacttaaatgtaagacctaaactataaaaattctaggagaaaacaggggaaaagctatacgacactggtctgggcaataatgtttttggatttgactccaaaagctcatgcaacaaaataaaagatagacaaatgggattgcatcaaactaaaaagcttctgcacagaaaaaaaataatggaatgaagagacaacctacagattgggagaaaatattattagtaaccaaaaatataattatgggttgatatcaaaaatatataaagaattcaaacaattcaacagcaagaaaacaaataacctgattaaaaaatggacaaaggatatgaatagacattacttaaaagaagaaatacaaatggctagcacatatatgaagaaaggttcaatatcactaagcaatgcaaattcaaaccacaataagttatcacctcacacctatcagaacagtaattatcaaaaagataaaaaccagtgttggtgaggatgcagagaaagagaaacccttgtactttattagcgggaatgtatattagtacagccactactgtactgattagaaaaactgtatataggttctacaaaaagctaaatatagaattactatatgatccagtaatcccacttctgggtatatatccagaggatctggtatcagtatgtcacagaaccatttataactctcatgttcattccagcattattcacaatagttaatgtatagaagcaatctaagtgtccatcaatggataaatgaataaataaaatacggtatatatacacaaaggaatactactcagccacagaaaggaagggaatcctgtcctttacaacaacatggatgaacctggaggacattatgctaagtgaaatgagccacttacatatgtacacataccacatgatctcacttaaatgtagaatctaaaacaaatgaatttatagaagcataggctgggtgccgatggctcatgcctgtaattccagcactttgggaggccgaggtgggtggattacctgaggtcaggagttcgagaccatcctggccaacatggtgaggccccacctccactaaaaaatacacaaattagttgggcatggtggcacgtgtctgtagtcccagctactcgagaggctgaggcaggagaactgtttgaacttgggaggtggaggttgcagtaagtcaagattatgccactgcactccagcctgagcaacacatgagaccctgtcacacacacacacacacacacacacacacacacactcacacacacacacaaacatgctttgtagaagcagaaggtagaatggtggttatgagagactgaaggtaagaggaatggggagatgttggtggaagggtgcaaagtttcacttgagaagaacagattttttgagatttattatgcaacaaggtgactacagttaataataatgtattttatatttcaaaattgctaagagtaaattttcaaatgttcccaccaaagataagataattatttgaagagatgaaatgttaatcagcttgatttaatcagttcacattgtatgcattcaggttgagaaccccttatccaaaaatgcttaggaccagaagtgttttcggattttagatgttttcggatttgggaatattggcagaatacataccagttaagcatctctaatttaaaaattcaaaattggaaatgctcattggagcatcatgttggcactcaaaaaattacggattcggcagcatttcaggattttggacttctggattagggaccctcaacctgtatatcataacatcactttgtgtcccatgaatgtctatgattataacttactagtttaccattaaagaaacataatccttatgctaagtgaaaaaagtcagacacaaaggtcatatgttctatgattccatttataccaaatacccagaataggaaaatccatagacagagagcagattgatggttgccaggggctggagaagggggatggagagtgattgctaatgggaacagtgtttgcctttggggtgatgaaaatgttttaaaacttgatacaggtggtgattgtacaacattatgaatatactaaatgccactaaaatggtagactttaaagtggtcaattttatgttatgtggatatctcaattaaaaagaaatttgcaatctcactaattaccctttactcagctccattttgtgattcatttgtttagtttgcttcttgaacatctccttctcttgaatgtaaactccacaagggcagggctttctgtctgttttgcttattgatttaatctctgggcctagaacaggcctggaacaaagcaggccatgagttttgttgaatagacaggtgaatgtattacctcttttgtgccttattaataaaagatcctctgtatttcttgaataccaaattaaagagagataatttcttaaaagaataggattaaagggctagtggtctcatccaaaataaatttaaaatagagaggggaagaaaagtaatcctatcagaattcctcagttcactgcatgggaaacaaacaaacagcctgtcagagattcagaggattgagacaacggtatcctgtgccgagcattgaggttctttttaatttgcaaggattagaaatgtcaacgagcatcacattttcctctaaattctaaaagatgactcagtgcagtggatttaaatcagaaggacagcagaaaaaatgaggctgctaataaatgcacggcttctgtgtaagcataggctatgcatacgggttcaaccacacctacccctagagaaaatattttcacttaacacttgagacactgtgaatcagggagaacataccgatgagctccttatttctgacgtccaaggccatgttccgcagcgcagtggccaccgcgcacaccacacggtcattgtctattcggagcagctccacgaggatgggcaggcctttctcttttcggacagcggctcggatatatactgaccactgcaaaaacagggaaggcgaagggcgttagaaacaggaagaaaccctgcatgcaaatagtacatttgcgttttcaggcggctgcttacaggagccaaaaaggttgaattaccaagacctagttgtagaatgggttgaatacgttagacatgcatttaaactttttaactgtattttttgccttcaacttggggacaaagatttcagggttaatcagtgaaccacattaggtttcttttgtgacactgttttcagtacttgaagttgaaagccatttgcgtgatgcgtatacttgatgcttcaagatacagaggtttgggacaagcggatgtggccagtggcattaaagagaaataaaacaagaaccctgaaaaagtagaaaatgagaatgggttgtgtgggagtgatttctcaagacagctttgaatttggagatggggcacacaggtgagttgctgaacgtgctgtcaataagtcgtttgctgaacaataaagagtcaactagtcagaaataggcaggggtggataaatgtaaatatgacattgaaaagcaagagtgcacatggtaaaatgttttttaaaaaacattaaggttaaactgtataatgttcagggccataattcaatgtcttctttataaagtaggacatgaaatttgttttgggttggtggtcgtcagccttaatggaacacaggtaatgcgtcatattaaaatgtccttgcaatatcaggatgataaagcattcccattcacttaacagaatgcaggcccacgttttcagacatttgtatgtatgatgtatactcttctacagtgtcctggagaagagagtacaatataaaaattcacaaatgtaagggttttacctgttgcaatttcattttgatttaagaaaattacattcacgcaatgaggctgtggattctgtggtagggtcctcctggggaccagtcctttcccacccagtccccccaccaggccacctccaccccccttcccccatgggggcaggcaccccagagctggctctcacctgtggcaggcagggagccccctctggcagtgaacgtagggcatatgccatgcctgccacatcctcagcccagccctgcatgaaatatgaaatcaaaaaaacaacttcatcctgtcctacattagaaatcacattcacacagtttcttatcaccatcaacccacactgtatgcttttgtctcacctctactttgtatctcaagctctaggaagccttgagggggtagggagcaggtaaagctcactaaagcatctcttggctgcagtgaactatttgacagctccactttcagggagcaaagaagtggaaggttaggaagtgtcagacatgacaaaacattgaggtttgcaaactgcttcttgggatgtgggaatccggaactgatatcccctcccagggaggaagccctttctcctggtacaatgccaatttccatcgatgcatttaaccgacatgctgaaacatgacttcctgtggacacatctgcctcccctactccttgtgccctgctgagtctccagtccccagcttggaaaagcctggaaatctgagcttatgcagcccacttaatcctgggatcttccctaaaactaaggagagaagctagaaaaaggaagagaatgcaaatcagggtgtggggtcaacaatgacatattgcaaaaggaacatcaacaataacttgcaacatcggggagatattcttgaccttctgggagatggcaggggtactcctggcaacttaggcaggctgatgcaagtgccctcagcctggtggggaagagatgaactggggaagatgagttcatctcttccaccataccacttctttgcaggccccatgcgactggcttatatatttgagatctcttctaattcttgaaactccagggaggtcagcatttttattttatacagggggaaatttaggcacaaagatattcaataacctgcccacaggagacacctgtgcccttgactctgggtcctgttacttcatatctgtctttttttatgctgctgacattataccccctctaccatcatctcatcccctctcctttaatcctccatgctcagtctcccagatatgacctagcctttccctccatccttccagacacagacagaggagaacctggccacatctgaaatgagccaagaataaatggacataactttgtccttagaagtccaggtactagccacaccccccaatgctggatgaaaaggtgatttggtatttggagaataatgggaatccttcagctttgctgggaattgatttgagagcaacaataacaaaaaaggctacttaggaccaaaaatgtggatgatatagaaacacatttttgatacgagaaactggtgagcagtgatgtgttttccctaagaaagaaaggataaccagacaatagatttgatatttttattattgagacatagaaaatagctttcattttgaaaggttagttatgtgtatgtttgtgtgtatatagaagatttccaatgttatcacagtaaatgagaccaatttgtccagatttagtaggtccaatacaagaagtcatgtctaattggaatttctcgcttgtgtcaggaaaggatcccttcctgcaggtgatgggacaaagcttttgcactcctcttcctggggagaggctcaggccattatttgacccaaagaagtgttgtcagcatgggacagagaagcagcaaacatgtattgtctaaggctagagggcacagatccaggtaaaagatggaatatatttgaaagagaattggaacagggagaaaataatttgccctctccctagtcaatacagagcctccatgctggggaaagaaaggatgcagtttggagaggaagcaagagatgcggcagcactgtgggggctgccagctgatccctggagtcctcctggacaagcccccctccatggataagggggactgaggatgacatcccccttgaagatgggagaatggaaactccacagtttggctgctcttctaggatgactgcagtggctgagcaagactcagtgaagtctcctgtaccatcccagaatggcagccacagggcaggaacagtgacatggcttgctgggctggggagggctgggaggattcgtgtagccccagtgtggcaaggggtagctgctgagggtgttcttgaatgggtggggtgtgtaggttagctgaggaggagaaacgaaggacccagggctgcagaggggttacttggccagaagggaggagacacatcagtggagcacatggtgggagcagacggtgcctctctggattaaggagaggaggtggttggatttcaggggagctcaaaagggatggaggcaggtgtgggccaagacaggaccctggaccggagatggtccaatcaccaatcaccacgtccatgtgtgtcctggagaagaggctgcatagaacagagttgattctacactgagaaatggacaccacacccccatcctctgtgcgggactatacctgtaagacccccaagtttagcaccaactgcaggggcaggagaggatgaaggtgaggaacgtaaaatgtggccacgcttgcagactgacgggactgggaaacagctgaatttgactgggtttgcctagaaatgttgagattcacatttctttcctttctatttgttggcatcaggcaaatgagggctcagagatgaacctgaagtaaattaacaaagatacttgcacacaagtttgtgtcccatgaaattcctagttgtatgtattgagaatttggtaacaaggagaagtcagtatcttttaaccctttaaggccagactgtctcattctaatgtggatttccagggatttgacttttacaaatcccagcccagctataaatacaactgatggtcataatttttccaaaaagttcccccttgctgaaactgaggtgattctgtgaaggcctatttgttcctgaaaggagattaatactataatttaactagcttttcctcattgaaatcctaataatttgctaaattacaatgacagtgttttcctttaagtactaaatattctcttctgaggctgaatccattatagtgctaaaattctgaatttgttgaataattctctatattctaaaagtactcttgtgttagaagtatagtctgcaattaaatgattttcagttaaataatcatttgtgcattaattttctttatcaaattagccatatcctcagtttttcttttaacaaggtaaagtcaaattttaaaaccaaactcttccaatgaaaaatacatacaatgaatttggtacaaatggcatgtgattcctaaatttgtttctgaatttatttacaataccagggtgtctcattcccatgacaagagggtaggaaacacctcctgcactgaaaagcttatttagttagtcttatttttaccagtagtttattataaaaacaatgcataaaatattaggaaacggcatggcttttgctgtatgccccagattattctgtctagaatggattattatttgaattaccagattctcccagctggaaaggaactgtgcttggttcctgctctaggatttatgaaataatggggtggtattagcacaaggtccttcaaatgatggggttactctgcaatggatatagaagtcaggtgttggctcttcacatccagagttatgttatggatttacataactttgttttcaaaatttctaaatctattttgaaaactggtatctctagtcaagatgactagtgaagaattccattctgttagtaaagaaataaatcaatttaataagcacaaattttggttaaggcaatggcaactattgcatgtttagtgttttttgttgctgttgtttctttgtctgaattttaaaaatctaagtcaagttagggcaaagactgaattttagcccatatgtttatgcaatgctcaaaatattaatgtacaggcaagataatttcctggggggaaaacatttagatgtgtttttgtagtaagaacaaacaaagaaggtcaagctcaagtaaaagtgacccagaggaagcattcactgaagagattggaagaagcatactcattccccaactctcaagctatctcaaggattagtaattttcaattaaaaaatttctttaaaaaaggaaactttctgaacatgaaaaggttttttgtttgtttttactgtggatgtaatcaaatattagagatgtcatccttgtgtgcaactggtatctagaaatgccttctggggaactaaatacaaccctgttaaatgatagacagtgcatggtatgagactcaggctgcctcagatcttattctgagacccctgtgtgttccttagtaacagtgatgcatgaatacaccattgagaaggggaaactgaccacagtggaggtccaaaatgaaactgctcacactactaccctctaaacaagagtggtggttgagaggtgcaggctctgagccactacattcacagacatggaagatttggtgatatttttatccaatttaggaaaataaaattaattcagttgtttcttgttctaagttaataggcactaagtcagaaaacttttcatctacatatttttttttctctttaaacatagtgcctcatgggtggaagtgatctggacttcatgtttttcttttggaaccagaaaacatgccatttttggaatattaagcaatttctttcttttggatatggggagggagaaatctgaaatgtatctttagggcacagtttggaggggccctattgataagccctttcagtcttgcaactataaggcaaagtttttgctgaagtcttaggtagtaagttaactacagtgcaattatattttactaagatagtgtgttttattttctaatagtctagtataaatctaatatattagcaaattcttcagaagacagaatcttatttttcttggatctggatttagatgaccttactgcaaattattattgattgctggtaggggatgagtttatgaagacatctgtgtactagaggctaggagctgagcccagcctatgagaagggacatagagctgtgatcttgactttcataagagaacatatgttgttatgaacttgtgtttttgctgctgttgtttttgcttcctgctggtggatagtgatgacaacagcagtcctctaagtcacacattgaagatggcagaacagctatcagcctgggtgaattaattcgtggaggggaacttctgccttaacctgctcttaactgtgacatcaggagaaaataacttatctcgcttgggtatttgcctatgtgggggtctctttgttatagcagttagcactctcctaaatactatgctagtgtactaaaataaactctcaatcatggaaccctagccctaaggctttaacaagcaatgctggaagtgtgcttcctcacctcctccacttcattgcaaaaacaacctcatggatggccctgtgccggcacatactgctatagcagcatctgtaatggattttgtagacactttgtttacatgtttaccatattgtaagggaagagaccgagtcatattcatctatttatctcaattgtcttgtcttttttggcccacagttggagattttaaactgtttaattgatgaaaaaagatgtcaggttgatttacagcatcaagtctgatgatttaacaacagcattctgcacagaggggaactatgcaaaaaggatcaaagccactgaaattactaacagggccaaaaaattctaaccacttccacaaaacgactgctagggtttaaaatggttacacagctgggcacagtggctcacgcctgtaatccgagcactttcggaggccaaggagggcggatcacttgaggccaggagttcgagaccagcctggccaatatagtgaaactccatctctactaaaaatacaaaaattagctgggcttggcccaggctcctgtaataccagctcctcgggagactgaggcaggagaatcccttgaaccagggaggcagaggttgcagtgagccaagatcccaccactgcacaccagcctgggtgacagaacgaaactctgtctcaaaaaaaataaatagatagatagataaataaaatggttacatgctcctttgggagtgtgttctaaagccaaacaaatcccttcattctgaggcccctggtgtggtgctggaacctttgactcagggcttatgaatacttgtttgtctccaggactgaagaacagaatactgaggtggcatgtccggagccaccatagcgctgtgatcatgctgtgtcaatttcatctaagtttttgtgttagaattcctctgtgaagttgactgctcaggtgacaggttagcccatgtcttaaactgggctgaaaatgggtttcatgtacaggtagttttacaagtgctctcagtgcaattggtggactaggacttcccattagggcagaaggccccaacccccgggccgcagaccagtattgtggcctgttaggaactgggccgtacagcaggagttgagtggtaggtgagtgagcattaccgcctgagttctgcctcctgtcagatcggcagcagcatttgattctcataggagcacaaaccctattgtgaactgtgcatgtgagggatctaggttgcatgctcctcatgagactttaattcctgatgatctgaggtggaacagtttcattccaaaactattcctcgccccattggatccacggaaaaattgtcttccacgaaactggttcctggtgccaaaaatgttggggaccactgctttagggataggctgtgtctgctagacaccaaactaaaagtcaatttaatatatgattgagcccagtaagttcagccttttttttcttttttttttagtgctttatagatgctgcctccctgtcttctcactggcgttgttgctgataagaaatctgcggtcttccttatcttgtatggaacatgtcttttcttcctctggatgctttgaagattttctttttattgctgactttgagcagtttgattttgatgcaccttggttttatttcttcatgttccttgtgcttgaggctgtttaagctgctttgatctgtgagtgtatgagtttcattaaatttgggaaattttcagtcattattttttcaaaaattttttcctattctcttcctcctttctctgtcctctcattagggtactctgtctacatatagcgggtgccacttgacacccacagatgatctgtacctttcttttttctttctgtgtttcatgctggatagcttctattgtcttcaagttcactgatcttttcctctgcaatgtctaaactgctgttaatcacaccccatgtatttttcatttcagacactgcatttcagactctagaggttttatttgagtcttttatacattttccatgtgtaacttttaaaatgttttgaacacatggaatactgttataataattgcttatttgataattttaacatctgtcagttcttagttttcatttatttatttttctccttattatggattgcattttctatttacttgcaggatagtttttagttgtatgccagacattctcaattttaatttgttgggtgctgaatatttttgtattcctacgggtatcttaaagctttgttctaggatgcagttaatttacttggaaactgttgatccttttgggtctaatttaagatttgataggaaagactagagcatggttagtccagggctaattattcctctgtactgaggcaagaccctactgactattctccccagtggcccatggattatgagattttcttctctggctcttgagaacatgcactatatgcacccccacatgagtgtccgatttcattctccctaataatttcaggtgtttctttcccagccttgggtatttgcctcagacacatgtgctgagagttctctgttgaatatttaaggggagtcctctgcacatctctagggttctatgtgtggctctctcctctttgatattttgtcctatgaactctgatcactttgatatctcccgattccccgatccatctcctgaacacagtgagtctaccgagatccccctggtccctcaatcttcataccatggcttggaaactctctctcaaggtggtgagctgagacaatcagaggactcaccttcttttgtttcctgtctttcagagatcattgtcctttgctgactaatgtctagtgtcttactaaaaaaccccaatgtttcacatatgtcttttctttgttgctgttgtttttccttgaagaaaggtaaatttgaaccttgtcattccatcttggcatcttggctggaagtggaaatccctctggttcagctgtttctacaactttaaagttctgtaatttagaactttagaaatcagatcatccaatgacagtactaaaattaatgcaaaactattaaaaatgggttttctccatttatcgatttggatgcatgtggcatttgcaacacagatgtggtctttgctatccgtgctgcttcccgggtcttgcagggaagaaatcactgagtcctgtgattaggaccaatgacctggttgtggccatgctcctcccatctcctgctccacagagtgggtctgttcttgtcctgcaacagactggtcattgcctgtgtctgagtgtaccatctccaggacactgctgactagacagggtgctctgatcacctctgtgtttatactggcctagtttctaattgatgaggcacgatgcttcgcgttgtattttcatcacagtctttcaaaactctgtttctttacatttaaatctaaagcttggcatcacaccattaactagaacaaagacaagtcactttgtcttagacaataaaccatgattcttaacttgcgtttgatagactccactaatctgccctggttcacttttacatgatacactacctactaagctatgctaaagtcagtctttctcaaggctgttatctctctctctaaggacaagtctctaatttcccagttctcttgcattttttattcatttggggcacacggccagagattctgtttccttcttcactaagtccatgttgctattacgttagctcattaaatattaatagattaacatccaagtctctctttgttctgtcttatttttaaaataaatggcaaataacagatgctttgaaaagagtcacactttaggaggaaaactgagtgtacaaagattttaaaatgtttgacttcatagcaagtacagatatatttctacagttcaaatcctgggttttcagaaagctcaagtacaatagaaataatccataaacgggagttaaaagaacattcgttcacattttggaaatcttcaaagcactatacccaattgttttaatagtctgcaacaaacaaaatcactgtactataaatgagaaaaaggtaactgaagtccatgttggcaatgaaaaacatttatcactttgcttctgccataataacattatgtttttctgatgctcataaaccaagtaatgagtgttttaaagtttaaaaagtgtttagggccattatgaatatctagtttgctagtcaatttgtcacagaaaaagagtgtgcatgatcttcctataaagagaatttattgttttagatgatgaggtctataaaaagctgtctccatgcaaaattatagtattttacctctacatttctgtttttgttgggtcataaaaagttaagaacactaaagaaataccactaaattttaacagttgctataaaaatgcattctttgaattctagatttcagatggtaacactatatgctgttgtgtatcctaactcaatcttttaataattcaatacttttttctgaaatcatctttttaaaagtaaggatttatctgtttggtttctggacaactcatcctttgtcttcttgaaattataataattcatcattgcttggcttcatgataatcttctgaaatcttccctaagaattgtccacttgctcttcccatgaaacatggcaaaatagtatattatacaaaagatgatgataatgtgactgatccctatatgtgtacttgtattttgataagaaatgtttatatatgtatgtacatatttataattactcccaaatattacttatcagcctctcgtcatgcctgagaactatcccattatctagaattattagggaagcagcgcttctcataagcaagactgacatcctaagaggcaaaatcctactttaaccattgggatggaaatcttttgcaaatgctttctgtcttctaaaattactagtaataacattttcttgatgacagagggccaactttatgactcgcagagtagatggaacagccatgacattaaatggtctctgacagtttttctttcttgcattcttatattcagttttcctaactcctctgtcttttctctttgccaccacagtatctactctccctccttatgatggtctatgtgtctgcttacaagagttcttgcttttttttttttttttttgagatggagtctcactctgtcaccaggctggagtgcagtggcgtgatcctggctcactgcaatctccgcctcccaggttcaagggattctcctgcctcagcctcctgagtagctgggactacaggcacacgccaccatgcccagctaatttttgtatttttaatagagacagggccaggatgatcttgatctcttgacctcatgatccatccacctcagcctcccaaagtgttgggattacaggcgtgagccacaacacctggccagttcttgcattttttaacatgttgatttccgataaggacagggaaatctatggtcgtcattgttaagctttgtctaaaacagaacagcttctgttatgctgactttggctattctagacctttctgccattttcctattattctctactcgcttagcagtagagaaatttaccaaagaaatgcgctctggatatgtggaataactgtgctgaactaatgcacagatttattgtgctggaaacagtaagaggctattgccagaaaatattaagaataattatcatacttcttccataattcccattatgtaaagtagaagagactcttaaaatataaaaatagtaaatgctttttaaacttgtcattttcttactctacacacctaaagatccacacatatctaagcagttcttgcagctgatctggttgcccctgagatacggaacctgcaaacttacacggaaatctcagcacagtaggaaccgcagaactggccctttgctactgagctctgcaacctgcaaaacattgttcagtctgaacactgaaaagaaaatggttctctcataacttctttctatcaattttacattgtattgacagtatattgccagctgaaccaaagaatcaaaatatcataaaatgtgaccatctgaggatggcctggaacataatatgtgctaccaaattcttattgactagtagacattaataaatagaaaacactgcaaccctcaaggaagacatatagacatggatagtaattgagaaaaataatcacatttgaattttttcgctcagccaatcacaggggtagtcagtgggacagaaagataaatggggcttggtctgcccataaggggcgtacagactaaattctcttctagaggacagtcttagcagctcagaaggaatcattgtatgaatgaatgattagtgccactgatccttaaatttggtgtttagatgtggcgcagttctttgtactttaacatgtcttttttatctgtccgcttttaggattttttttctttgttactaattttgagcaatctgattaaaatataccttggtattttttcttcctgttttctgtgcctggggctccttgagctgcttagatctgtgagtttatagttttcattaaatttggaaaattttcaaccattattttttaaaatatttttttctgttctctttcttctctcatttggggactccgtttacacatatatgaggtcacttgaagctcactgatgcactgttcattttttcttcttttttctttgtgtttcattttggatcattcctattgctgtcttcaagttcactaatcttttattctgtaatcttataatctgctgttaatcccattccacataatttttgttcaggcattatattatattatatttattatactttaagttctgggatacacgtgcagaatgtgcaggtttgttacacaggtatacacataccatggtggtttgctgcacccatcaaccgttatctacattaggtatttctcctaatgctatccctctcctagccccccacccctgccaggccccggtgtgtgatgttctcctccctgtttccatgtgttctcattgttcaattcccacttacgagtgagaacatgtggtatttggttttctgttcctgttttagtttgctgagaatgatggtttccagctccatccatgtccctgctaaggacatgaactcatccttttttatggatgcatagtattccatggtgtaaatgaggcattatattttaattctagaagcttgagtttgttcttttacatatttttcctatttctactttttgaacatatggaatatagagttgaaaggttgaagtcttacattcaaaatcttctagaggccaaagatatttctccacttttaagttgttattattacatgataatgaaataagtatttctcaaggaaaatgataattgataaaaataaaggaagagagaaagaagagagagacagagggagggaggaagagagagagagacagagagagagagagagagagaaacaacatcttaagatggcacacctgatttgccacaatctagatctttgtgtcttagtcaggctgatgcctgaagcccagagcccattttcctgtacccatctagttagtgctgcaaggcaggggagctgggtagggtcttttagctcatgagcacgtgagtggtcatgggcacatacagtgtcttggcctatcacatcttgctaccatccttgcatccagcgttgtgactgatgtgcatgatgtagagtgaggcagccctgattttctctgcagatgacacatctgagacacagtgatatgctgtagtttgcccaggctcaccatgctcagaaaaggtggagcctcggtttgaactgtgatttgagtcaaagcttcctagatcacgctaaatttagagagacataagatgtaagtcctcattccaggaagtgatttccattagtatctctttcctgctcctgtaagactatgcttgggatgtctacctggtgcaactctgcttttgaagcttttctctaccaatctctggttgcaagcaagagatgtgtacaactctagggctgtctatgggcagggtgtagaaaagggctaattatgcccattcctaagactcttaggagaagaagtgggtctggcatggggcagcggctagctctgtaggaagaattgtcagggcctggcacccatgagctgggatggcacacttgagaaagaaggaagttctgtagcttggactgtagtaatggaaacaaaggatgacagagagaatgacaagaaggcagacatccaaaggaataagcaaaggggagggtgtagttacataatgttgaggccagggtgtggtgagtgtgtgacatctatggccttgagcttctgatgtccgtgtgtatatgttaacatggtttggatgaaaataaatgtaaaggaaaggagtgattgatgaatatcccacaccccaggatttgatatgagattaatggaacatgcatggcagaagtgcaaactttctctcttggtattctccccacctgccctcattcttctaataggtcaaacttttttatgcaacaaagcaaattagcgcattggtgaccagactcaggaatgaattactatggtgaatctctttttgcccaaaatgagtgttatgaaaatcaatcaggaacagtgttagtttataaggactcagaaaaaggctgttctaatctcctctccaatcataaatttactttaacatgtttgccaaagtcaactaacaatactattcttctctgtaagcccatgctttaaaaacataaggggttcttttcttttcttttcttttcttttggggctgggacccggtacattttaagtgttcacatgggattttacacaggtatttgagcattaactctcttaccagttaatgatagtgctttgaaaaaatatcaacctgtcacaatctgcactgaaaacaaagtagctcagctacaagaatagaatgaaaaacatttcacagcattttcagtgactataaccacatctagtcctctctgtttgtagtgatcttcaaggactcctgagcctttaagatcaatttttaaaaggaatacatttccaagtaaaacagttcaatataatttttttttctctaacatcctagaaatctttattagagttgcatttctcaaaactggacttatattgttttctgaggagttgctcataactccagatttctttttattgtaatgaactggccataccttccagctccctgcagccaagttctgcagggcgcctgccgccccttccagcgtgtctggatttgagcactcagagagcagtgtgaggtagggtttgactattgatgggtgccacagcatctggatcccttttggtggttcagcacagtctggaagaggtcctactccatcccactggcggaagaaaaacaagagagcaaacatctttaacatctttatgcttcccaactttgccttcctcaaacattacaggcgaaaacaaaagcagagtgctatcacatttgctgaacatagactgcacggaggctattgcatcagcagtccagggatcactaaaagtggaagccattcctgcccagcgagagcttgggatcgagggtggagggtgggttggtgtatgcacgcaagagaatgtaactggcagaagaagtggataagctctccaagaacgactctaacatgttgctgtaggaaggaaggggaagagatgaattaattttgattgagcagtttggaagaaggataaagatcaaggtagcatattttatagtaagcatactaccagtgttgcataatagttaccaacaacaaatgccctcacttcttatgcatcattattaatgtgataaactcctatataatttgttacatgtatacaaattgggttctattgttgcatctaacaaatgacagaatcgataaaagagagaaaactgctatagtctattagacacaatgacatgagctacaggcaaatctagatcttggagcaatcatgatagttaagtttgctttgaattgaatctaatgaataataggataatgtgtaattcaaaattaattacccataatttagaaattatggcttacacgcacaaaggaataccagtcaaccattaggaatgatacttatgaagactatgtagcaacttggacaaattataacaataaaagttaaatgagcaaagcaggatgcaaagtagtatgggatttgcacattattccaactaaaatgcatcataaaatacctgtaattatcataaaaatttactaatacaatgtcttttttttctacatttcaaacttcctgttctattactcttaacaatttaaaaaacactaaaaattaaaataatgattctgatctttgattacacaaaggctttgtcttttgtgaaaataatgactataataaagttagaaatgaaagatgctatgcttttagaaaaaaatacacatattcagttctgagaaaaatcacagtaaaataaacaatttctttataattttagtgtgagaacatgaaggtatttagcttattagtgtttattaatgattacttaaaaatacagtgtaaatgacatatgctaaatgtacttacagatattttatgtacatacatatatgtgcatgtatataaatgtgtgtgtgtataaatatgaaaaacaaaaccatatttctgaatgtaagttccttaattctgaaagttttactgcaagaaaatacatgcttactttttatccttgcaacataaaaatagaaaagtagacagagatggctgctgtcacaaataatttcaaaaacttcattatttatttcttgaaataagctaaactgcatgtcttcttttcctcaataatgacacagcttagtttaagtcaagggtaaagctcagagatgaatgacatcccattaaaggtcattttcaatgaacatgtcactcaattttaactttataacaaggacactcagtgtgggaagcttcctgtccttttaaccaaagccacttcctaactattcaaagatgactttgcacctgtgaactgcctatcaataaaaccaatacatctcctttaaattaaaaaaagaaggaagtgaactagccccgtcacattgctcctagttcattatttgatcctggcttgctgcactgaatagaaagtgggcactagaaaaagacagtagtcattctgtaggtttgccagtttcaatgacaaagcagtagcaatattggcctctcaaaggagaccagcttggggtagtgaatctatctgctagagtaacaagaaatggcaaattatttcttttatttcattttatatcttgtctccttaaaaatttaaagcaattattttcatataaaaatggataaaattcagaaaaataaaaatgtgaaacttccaactcaacatggatagattttccttttatgtaagagctaacctaacagcaagaggtacagagaagtaatatttgcatgctcgttacaaaaaagaggaaaaagtagccatgttatcttttgctgggtttcatcttgttctccttttctaacttctgtgcaataaagcaggataaatggttaagtccgtagaaaattttcctcaggctctgacatgtcatctatgtagctctcaaatatcttttattacaatcctttcttaatggctacagagagaatctgaaggaataaaaggacaactgatgtgaacacagataatctttgatggcaactggagatggagttcaaaggggattcttggctattttagcacgttgatattgaagaaaaaggactatttcaaagccagtaaatgtatctgccagacctttatctgggtactttattcaaacttttattaagttaatagggagaaaagtatcataagttaatagggggaaaagcccattaaaaatagatttccatcagctgtaacatgactggacgtattctgtaagacttgggttaacatgcttgatattattttgtctagctcatcaacatcaacaaggtagtagggcaatggtgaagttaggatcagactgatgtaggtgagacaattctgcacatgcaaacttttgaggctcgaatgtgaagattcaagaaaaatcatgggatatacaactcttgcaccaaagtagaaatacttgatttacaaatttaaatataaggtgcttctatcctaaaatatctacaaaaatgggacattatcagaaggcaagcaagtggcttaatctgtaacataattgaagcagtgaccacacagtgattcagccctgaagaacacaagactaaacttacaaatcttgtgcaaactgtgttcgttttggactatatcttgagaacctactaccaaaaactctttaagagcttgaaatatgcaaagaatacataaagaagtaaaatgtcatcaagtcaggagagagaattttctatataataaagagcacatgaagacaaagtatttccaggacagcagtggtggcaatgccagaaaaggactttttattatgttatctgcatgacgaccacatatgtgtgtgtgtgtgtgtgtgtgtgtgtgtgtgtgtgtttacatcttcactcctcaggttgcagtttaaaaattaagcagaatagagaaagtgagagaaatagcacgaagacagaggcatttgtggttttaaaaaagcttttttgctgggtttcatcttgttccagcttgggggaaattttcaatgaaaatatcccttcctcctcagaattttactccttatgtttgagagttacataaatgttccacaattctgtgcaacatgttaattttcatctgttatattttaacgaataaaatttgcaaaagttctagtatcccttgagtcttacagatattacttcaatgttcaaattacactttgtgcaagtcattcacatgctgttgaacaggaaaacagaccaaaggatatatcactagtgtaatactgaacctcctcttatgaattgtcttgttcatagaaatttctaattttacacacatatttagagttcataaagctaaggattaaggtggctataaccagagtgtttgaaaactgagtaattgagaattagagctctgttggagacaggctggtagcaaagcagtgagtgtacatagatcatagaacaaaccaatagattgattttttgccactccaaatagtgcttcacccaataatgtatcagcacttttctttactggcttcaaatatacaactgcatgactaatatccataaaaaatcagccaacagtttctgtcattccatttctaaaactgtatagaattgaaaatatgtattctttcattaagaaggtaatgctcaaaaatttttggaaaaaaaagaggatatcaagcttcccaagatagaaggttaagggactgctgaaatttagacatgatgctttttgatatggtcaccatcggcacagagcatacataatggcccctgtaaaaaaaggtctgcttaggaaggaaataacatatgcgtggggctgtgctcaatgtgtatgttacaaagaaagaaaaggaaaaaagcctttctttggatttgctttaaatacttttgcttccatgcagggcttaaattctatttaaaagatttttttttttttttttttttttttttttgagacagagtctcactctgtcacccaggctggagtgcagtggcacaatcttggctcactgcaacctctgcctcctgggttggagcaattctcctgcctcagcctcctgagtagctgggattacaggtgtgctccatcacacccagctaatttttgtatttttagtagagacggggtttcgccatgttggcctggctggtcttgaactcctgacctcaagtgatccacccacctcggcctcccagagtgctgggattacaggcatgagccaccgcacccggtctatttaaaagagttctatctcagttgggtttgagaatgaaagagtggaagccatttgctccttatatgaagagaaagacgtaacttagggataaaaacctgaaagtaggctgggcacagtggctcatgcccataatccgagcactttgggaggctgaggcaggcagatcgcttgaggtcaggagtttgagaccagcctggccaacgtggtgaaaccccacctctacaaaaatacaaaaatcagctgggtgtggtggcgcacacctgtaattccagctactcaggagactgaggcaggagaatcacttgaatccaggaggtggagtttgcagtgggccaagatggcgccattgcactccagcctgtgtgacagagcaagactgtctcaaaagcaaaaaacaaaacaaaaaaacccctgaaagtaaagatgtcaacatactatattaaaaaaaaaaaagactttgtaaacatggggttctttaagttatagagagtcacaggagtactctaattatcacattcataaaagccccctaatgaatgagaagaattacaggacaatttacaagactcttctctgtgagccatcctgcaactgccctagtctctgatctccaatgcactgggctgggtactgaggagacaccaacaaggagcagtcagggagtatggagaaggatttccatttcaggagaagtgctaaaatacacagctcctctttccacctgtcacaggcttcatacagtctccgccaatcaagtttgtgtgcagaaaagaccttttactgctgagtcgtatcttcagaacataaacagaaaaggctggcttcaccagcggaatgcacctctatcacctagatttctctactaattagggagcatcacagtcattacatatgtgcaggctcactttcattttttaagatatttcagtgaaataaacaacagaccagagatgctgcaagataaaggtagcagatctgcagcatcagggaaacattctgattttaagatcccactctttcctctcaggggaagtcacacattgcaaaatgtaggaagagaagatggctctaagtaggtaaactgtcagagaatgttctctcaagcagggtttggtttaattaagctgcagccagcactatgtactttaaaaagcaacaataaaaacccaagtccatccaccgtctgccactcttgcttggcttgctttgaacagcagagttattacataatttgcctttacagtgtttcatggccacttccagcttttggggggttaaaggtggaaggatagaggtgatgggtattcaaaaactccagttaactgtaaaaagccagcgagaaatgattctttgtgttgattcttaggaatttcaaagaaaacggtagtgcgggtgtctgaatcccccaggagctgttcagaagacttcggctgcagctgaggctgaggctgtgcaaagaggggatagagttgatggctaattagctgtatttatgtggcactgcattgtctccaggctctccttgcaaaagacaggagggactttgcatttgagagattagaaacccgcattaaagaggcaggatgaggtgctgtctgaacaaagcgttagggcaaaagagattcaggaatagccttgctgatgcacctcctcctgtggggggccacggggcccggtgagcacacatccctcaggagtgaagctggtgatgctgcctactccacagactggcatcacgaggccggccactgtgctgtgccccacagaagacagctgtcaaggctgctccatatgactgggcctgcctgtcccttcccaaagtcactgtgatggaaccaactggggcatcactgatgctcatctagaattctctctgctcctaatttgccatccacatctagggaaacctgggacatggccgtccctgttactgccttctaaaggggctttgtccctgacgtgccaacctccttcagataatcctgtggtcttggtttatatgtttggtaatatgtccttcgaaggacaatctagtccaatggtctcaaccagggcaattttaacacccagggggacaagcggcaatgtctggggacatttttggttgtcatggctgtggcagaaggtgctactggcatccagtgggtagagtccagggaggctggcaaataccctgcaatgcacaggccggctccctggaacagagaggtatgctgccccacatgtgaccagtgccgaagccgagaggccctggtgaagttgtaaaagacagtattgatggtgtggaaggctgagagataaaatacaattaagaaaactaaacgagacacctgaaacagagttttaagtctataaactcactgaaactaaaatagcagcacttttaggtgatgggctatatcttccactagaggtgagaaagaagtagaagaatatggttcatccatggataatggcagacgagagttgctgcgcaaaaatgcacagccgtgatctttgcaggctcatgagatatgttgcttccaggacatgaaatatcatgccttgagtcaacaagctcccagcatatggtgaggtgaaggccgagggagactgtactcgaaccagccaagaggaacgggcggcagctgaaagaagcagatggttagaaaggaaatgatattaagcggcaaaagaaagagtatggttactaatgagaaaatgaaaactgtctggaagaaaaagaaaaacaacctgtgatattaggaaatgaaagcctaggagcatccaaatgtcatgaggagcagatgcatgaagtgataataaaaaatcaagtccacgaacagaaactgtcactgacatttagagtgattaagataaattctggtttgcgtattgagagtcttaaaagcatgcatttggtctagctatttcacttctaagaatgcactctcaagaagtgattaagggggtaggtgagatttaactacacagatgttcattacagtttacattagtacaaacttggaagcaacctgattttctaggaataggggattggttcgccacgtcatggtattcctctaccatggaattcacagtagctcctcctcattccagtgtgaagaactgcttactggcaaggaaaaaagtcagtctgtgtcaaatgataagctgtcataaagtggtcagcaaagtgacatagagcagacttgtgcctacaccttcccgcccatcagtggtgtgccaaagtgggcagtgggggctgtcacctgggggcaggtaataagaggctgcactctttgcagggaatgtacaggtaatgaaatgaatacaagttgggtttttgttcactaccatgtgcagacaatgctacacgatttcactggtaagagactcctcctcacaaggagagccccctactcactgcacaccctgaatgggccactacatgcctttttttctttattaagagaatgcccaaggttcacctagggtcatagttgtcacaaaagactacaatccccagcctccctcgcagctctggtgccactacgagccagtctaggccacagggatgtaacagtgatgtgtgcaacttctgggtggggtcctaaaggaaaggatactcctgtcttctttcccccatttctgctcctgaactgtggatgtgaagagccagaatcgtgaccatggggaggaaggcagcaccctgaagatgagagccccataaaatacaaggagcccacctctgaagactcaagagaccggagttctacatcagtggaaatacacttactaactataagaccttatgaattttgctgtctgatatggcctctaacagaaaaacatctgaaaggatatatgcccagatgtaagttgtaactatgaatctctctagaaggaggcacgctgaaggtgtgggtattattttcttcttggaggttagtgctattttactcacatattatttacatgttaactatgtaaatgtatacctagatatttatcattaatatctactttgtctgaaatgagaagaaactgttaaagttcaaatctccattgtggtcattttaactactaataaaattcatgtttgtgctttgggatatgcatgctgtttatttagccctagagtctcacttttgggtcaagagcatccgaatgacatagcaggcaacgtgtgaggctcttgaagaagtggtggccaataccgatatcctgaaaatccaagaaaaccttgtaggtggtgggatttcatgatttctcataacaccttcagtgcaaagaatttgtttagtctggcaggatcaaaagtcctgcttctccagggatactttttgacacatacacatatacctttgttgcatataaacttaagttcttagatgataacagtaatttagatggtgcatttgttttggtggtgattgcagattcagaatactgactaacagtgagataaatgcagcactgtcatgagaggctggggaacagctcaaaacacagggagggaagactgcggaagacgcttggctcacagcagcccttggggcaaagtctcaccaggaaagaaacagatgagtctgggaaaagtcacagctatgagcatccacccacaattaaacccacagcaagagctaggggccaccataggccacagtgtaattggggccaggcattgggctagaagtcacagaccgaaataagacccacagagtcctttgccccagaaaattcgctctctttggggatcaattgctatacttaacccataatatgataataactagcagagaagtttaaataaaattatggagaagtagattagggagtaattgtttacttgaaagaagtcttggaaagatagaggggatgttttatttgctcttgaatgattattctccaagtagtgagtggggaaagggagggccaggcagtggaacagcatgaacagaagcgtagaggctggtctgcgggatcctaagacaggccaggaaagagtgcgggcaagaagccttgaaagttcttccaagacatctctttcattgtgggaaaaataagggggcattgaagttttacacagaggcccattcctactgcttttatgcataaaacagcaccgtgtatatcacaggtgaatcttccagtcatttatgcatttggcatctacaacttaacaaagaggtgaaaaagagcaaaaatatttactgttaaattgactacagtgcactcagttgtgaaacaaagatgatcatgaaagaagacctaccagataaaaatagtggatcagaatcctgtttgaattgataggtttgtctcctcacccatgcagacagacatatattttttacccatttaaattaaataactttaaattgatttataagctaaaaagggaggttttggattccatcaggtcctgcttatttagtttttgtttttctcagtggccctctgcccatggtcaatctcacaccaacagcgccttgaagaaggtctgacctgaccagcagctggtggaggacaatgtcccgtcacctccaaaccacgctgaaacagtacccacctcaggacaccatcacaggatcgttggccatagaccaaggtgaaaacaaaccaaaaaatgctgattgctacaaaaggtgcaaaaagtaaatgaatccattttgtctcctcctatttccctggaccccaatcttcggattccctccaccaaccatgcagtgacagtctgctgtcataaagccctgctgagggcagagagggtccttctgggggagacgcgccttcttggcagatgacatgctgactgtttcatgggaggttttgtccaaaacggactagagaaactagcaattccttagaactcagcaacaggcacacagcagatgcaaaaatggatgagtttgcaaggacctcttagaccagaaagtgatgcatagagtgtcaaacacttctgcacacaggagctcgtagtctggtgcttctagactagaatggcctagaagtctgatacttctagtatggttcaatagcaaccatttcttgaactaacagcatgcatgcatcatatttttgtatcatatattttctagaattatccctacagggatttttttttaaagtttctgagatttttcttatagctaaatttgacatgcagaatattatagtgtctttttaaggtcaagaacaccaatgccaaaggtaagggtcaacataaatttctggactagaaaaagttctagaggccatcattaaaccaattattatttgtatcacttttactcctgttataatatttggctcctctgtcctggaaggtctgtgttgtagactagataacctttcattttacataatgtcttacacctttcagtgaggtataaatttctctgaaaaaaaccatacacttttataagcatacattaacttagtgcctttatgaacattattttttaaaggccatttgcaaagattacaaatgtaattttcattgtagaagatttataaatacagaagtacaaaaggaatcaatcattatcttctcttggatcttactctgctttttcaagaaacacatatattttgtacaggcaaatagcattttgtatttgcatatgacatattatacaaaactggccagattgtatctgtatcatctatacctatatctatgtacgcacctgtttttatattgctttttttcactttacttgtgaaactctctgtaagctccttgatgagataaatcagtttccaggccctgaagttaaccgctgttccagtgttagcaaaggtggggatgctttgtcctcccatcgctccctgtcctggtggggcctgtggtgaggggtttggtctctcatgggctccccaagacaggagcagagactgttctgatgcatcagggttgtgagttgctgcctagcggccttcgttttgctgcaggggaacctacttcccgctgcagcaggtgagggccattctgttctcaagaggcctccagctccagctcaacattgttctgaattcacctgaattgttccccacggccaagcttctaatgccatcctgtggaagggctgtgaattctctgttaccccatttccaatggaaagtgtgagactgaaaatctaaatgcttcgaaaccagcgattaaatacatgatggatctttggcctccctctgtctctctctgtttcccttcttataccacatctcctgttccacccatccctgtcacctggatggcatcaaatccagctccgacaatgccctaagtaaatgtgtgaattaacacagcgcctgctcagaggtggaatgtcagagcttgctagggcctcaggtgtctttttttcttttttaagtaatttcctatcctggctcaactgcgagacgtgagggaaatcatttcatgtcccaccgtctcagctgtgaaattcccacaggaaaattgtgcagatgcattagtgattttacctcctgatgaaaatgcagggctcattctctatatattgaggatatattacagttgcaattaggaaggggataattgcatgcagctgcaagcagcctgcatcacctgatcttgggatttctttttcttcttcttcttgccccagcacccagagctctcagcatccttgccattggcctcgccacagagtagcccgtccagctcgtccgtgcccatgtgctgtccctgagacgtttctgccgccagccggtacgagaggttccttaaaatgcacacacagttttcaacggtctgcagaaaagggggaaacagaggaaagaatgagtaaaactagcactcagcactccattcttccacctggaaaggcctctttctccatggacacatttctctttggaagtgtttagctgccagcttctgaaagctcccctgatggccacagtggaaaacaattggagaaacttagaaaggtcttaggaccttttatcccccacaaataaatgacttatcagcaatagttacttctataaacatctgttattgttgattgaaattcacttgtgagaagggaagaatgtacaaccacgagagatcccaaatatcatccactaacagacagcgccccacctctgactccctggctggggattggggatcgggtaatgaggaatcaaagacttagaatttcggtcagctctggtggggggcatatttactgcccaccggagcattttccgagtgtcaaggaggctacaggtgcaaaccagggttgtcccaggaaagtgaggggctgtgatcacctggggtgcataaatatttttagtctacatttttttgagatgcctgacactcatgttttcttagccaaaaggttaaacagtggttaaggacacatgttgtggagccagacacctgtagaaccctaggtgtccgatttagctgtgggactttggacaatgcacttgacatctctgggacatggtgtacccctctgtaaaatggtcataacaggtcccacatcttaggttcttgtgcattagttgagctaaaacatgtgtgtggtacgcagaataatggccctcccagaaggtctacattttttttttttttttgagacggagtctcgctttgtcgcccaggctggagtgcagtggcgcgatctcggctcactgcaagctccgcctcccaggttcagaccattctcctgcctcagcctcccaagtagctgggactacaggcacccgccactacgcccagctaatttttttttgtatttttagtagagatggggtttcactgtgttagccaggatggtctcgatctcctgactttgtgatccacttgcttaggcctcccaaagtgctgggattacagtcgtgagccaccgcacccagcaggtctacatcttaatctctggaacctgcgcgtatgttaggtcacgtggctggcaggaggtgggaattgttaagctaatcagctgcttgtcagatggggaggttatctggattgttcgggtgggcctgtgtcctcacaaggggcctgtacgtcaaagaggaagtcaggagagtcacagtgatgtgatgtgagaaggacatggctgaccatggccggatctgaagatggtggaaggggccacaagccgaggtatgtgggcagggtctagatgctggaatagggaagggaacaaattctccccaagagcctcaagaaggtaagcctcagaccttaccacattttaattttatcccagtgagacccacttcagactgctggtctctagagctataagatcataaatgtgtgttgggttcagccaccaagtttgtggtcattggttatgacagcaacaggaaagtaacacagcgtgcaagtactgggaagaaagctggggcacagtaaatgctcttcaaatgttcatatcattaacagtggcaggagatggcacagtgcggagctccagaggatgggatctagggctagccggcttggcttccaatcctgggcctaccatttcacaagctgtggggccttgggcaaagtgcttaatctttctgtacttctatttcctcatttgtaaagggagggtcatattaacagtatcatgtacaggctgggcgcggtggctcatgcctgtaatcccagcactttgggaggccgaggtgggtggatcatgaggtcaggagattgagatcatcctggctaacaaggtgaaaccccgtctctactaaaaattcaaaaattagccaagcatggtggcgggcacctgtagtcccagctactcaggaggctaaggcaggagaatggtgtgaacccggaaagcggagcttgcagtgagccaagattgcgccactgcactccagcctgggcaacacagtgagactccatctcaaaaagaaaaacaaaaaaacaagcaaaaaaaacaccagtatcatgtacagagccacagtgagggttaataagctcacagatacagctctttgaatagtgtctgctcaaaactatttgctaaaatactagttgtaataacttctgattgttgagaagaggggtgagcaaactgccgcccaggggtccgatccagcccacagccggttgtgcataattggtgttttcctggaggacacccaggcccatttgtttatgaatggtctgtagctgctttcatggtacaatgcagaattacatggctgtgactgagacagtatggcccgcaacaccgggaatatttattctctgaccttttgcagaaaacgtttgctggttaagacaaagctgaccttttgactacaggaaccatggaaagcggagaaaaatatccaattttagaaggggtgaaacaatgatggaaaaaaaaataaactgagccaagttttatttgaagaatcttaccaagctggctatcattttttcaggcacctgctacgtaacagccactgtgatggcacataatacaattccattgtatgggtgaaaggaggacagctaaagctgtgagtacctcccaccagactgagctgcttctctgcagtcctggggtgggactggaatgggcaggggctgctgggatcacaatcctgcactgcttccctccactggctggaatctggtgaaaggtagcaggtgccctgtacttattaccgagggcatgaaaacttacgaggaaaaccagttttcaggaaatatctctggagcctttgtcattccagacctttcttgtcagcttttcaaggtgtcatgggctgctaatcccacaggctctgagtcaacctgattttctattccaagcatcctctgcatcaaaaagtggactggcacgaaagcaggtaaactcagggcgatgcatgaaagagagaaacgactctcattgaaaggaaaatgttatggcataagtcagaatgatctttaaatcagctcaaacttatttttcttacatcaaagacttgggagaataaacttctttctcatcccactgttcgtcttccctggaggcatcactgttcctctgtttaacaaatgactcctggggaataaatctgcagttgggaaaaatgctttataatcgagctgcagctggggagatgatttgggaagaagctagaagaagaagagaaagtagggatgggggcggatggggagggaggaatgggggaaagaagatcacagggaccacatttatctgtcatttaagcctccaggagttctgcagtctgggttggtttgggagagttacttaattcaagagcttttctctaaggggataaggagaaagagaagacaaaagacttgggatcctagcaggagggtggcagccggtagctttgcttgggacatccattgctgtcagcagtgctttcagcagttgcttttggttaccagggtcattttgattccttattttctattagaaagggttaatctggaagttgtagagtgctccactatatgttatccagtcaacacactggcccaattataggaccagagtcacaagcttgtatggaatccacgctcttttatgtattaacttctcaggccttaaaaagaaggtgtactcattcaaacccctcaccctcaatttgtcattgtgaaagctcaaaagcggccaagcagagggctgagtggaaaatgatggtacaataataatacattaaaacccaatagcacaatccagccagtgaagcacctgctgagtaacatcacatctgatcctttcaacagccttggcattcagctatgattatgctccttgtcacagagttgaggtcagttggatatggtgctccagccagtgggaggtggagatggcacagtccactggcactgtcttgatgccagctcagggctcttcttactccaccagggatatctgggttttctgactccagccctgaatactcccaattatttcaacttcctcttttggggaaaatgtggacattagaaaagatgatctaccaagtctcccaggttttaggaatctggtcatctgacagaaagaagatgtttgtgccatgttggttcttgaaccatggctcctgaaagatgccttaatctttggtgctggtggctgcacttagccaaagcatgaggctgttgactcttattttattttcagctgtaaggtccagctagtatcaaagctcttttcgtagccatcacagtaaaaggtatagtctcccagtgcctcactcaccactctgaatatgacgatgctgagcattgccgcttcagtgatttaccttcaggagccctttgaaaacacacgtgtctattacgctaacaagcacttgtaaatattcaagacatcttgactggtcacttgtttaggaatttaattttcctgtcgatgatactaaatggtctaaaatggtcacttaaggccttctgtgaaaggggaatgcttactctttgttacattatgttcatctttgaaactaaaaacacacagtcagtgaatggatgtgaacctaactgagcagaagttaaaagatgacaagtggtgctcataattggggtgaactagtactcaaagggctgacgtcccagaggtaccttgcattcagatctctggggagtaaggctcaggcatcagtgattttctaaatttcttggtaaccctaatatgtagtcagggttgagaagtgctatgctaacttatacacacagccaattaatgactacatggatagaaacacttttatttgttctttatctaactttgtaactaaattacattttaccagattcccaattagagagtcatattaaagctctatctactatggcaggttcttaatctaagatgtacatcaaattacctgatgaacttttaaaggtacacaaacttgtgaccagagttagacagttgggttaggaggactgcaatagggtctgtgcagatgtatttacatgaacactccaaaggcaattctaataaagagtcagaatgaaaaccataggattaaggtcacggttcataaccagggccaattttgctccctgcaggacatgtggcaatgtctggagacactgttgtttgttactggggtggggatgggggctgctactggtatccagtgggcggaagccagggaggttgctaagcatcctgcaatgcacaagacagtcacatgacaaagaataattcaccccaaaatgtcaataagggtggctcttgagaaatccttattaagaaatcacatttattacctgcattactttatgactattggtaaagtttgtgtttataacaggatattatgaaattacaaacatatgaatgaatcaaacttatttaagactaaataaaatagctcaaacactggaaaagcccacccaattctattctggcttgtgaactaagacactgaatagactttgctgatttattttgttgggaagccccatttatttagcattgtgacatttatttagatcttgcaggccttttaaaatggcacttagtgtaatcaacagttgttaaaaagcaagtttataagaatatgggattattcaaatcgcaaatctgggtgtggtggctcatgcctgtaatcccagcactttgggagtctgaggtgggcggatcacttgaggtcaggtgtttgagaccagcctggccaatgtggtaaaacccgatctctactaaaaatacaaaaaaatagccgggtgtggtggtgcacgcctgtaatcttagctactcaggaggctgaagcaggagaatcacttgatcccaggaggtggaggttgcagtgagccttcattgcaccactgcactcctgggtgacagagcctgggtgacagagcgagactctgtctcaaaaaataaaaaaaaaaagcaggtagttttaacatcttgtcttttctgttgaaagtggattacattaaaaaaaaaaaactagaagcttgtgagcaacgtggtattcaagtttatacactcaactggaacacctgtggtttgagtaacttagaacaatctgcatatttactcacagctaatcagaagttaggttatatatctagatccatgctagaattagaagcccagtctaaaagtgttggattcttataaggaaaccaggagagagttcagaaggaaagtctgaaatactgcattggctctccagggttgttagctattgttgagtcccgtgggagtctttattctcaaacatgtttaatctatgccagcacaaccaaccttgctatcgatctcactgctccccagcgcagactggatcacgtacagcaaggcatccgtaagcccatcacactctctcatccttctgcgggcctcctctccggccgaactaacattcctgcaaagcaaaaggacacgtcagcgatcttcacggttgtcaccaaaagaatgtctttccatgcccagctgctctcatagtttgaaagtaaatgcatttttccccactttttcagaatgcttatcaagaatatatctttaatgaaaagggatggcttccacaaaacacatcccagagttgggtaagtcacagatgtctgtaatgcaactcctggaatagacaatgaagaactcctaatacgggatctgtgagtcccatgaccgtggagggtgggggaccttcagaaagtcttctaggtttactccatgtacaatcagaagctttttgattcaaaggattcctctttgagaggtccgaaacactttcaaagacagaacttgtaacttctgaaatattttagacatctaaatttgtctgccacaaaagatacctaccttggcccagccagaagtagacttctaggacttcattctaaggacatagttagaggtttctgtgacaatttagtcattgggatgtgcatgatacctcttatgagaaggggctgctccaagctcttttctgtactagcacatgctgagctaatggcaacagatggggtctactgtaatgaaatgtgtggctacgaagcagagagatcttctagtcctacaagagacagagataatccgaaggaaaatcttggggtgcttttagttactctaccacctgagcatatgttgttcttctcctacccacagttagcatatggttccagtagagaatttctgcaatgacttactacagacaacacaacctgtaaaagggaggctgcaggagatgacttagtgggtggtacaaagggattgaaagaatttaaggaccttgggaacagtggtagaaaaagaaggacgattctcaaactttgggagcatcggaatcctctggaggtgtgtgcagtacagactgctggctccatgctggagtctctgactcagaatgtctggggtagagtcagataacttgcatatccttggtgatgctgatgttgagaactcagaccccagctctctagggagggtctggctgggaggagggtggtgttctttgctgagtgctggggcagccatgaggcagatcccaaggatcagtaagcctggacggagtctggagaagttgaatgaaatgaatctccagcccgctataattgacccaggtagtctcatttcatattcacaacatcttttgctgttgtaataaattctgttttacagatgataaaaccgagcctcagaggttgtccaaggccacacagtaagtgtgtctctgcttcagatggccaagatactggagatcaaacccagagaggaccaaggaatgagattttgaggaatcaatctatttgcaattagcctcccccttcacactctcttggctctttgaacctcctttactgatcaccattgattttgtattggaattatttggctgtgacctcattactgcaccgagactttctggagggtagaaggcatgtcagtcttacgtctctacctagcattcagctgaggaggagctggaacaaaacctgtgaagatgggaaagaaagggcttcaggcctgttgtcaaatatgaatgcagaatatgattttttaagaattaaaataaaataaaacaggtttcatgttaaaatgctactgaacatgaagagttttttgatacctaaaaagttccacagacgtgttaagataggctctatcagcagcatttttgtgtaacactgggaaaggttatacaattcaaattagtatttttggcatttgctgatcttcgaatataaacaaaatttctcagcttcctagataatataactaggcaaatactgacagcatttttatgtaaaattttataaattccatcctgtgatggccaacctttgtttctgacacaatccgtggtggtggccagagaggaactaactttctgctagggaaaaggtggtgacaggcatttggatattattttaaactaaaagaatggcccttttaaaggagcattttagatcattccttcttgaaatgattttcaccaggttgagctgtgaagctgttaaaataataagtttgtcaaagattctgaatcagacctctttggccagaagaactttgcatggcaatgtgtgattatgtttcgctctttagcgtggcaagttagcatttccaaatagaattaatgaaattcaggctggaaagcaacttagggtagcgtgtgtacaccctgatctgaaaaaaaccctctgcagctcttctttgactaatgtgctcagtctttccttcgagtatcctttttttggaggcaggctgcctcccaattcaccaataaacttcctaataatcagccctaatttcactggtaatcattaaatgcgcaggaccaaccaataggaaataatcaaaatgaacaacttaacatcagaagttgtcaatactaatcttagcgtttttctttattctagtttctattccattctagtccagtctcctccaaaatttaaaaagttattaattggctactatattacaatgtgtaagatattgaaaaatgagaaagattaataacttaaggtctcagcagagaaggggagtgactgagatacgcctacacccacacagcacctatgatatagacttcaagagggggttatcatgctgtctgcaggggtgatgaggctcagtatacatatagacttcaagagggggttatcatactgtctgaaggggtgatgaggctcagtatacatatagacttcaagagggggttattatactgtctgcaggcatggtgaggctcagtatacatacggacttcaagagggggttatcatactgtctgcaggggtgatgaggctcagtatacatatagacttcaagagggggttatcatgctgtccgcaggggtaatgaggctcagtatacatatagacttcaagagggggttatcatactgtccgcaggggtgatgaggctcagtatacacatagacttcaagagggggttatcatgctgtctgcaggggtgatgaggctcagtttacatatagacttcaagagggggttattatactgtctgcaggcaacatgaggctcagtatacatacagacttcaagaggtggttatcatactgtctgcaggcatgatgaggctcagtatacatacagacttgaagagggcgttatcatactgtccgcaggcatgatgaggctcagtatacatttttatataaactgtctcttttcaatgggcaatgatttcctataggcctctgggcttgggtttccacttttaatcaactatgcctcagtgcatgaaacatatcttaagagaatatttgattttcacattggtggtaaggagggtttcctgttcctccgtcttccccacagacacaagttctactctttcaaccacaaatttcagctttttattgttgttggttaagacttttgatcaacatgttaaggtgaagtcatgtcagcttatgattgaaatagcataagcttgttagtacatgatacagctataagcatcacgacttgaacacagctcaaatttttgtctcaacacctttactatgaaacttaacaagatgtttcactgtttaaaaataaacaccctgataaccttccgcgatgctcactaaatggttagttgtaatcatggtccttagtgtttgacaattaatcaatgttcaatctagaaagttcctccctcccattgtacttaaaccatcttctgcccatcatgaggaaggtgacttctatgtctggttagaaatgggtatggaaaaattctatgcataaacatagtattaaatacctgtagattatttgttagaagcacaaaaatgtgcataatatctcatccttattagtaacctttacaatcgtgactgaattgtcagttgctatgtcattgggaagttcctgctaaaagtggattctataatctttttatctaatagataaaaaatgaaacaattcatttttatgtcttccaaattaaaagaccaatctattttttattttaatgcaactaaactgcttcctttcccctgtcttctgtgctgcttgaaatctcatttctttgaatctccatcactcagtgctctcctaggacccaacgtggaactcagaccatatgttcacctgtatgactacggcattttccatgaaagatgtgtctctgcttcagatggccaggatactgaagatcaaaccacagggaaaaccaaggaatgagatattgggtaatcaatgtatttgtaattagcctctcccttcacacactcttagctctttgaacctcctttactgatcatcatttattttgtattggtattatttaggctgtgaccttattactgcactgggactttctggagagtagaaagcgtgtcattctcatgtttatacctagcattcagctgagtgtgtgacacatagttggctcttattgagaattcagcccttccatcggattggaattcaggaaagcaggggcacatttactctgtgactgactgtgctctatgcttacagaataaatatcagatgtttgttccagcatttgaatactggcttcttaaactgtaccttgtgttacaagcctcatcttgagttattcgaggcagtttcaacttgcaaaaaaaaaaaaaatagaagatgcaattgaagatagcatacagcatcgcaagtaaaattagttcaagatataaactttcttatgattgttcacaagtttgtggcctggagccagtcagatatttcccagtttctcacccgtctacaacctcaggcttggaggaagagctttcacagcctggctcaaggctaggttgtcttcctatgtctgtttcctcctctcctctctccctcaccttctccttggccttcagggtctggactccactggagttgtctcatacccagcctacttacatgtccttgagccctgggtccagccctgctataatcaccgtccatcaggtggcccagcccttcacatccctgggcaggcgctccctgagctcctacatctcatcttccaatttataaccatcagagcccagatgctgggtctctgcaggatctggcctgggttcctgagaccatatactagtttgaggagtggggtgggctgtctggagggtgttagagaacagaactaggtttaagtgatacagagagtcccaaggcaccgtcccgtcgaaaaatgaagtcacatacttagtacagccttgatgcaacccagcaaggcaggccggggaggcagaagacaccagagatgatggcatggaccagagaccagacccgaccctggggatacctgcgacccctcagggcagagctgagggcctctggacgcttgaccaaggataaggagaggctgtctggggttcccaggcccactgatccctccccctggaatgttcttccttccaccttgaagccatcaactctgacagtcgcagttgccagggctcaatccaagcactgccttttctaccttctaagccttgcctcagccccgctactccttccttcatagctccaggcacaagcttctcttagagcacctgtaacacacgatgtttgagtctggtcccacaaggcgttaggaggtaggggggagcatcatcttatttggttgtttgtgctccccactgtgcaggacacagtaggaactcactggatatcgactggatgaaagagcatatggttcttttcaggactctttctagaccagtggttcctaactaggatgactgtgccaccagggaatatttttggttgtcaccgctgggtgagtgttggggacattacaggcatctcatgggtagaggcagccagggctgctgctaaccatcccacaatgctcaggactgcccccaccacaaggcacaccaactgtttcgaggctgagaggtctgctctggatagctgggctccatgaggatctaatctacatgtgtgcttccccagcacctaacctgtgttcagccctgtggcttctcaaacctatgctcctctgctgcatcagaatcagctttggagcttgattaaaatacaaaggcgcaggcccttcccctatacttcgattagccccattctcagtgtgtttcactggtctccagctgatgagaacgcattccaaaggtgagaaccacggccttagcccacggtaggaaattcaatgtggaaaggtagagtacttcttgaatggccatgaagccatgtggctgtctgccgtgtgctatgtgatgtatagactctgaacaacactccccaggctcttcctaacaggatgggaccatggcccccacacacaccagttatggcctttagaccaatggccatcagcttctaacagtcaaccagcaaatgatgggaaataacactaaacttgtgaggggggatctcacaagtagaacataaatatggagcatcttaattttttgaccatgtaattacctgctcagaaattgatggaaattttttaactcatgacaatcttttaattcaacaacacaggcacccccagtaacaagatctccagaactcccagcctctcctgcctgctctctcttgcttaggctaagcagagactgaacagacctaatagctaccccttcaaagagccatattattagcagccaaatcgattatcaagtattaattacacgtaaaaatgcaaaaaattggctctttggagtttgatgcctataattagctcctttctgtggagaacatccttacatcctcgatggcttgaatttatcataaattacctgatctgagtaagtgtgagaatgggaaattatgccaatcatacttttctcgattccacgaagcacacttgcttttgcttcaaaaacattaaattttaaagagatcttctatccgtgaacacctagatcaggagttaaaaactctctgtaaaggatcagagaataaatatttcaggctttgcgggccacacagggtttctgccactttttcttctctcctcctctttctccttctttcaacaaccttttaaaaaatgtaaaacctgttcttacttgaagccatacagaaacgggtcactggcacgatcaacccctgaccgagattctcatctgaagctcagatataggattcaggagggtgtctgtgaactcctgatattttgttccaagttttgtatatttttatatgcacgttatgcatggttttttgtttttattttctgtgctagaggtacagaactttcagcatattctgaggctgggatcctaaactgtctaaaaacatctcaccaaaataagtggtttgagcagcccctgcttggagcagcacgctgctctcctaaatctagagtctgggtttcaggaatcaaatgtatttgcctcctcggggaaacggcagctctgccttgtgtcctcccacaaggccttgggaaactttgtctgtggtttccaaaatcattgtccaaaaagcccatccttttcttccgtgcaggaagattgtcctctttgttgagtgcccaggggtggggaaggaaggggtgtcttcgcccagccactgggtctgctgactccacctggcctttactggagtgacagtaatccagccacagcctctctctctaggtgcagaggttgcagggctaggggggcagcatgagaccctccaagtctgtccatccccttcattcttccacgagggctcatccctttgatttgtagcttctttgaaaaaagggagtggctggcttccttattattcaaaatgttcacaaaagtggcttctcctgtacctgctgcggtgcacatagctgcgctacttagctgtgaaggcgctttctttgctttggcctcctcatccgggaggtgctgctgggaatggtgtggacatcacaggggatctgcagtgacacagggcagctgctcagcgccgggctggtttcttctcagtaaacgttagctgagcagctgctccaccagagacctcccagcccagaggggagaaacatgccaggcgggttaccagcaccccacaggaaaagtgtctcccgcaaatgtgtgagaggaaagaacagaaggtttcacagtagcattggcaattttagtcatttattttttaaaaatcaaaaactaatgtaaaaatattaagacagcgggggaaatgtagaactaaaagtgatgtccacactcttcgctttcccttaaggaaatcactgtgaccatttggtgtttatcattcaagattattttccactcgtattaatgaaccatgtaggtaagattctgttttttaccataacaattcctcaggcaactggcttttacccctcaaaagtttatctctgtctctgttcatgatggtagctacagttattgaatgacttttggtatctcatggtataaatagatcggctgggcacagtggctcacacctataatcccagcactttgggaggccgaggcaggcggatcacctgaggtcgggagttcgagaccagcctgaccaacatggagaatccctgtctctactaaaaatacaaaattagctgggcgtggtggcacatgcctgcaatcccagctacttgggaggctgaggcaggagaattgcttgaacccgggatgcggaggttgcggtgagctgagatcacgccattgcactccagcctgggcaacaagagtgaaactctgtctcaaaaaaaaagaaaatagatcacaattcataattttttaaattaataccctgttaatgaatatccagattatttctaattttttactgtattatgtaatgtttggttcaattttggaggagatatgggctttagaggaatcattctaggaagataaaatagcagagataaataatttcaaatcaacaaagcagccaaccttgactgggtgcctgctttcttccatacgcaatgctaagtcctgggataaactgatgagagtacctggcttgtgacctttagaaggtcaccgtccagcaaggtaaacagacattatatttgatgtgagtaaccacgatatcatcagtatgtaactagcagtgtgaagaatttgggaacccatcttctttggaagtgacatctagatatacaacagaaaacaaatataggctgaaatggatgaaaattttactcttcatctgttttagtaaaatatttccttaagttgtaattctgtaaatgtagatatcagttattttccttcacacttacagcagcaagtcatgggtggtaacttaaaaaataaggacacggaacataataaacatgtttccagcaaaaaagcagctcatgcaatgtaaatggaaagtattaaaaatgcgtacttttagatgcaaagggcaaggcttaaagtacaggcacaggtttgggctaagttccaggtgaacagcctgtgcaaataccatccacgcacatccgtgcaggggtggggtctgcaggctccaaccaaggacaggacctggcagggagccatggcattctgtggcaaatgttaattttggcatataattctccatttttactaagcctggcatcctcagccagtgcaatatgtctactaaaactgtggctggctcatggtggaccaagggcaaatcttgttaatggccttttactcaaccacattctctgtgctaagtgcttcctgagatctggccacaggacagcccaggtggattgctgcaaatcctgggccatccctcaccagaggtaccactcctgcctcttgtagttccacggcaggtggaaatgcagttctgtccttgtcgttctgtgcaggtggaaatgtgtgacgtttgcacgatactcaaaagtggactgaagcagggcttcttcccccaccagcctgatgcattcaagtcccttacaagaggcatttccactgtcatctttttctgacatctgacccggagggcaaagctgaggctgacgttcgataagctctggcctggaaacccaatggcattggctgggctgggtttccaggctgctttggagcagcaactccattttattttcaattcccccttttagaactggagtgtctataattgttactatgtcgtcccatcactgcatgttgggagcagatatgttgcttccttattttcacaggttcacagacggagagaagttcttccccaggagctgtacttaacagattactcatccagctcggatttggatgattcagattttggacttttgagctgaagagatttaagactttgagatgatgctgtaatgggatgaaacctttggggactgtggatggaatgaaagtatgtggcatgaatgtgactctttggaggccagagggtggactgtggtaggccagagaacagcccctccaagaggtctataacttaattcttggagtctgtgaacaggttactttatatggaaaaaagaaaaaaaaaagacgttgcagatggaattaaggttacaatgtttaaaatagggagactttccctattttgtccctggaaaatctccctattttattctctgctttccctggctggagtcagagaggtgcagcagaagggatggcagagatcccaagagtaaaggttcagctcccagctgctagcttcaacatatggggtagccacaggcaaaggggagggagaggccattaggagtgcaggagctgagggcagctctcaactggccaccaccaagcaagtggagacctcagtctcatggccataaggaacaaggttctgctaacaacctgcagtagcttggattcttccccagagctgctagtaaggagaacgatcccaccagcaccttgattttaaaccagtgagtccagtgtctgaagttctggcccagagaagctgtgggctaatgtattttgtttttttaagtcatggaatttgtggcaatttgttacagcagcaagaggaaactcacagggaggctgcagctcgttttgctccagggtaaacggattcttctcagcaccgtctccgatgcctcatgtcccattccctcccaggaaaactgctcagcctgcagtgggcacatgcaagtttcaagaagagttttctagataatcaaacaactggattgctttgctcaagaccaaaatgccatatatataatatatatatttatatatattatatataaatatatatattatatataaaatatataaatatatattatatatatacaatatatataatatatattatatattatattaagtatataatatatataatatatataatatataaatatataatacataaatatatattacatatataaatatatataatatataatacataaatatatatattatatataatatataaatatatataatatataatatataaatatatataatatataatatataaatatatattatatataaataaaaaatataaatatatattatatataaataaaatatatattttatatataaataaaatatatatattatatataaataaaatatatatattatatataatatatatttatatatattatatataaaatatacatatattatatattatatattttatatataatatataatatatattatatatttatatattatatataaatatatattatatattatatattatataaaaatataaatatataaatatatattatataaaaatatataatatatattatatatataaatatatataatatatatatatgcatcaaaattcttcctcggagcatgtggaagggcgtgaggtggtggcatagaaaatacctgctctcaatgccgtgaggccaggccactgttcgatgggactcagggcatgccaaggccctctgcatgagcaacactgatgtgatgttgggatgacgcactttctgaggctgaactacgtgcttcaatatattctgccctatctctgatctcatcagctacaagaatgccaccaaatttgcagccatcagcttggtccagactgctcttttgcctggttggtatcttccacttctgccagaaaagtcccctgaaaactggagttttcagagcttgcagagaaccaatagtgctacagttggcattctgtatctgtctaggacatgagtacactggattataagagagagaaatgaggcagcttcctagccctgcttaagtgaagtctgcagtgcagcctcgttattttaaatgaattcccataacattatgtgaagcaccaaccataagtaccaggcagtattacccgcattaggattagccacacctccataaacttttattggttgcaaataatgtaaggttaaatttacttgaaaagctcttgacttctctctctccatatgtgttttgaaagctggtctcttatcacagccaagtcagaataattcccaaaaaaacaagtttccctaatttttttttaaagattagcacagtcttgctgttcgaattactatgcaccttactgtcttctcccaaggaaggcaatttctttataaatcaggacaatgatggcttggtaattgctttgctgagctgcagagacagaatgcttcagtggctaaagaccaactacctattggggctggccgcgaacaccactgttgttctgtgcccaaagcggtggttgctaggttcataccacaccccccccatccacccataaacgtaagccatcagaaagggacggagggcccctcttttgatgacgattaaacactgcaccgttttaagactgcctggatccgtgccttctggagttagccatgcatcagggaacattgttccagagaagcccagagcggaaccagaaatacctgaattaaaagacaccctcttgctgtcaagtactacctagggttttagctacatgattccaattaaaactgatggtcgccacagagttaactgctctatgaaatgtctgctgaaagtttcccattgggctaaattacaaggaaatcagagggaagaaaggtgtggatgctgtgtggctaaaaccattaactgtgagcctaattgtgcgggtggccctttgtgctccacaaacactcacgtgccgctcacagttgttctttcctaacttgcagtacttggggaatgagctgtactcactaggcattgattttttcatgaccggacgacgtctcaagcttggagtaacgccatatggtccatcccccgggtcagtgcccgccctccctgtattctaccaactcccacaatgttttactctggcacattcatggtaggctcagaaaatcagggtgtactatatattgaaagccgcccatatctaaccttaattctggcaccttgacttcccatcaagaggacctctgttaagtccacccaccacacgccactgcagcaagcattaccatgcttgctaaatgatttgccagccatggccagttacaaagttacaaacacagcgaaaagaaaatgtcatgggtcaaaacacaaattagattaaaaaatgaatactagctagttgttttcttctttctttgttaaacaaaattatttctgctcaaccaggtgtgatttatatgacaagtcacagaacctaagccttaaaatgtatataataaatgaatatgctaggaaacattgcagaagagagatgcaatattcacttcaccaagcagttggcttccaggaaaataaataccatgtgactaaataaataatgagcaataccaatgtgatccaattccttgcattttgagtcccctatcttctaagaagtaggggaacagaacttgactaataagggtttatagattattggctacctggcttttaaatgtcagactgtgggcgttaagattttcaagatctggcattatgttctggattattaacagctattattaaaacagcctttccggctgggcacagtggctcacgcctgcaatcccagcactttgggaggccaaggctggcggataacgaggtcaggagatcgagaccatcctggctaacatggtgaaatcccgtctctactaaaaaaataaaaaaaattagccaggcgtggtggcgggcgcctgtagtcccagctactcgggaggctgaggcaggagaatggcatgaacccgggaggcggagcttgcagtgagctgagatggcaccattgcactccagcctgggcgatagagcgagactgcgtctcaaaaaaaaaaacaaaaaacttccaactttcatttcaattcatcccctaattccacatatgcagtcatgtaatcttttaatttatttacttgcaggatattttaacaaatcgtacttcaaagacttattaaagctgagaataaatgtgatttttaaaagctcacttatctagatggtaaagttttccttgaggtctatttcttgtttttgtgattgctttgatcactgactgatagcttactgaataccaataaccatcatcaaaaaactgaaagaggcaaagaactgcatatactctcacatactcttgggtcttaaccctttgttttgtgcaattctccagcccctctaaaatattgttttattgtggggagtcaccccagtatttctgtaagctgactgctcactggggggctaagtacttagaagagggagtcactcagtagggaagaaagggcagaagccgctgttattctgtggggtccaggcctaccacctgcgggtatccggccctctctgctttttatggtctttgttatagactgaatgtttgtgtcctccaacaaatcatattttgagattctaacccccatgtcacagtgttactgaggactttgggagatgattaggtcataaggatgagaaccttcttgaatgaaatcaatgcccttataaaaggggactccgagactctttgccctctttccgctgtgtgaagacacaggagttggctgtctgcaacccaggagagagtcctcactagaacccaaccgtgaaggcaccctgatcttagacttccagctcccagaatgtgagaaatacatttctgctgtttgtaagctatcttgtctctcgtatttcactatggcaggccagactgactaagacagtcttcttacatattttccctggaaaccaactccttaatttgtggcaaaaatgctaatagaaaaggagactccaagagctcttggatcaaaacattccttggatcaaaatagcttaatccccataagtttaaattggaaggaagtgattgaaaataaaacccacccttcctataacctcttagaaatttacccatctctgctaactgctatctcataaactgagaagttttgacaacttatttagtagttttttacttgaggcaaagaacaagacaaatgttagaaaatccggactccagttaactcggccagagattactgtatagctctagctaggtgaatactgtattaaaaacagacaaaccatgtttttggctaatggttacttaagactgccaagaagtctaaggaccactcgccttgtttcagaatgaaaatatcgcatatggaggtaatgggagatggggataagaaagattataagaacacatatatatttcatataagaaaaaatatacagaaaacagtaaaacttaagattatttagcctttttttttcctgaaagggaaatattagcacagtcttgctgtttaaattattatgcaccttactgtcttctcccagtaactagtaatttaatcttaattactaaaatatattcttaaatttcttttttctttttcttttttttgagacgcagtttcactcttgttgcccaggctggagtgcaatgatgcgatcttggctcactgcaacctctgcctcgcgggttcaagcaattctccaacctcagcctcccaagcagctgggattacaggcatgcaccaccacgcctggctaattttgtattcttagtagtgataaggtttctccatgttggtcaggctggttccgaattcctggcctcaggtgattcacctgccttggcctcccaaagtgttgggattacaggcatgagccaccacgcctggcctattcttaaatttctgaaagaaatttctggaaggcttattaaaagaaagcaggagttatttctgtaaagagaagtaccaatgaggtcttgcaagtttatgcacaggtcttaatcactagttaggaataatgttggaaaatgcgttaacagggcagctcgaagattctgcattttaaaagcaaggctgccatagtaccgatatagtctgtctgcttccattattgtcatgattgcacttttccccttcactgtggtagggagaattctaaagacatctctccaagattcctaccctttggtcgctcaaccaaatactaactggggaaggggctttgcaggtggaatcaaggttgctaatcagctgaccttaggatagggaaatgatcctggattatcctgctgggctcagtgtaatcacaggaactcttcaaatcagaagaggaaggcacaagggtcagactgagagatgtggctgaggagggagcaggagaaagggggaaagatagaggtagtggggctactcaggtggctttaaggatgaaggaagggagcaatgagccaaggaatatcatgccctctagaatctgagaacaactcctggctgacaccccacaaggaaatgcagcccttagtctacttcatgggtctgaatttagccagcaacctgaacgatcctggatacaggctcttctgtgcaaaaagagcccaatggccaatgccttgatttcagactcgagaggctccaaacagagaaaccagccaagacccctgcatttctagagtgcaggactctgcagtaatcaattagtaatgttctcagccattacgtttgtggtaatttgttatggtagcaatggaaaactactatattcacataagataaaacaaaaggaaacccaccatagtaattttcacaaatgttcattttaacatttctgctaacgtatttcaaaagttttagataaacatcgtttcttcagatgggggcatttcacaggctctgaatgacaagacgagatgtagtcattaagatttttagatgtctcttgttgcaggaagaacagtaagctaaatgagtttctcaccaactctaggtagcacctaagaatgacttttcttgctttactactaccagatggcttgcacacaatatgagtgtaggataatggcaccactgggtgcacaatttccttttactgcttcagttgtgaaaggagtaatgcttcaaaaatccaagaattataaagctgcacagaaaggtcaaatagcaatgacactttgaggagccacagagcatcattaaaaacaggtcacaagttggccatgaagagtttagttccattgtctatcttcactgcgctaagtgctgcaatcaaaggacttttaatcttttacagtacatgtgtcagtcttttgagcaagtgttaaggtctgatttaaaaattgtgcacttaaccagcttggtggccaccctgggaataactagaaaacaaaagagaaggctcgtgccctccaccatcagcccagggcacatttgtcattcaggttttactgcttttcgtaaataataatggttcttagaactctggcacaaactatatataatgacttcatgggggaaaatgtcaaggcaacagtactccatagaaataatctagaaaacagaatctagaaactcaaggtttttctaaagttcatcttaatataattactcttattatccatcattttatatgtgctgaaatgaaaaggttttagagatctgtcaattagtaaagaaaaaagttacagaagaaacagtggattcaacttttgacaaaacacatgcagagagaggatccttctatatcacacaaatgtacatcggtagattcagtgattgaatgacttcatttaatccaataatttgctaaaattctctaagacatacactgtattattttaatttgaatcacaaatactcatcatggaatatttttacagactatgctgaaaatcaaatacatagtgttaggtgattccaactccaaagaaaattaggatcgctgaagtctctgagtagtggtttcccatctttattttccacatggacacacctcaaagatagtgtgcccatgactgacactctcctacatgcactggccccttaccatgcagcgagatgcagtgggctgtgggttacatgaagttgcaaacaagctagccacaactttgcccttgctctccatctggttcatatcatggtggtaggtggagatatccacttctaaattagcattggctactgctatcatctgaatatctgtgtccctcctaaaatttatatgttgaaacctaacccccaaggtgatggtattaagtgagacactcatgaataggatgagtggccttataaaagatgcctgagggagtctgttagcctcttccaccatctgaggatgcaggaaggtattatctgtgaagcagaaagcagccctcagcagatcttgaagccgctgatgccttgatcttggacttcccagcctctagaactgtcagaaatacatttctgttgtttgtgaattacctggtctaagctgttttgttacagtagactgaacagagactgccagcctttttagcttgttttttgtttgttttttagttctgaattttcttcatcttagaggtcatgaattaaattagtgatgaataaaatagaaataataagagtgaaaaaggactttataaagtatatttgttgccacagtgatcaagagacacgaaagaagataaaatgaaaaaggcaagaatgaaaaaaggagataaaaatgaaatggggaaaaagaacaatggtgctaactggggcctattttgagggttttcttaatgcttatgttgttatgcaccagcagtgctacgcttgtggaatagatatgtgtgtcactcatctctgactctcctctttcccacacacctacattcaatcaggcagcatatcaagtcagctctaacttcaaagcatttccagaattgttctctaaggccaccatgtatctcttatatgttctctctgcttctgtcctcatcttctctaccttctagggaagtctcatgtagcagctgcagggattcttcaaaaatatatatcgaagcacaagtcctccagtccagggtcatttcactgagtaaaactcaaaggcacatgcctgaatactctctcctcttctaactcctactcatcattcaagtcttttccttaggagggctttccctgatcccctgaccaggctaaattcattggttctatgttcattcaaggctctctttcacaattcccaccccactgatgttacctgcttactgcctccttcctgcaaagcccatgaaaatagggcctgtgcctttcttgtcactcatatatcaccagcagctagtacagtgtctggcatcaagtaggcactcaataaatagttgttgaattgaaaagacatactattgtatctctaatccaattccataaataacatacttattccagattggtctggaggagctgaatgacagaaaagccatatgaggaattaatccattcattagttcatttcttatttattaatataagacatcccaattttattgggagcatgttgatctaaaggcaggaattttattaattttcctattcagagtccggaaatttgatttttttcatgccagtttagtcaagaagctgtatctagtcgtctagagcaaattatgatttggaaaatactataaatagtacatacaccccaacgtgtccaggaatttccttgttttttccttgcttgttatattcaagaacaaggttaatcctcataaacttaatagggtaatactctaagccttggtttactatttccatgtagttgtagataagctcttacaaaataacttgggaagaagacaactagcagcaggtctaacttgggtgtagggaggaagaatgcttttggaaaagaaagcaggtgactgatgactgccaggtcttcttgcaaacatgcaaaacacagacctcctagcaaacaaaacaataatgtttactagcaggcaaatccttatttatggaatgttttcttcagaatattcctgatgtctaggagtgctcatgggaaatatttaagttaggtatccatctggatatgaaattagaggtatttaatgaccaaaatgaccctgtattagctttttgctactgccacaagttacctctaatttaccagactaaagtaacataaatttattaccttacagttctctcttattacaggttgaaagtccagtatgggtctccagagctaacatcaaggtatcagcagggctgcattactttttggaggtgctaggggaaaatctgtttccttgcttattcagcttacttgcagaatttagtttgttatggttgtaggactgaagtcctgtttcctgactggttgtcagctgaggatctttcccagcttctagcaactgtgtgtatttcttggcgtgtggcctcctttctccatcctcaaagccagccgtgatctctcattctgctgcatctccctgactccagccagagaacattctctgcttttaagggctcatgtgattagactgggcccactgggaaaatcacaacaatctccccttctcatggttcttaaccctattcacgtctgcaaagtgtcttttgccaggtaacagtctcaggttgctgggattaggatgtagacatctttgggggccactattctgtcaatcccaggctccctatttgtaagtgttgtaaatgcacaccattctgcgaggacacgtgttaaactgggtcagtgcgtgtcctgacacagcaggaaggacctggtagtggcactggtggtgccatcctctccctgcccaacctgtgccctgtggttacctgtgtctctgatattattagaaaagcttgataccttgtcgggtctgtgattggtgtgagttcggctcaatattctaaaccttgttacatcacacagatttaatgggtggtccagattctgttctatttgtagttactgattaattattttttctagaaaagttagctttgctaggagctacacaacaggaccaaggttggtgtcttggcttataatttaggtcatgagagctctgctccatacatatctccagtggggagtgaatgaagtggtactgctgcattgattagtcatgaggaggttccttcctgcatgtccatgcagaactaaagcattggaatcatctccccaagaagctggcactgagtattctttccctgtcttcagaggagtcacagagtaaaaggaaacttttttttttttttcttttctgaggctggagtaaaatggcacgatcttggctcaatgcaacctctgcctccgggattcaagtgattcccatgcttcagcctcctgagtagctgggattacagctgcacaccaccatgccaggctaatttttgtatttttactagagacagtgttttgctatgttgcccaggctggtctcaaactcctggcctcaagtgatccactcacctcggcctcccaaagtgctgggattacaggcatgagcgaccacacccggccagaaaccatttttgatctggaaaccaaaagagggagaaagcatcttgttacccaagaagcctgtctgcatcccagcatactgcgtgttagagttcaggactgtgtgaaagcacgctgacagtggctggatttcatttcacatttgttttctcacacctagaacgggaccagctgatgaatccctgtcttacttgaatctttgctcacctccctggggtaaccactgcatcatcatgggtgtgatgtttatggaatcttggatgatagaagagcctgggttgaaagggagaaagaaaaacaaatcccattttctctctgtttgctgctagacctcgtgtcctgctggccagctgctcgtgcagctctgctccctgagtgctgagtgcttgcgacctgcctggctgtgtggcttcctggtgctccacaggaatgcaacagctgcctgaaggcatctgctaggttcctcctgctgctgtaacaaattaacacaaacttaggggcataaactgccgatttattcttatacatctggagaacagaagtcagcaatgggcccacaggctgaaatcaaggtgttggctgtgttccttctgggggctccaggggagaatgtttccctgcctttcccagcttctacatgcacatcttggctcatggctgcttcctctgtcttcagagccaggggagactttcttatgtggtatcactctgatactcttctgcctccctctttcacatgtaagaatccttgagattatagggatccacgcaaataatccagcataatcgccctattttaaggtcaggtgttagcaaccttaattccatctgcaaccttaattttcccttgccatgtaatttaaggtcttcacaggtttttggtgattagcacagggacatcattgggggtctggcctaccactgaaggtcagactattttttcattacagttgggcatacattggtacccaaagaaaacatgacaatctcctgcctccttcaacctgtccagggcaaaggaacaggttcaggaagtgtattcacaagactgtcctcaaagtactcctaggctcttcttttaataattttatctcaaaaggaaaaacaggtaaaaacattatctggtcaatttattggtcttctattgattaattggaatgcaatgctatctgattacattcaaacgattgtttttgcaagccaagggctaaagttgttttcaaacactatgtatgctaataaagttcaagcttacctgtaataatctaataataatgattctctataactacctattgagaagacatctgtatctatatttaccaatgctaccagttcctactgtgatgtcaaacacatgggaagagagggaagaaggagagcccattcacccccagctacaaaacagttactgaggccattcaggatgtgcaatggaaagaaggatctgggaaaacacagtctttaccaaaagttcatccaatgtataggagaagccatctgtgtatagtattggagagaaaatgtacacgtatttaagttgttatattctagatttattaaaaaaacaatttatataaatatatatggagaataattaactggtttggctctgggttggaaggtaagagacaattactaatactatttttattccttttgtattgtctgattgctttaaaaattatttttatttttatttttatttttttgagacagggtctcattctgttgcccaggctggaatgcagtggcataatcagggctcaatgcagcctctacctcccaggctcaagcgatcctctgacctcagacttccaagtagctggaactacaggtgcatgtcactgaacccaactaattttttattttttgtagagacagggtctccctatgttgcctgggctggtcttgagctcttggactcaagcaatccttttgtcttggcctcccaaagtgctgggattacaggcatgggacatcatgcccagctgtttgattactttttaaaacaaatgcatataagaccgtcatttttttttttaattttgtaaattgttggtgaacacaataatagaaaaggtcagagtaattagtgacaattgcatgcttaaagtgattggctttacctgttttctatgtggccagagtaccctcctgatggctcttggtgaataaaggagccaaagctaaaagttagaggctccagtctttggaaggcgtcttcagtaaaaatatcctttggggatgcttagttattctaagaatagttatagatctaataaatattgcctttgaacggttaagtttggatatgcaagaaggccagctgtgagaagaacaggcagccgtgcaagctggcaaagggagaaaaaactgtttagggataggagaaaacagatggatgccttaggccagctgtgtctgcactcaggagcccaggttggcagcagacagcccttgaaggttctgcatcttcatctatggccaattttggtctgcagatgaatatgaatggctgcttgtgattgatttctttgcctgttgctatagtttgaaggtgttctccaaattcatgtgttggaaacttaatcccaatgtaacagtgttgagaagtgggaacttgaggaggcgattagatcctgagggctctcaatggattaacatttttatgggagtgggttccttattgcaagagtgagtttgttataaaactgagcctggcctccactcaccctctggctctctcttgcccttccaccttctgccctcaaccatgatgcagcaagaaggccctcaccatatgccagccccctgaccttgtacttcccagcctccagatacgtaagaaataaatctctgttctttataaattacccagactgtggtattctgttatagcagcataaaatggactaagacacctgtcaaatagatgataacttgctcaaatgaaaaggagacagaaggactaaatgatgccaatactaatgtactctagccacagaaagcaaataaaattaaaagccagcaagagagctgcttcctagtgcctgcttcttctttagccctattccacagagaaattagaaacggatcagataatattcttatctcaaacatgttaaaggaatttcaagcaagagagtgtgaagttgaatgcaagggggattcttgaagagccagggagaagggtgtgaacagtgagaggaacacaccaggaatacttccatacccctaccttggcaggtcctcatttttatagttcacttataagaaatagaagtattttgttttccataagacaggctgtggtactggaaaaggtttggtgtcaaatttaaactctttttttttttttttttttgtttgaggcagagtttcgctctgtcacccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaaaatttaaactcttttattagccaactggtcttgggcaacacacttaacatcataccctcagtttattcatctataaagtgggctgatgttttagaaggattagatgaggcagtgtgtgatgcatgcaggagccagacctatttcctccttcccccttgacttctgctcactcaggcatatgtgcccgagcaaagggcagaggaacccatttaacaaagagaaaataagaacaatatgtgtaaagcacctaatgtcatgcacagagggctatcctattattcagctaataccccattagctctgggaaaggtgaacctcttttcctagctttattttcctagaaactctccatgacttcccctacccttcctatacacttgcacccctgtactagtttgctagagctgctgtaaaacattaccacaagctgggtggcttaagcaacagaaatgtattgtttcacagttcaagatcaaggtgtctgcagggttggttctttccaagggttgtgaaaaaaaactcgttctgggcctctctcttagcttctggtggtttgctggcagtctttgatgctctattggcttgtaggagcaggaccctgatctctgccttcatcttcacgtggatgttctccctgggagtgtgtgtctttgtgtccaaatttcccatttttgtaatgatcagtcacattggattggagcccatcctaatgacttcatctaaactaactttatcagcaatgaacttatttccaaataaggtcacattcttcagtagttggggttaggactgcaaaatgtgaatcttggagggaggtataattttactcaaaacagcccctaataaggagagtgaatcatttgactggtgggtgatgaagctctggcattggctgagatttttgcacttgttggagctaagctataatacaggaccagggactgtgggagtcagtgatgttgggtgggtttgtcagcttttcaaatcccaggttttccataggggcagtcgccaggtctacaccagctaggggtttctaccataggggcttgtccccaggtctgcaccagctaggggttcctaccataggggcagtccccaggtctacaccagctaggggtttctaccataggggcttgtccccaggtctgcaccagctaggggtttctaccataggggcagtccccaggtctgcaccagctaggggtttctaccataggggcagtccccaggtctgcaccagctaggggtttctatgagcagatccttagtctgccacttggcgggttagaaagtcatgctgtcagcccagtgttgtcaccagtaaacagactatttaagttccatttgtctgttttcattgtcttatttttcaattagtcctaaacttgggagaagaaaagggtgcatttattgggcccctcagtcctaaaatacggattttaaggaggcatcaaggaggcatcagggaggcaacggagggtcggggagctcgggaaggtttgggaagtggcttgagctcccactgcctccggtccacctgcaggctacccgaccagagcctggtctccccacttggactcacctgtgcttcctctgaggatctgtcacatgctctccttgtctcctggggcacaaagggctgagtgagtcagggtaagggttactgtgaccaccagcagaggagatgtcaaggccttgggggtctaccttttggtccacagaaatggaagcagagaatgaggtcttaggggacaacaggtatcctttgagttggtgggaagaagctgtatttctctcaagggaccgccgtctcaccccttttctggaggaagggcctccacccaagctgagatgatctaggagacaaatgttgttttacggagtgaggttcctagctcctgttggtggacacattttcctaaggaaatagatgtgtgtaggatgctatgcccaagatgcataagacgacccagtgctcagcccctgagtctccccttatcgttcccaacagctcccaagacagactttcattacaattgcacgatggctgcctcagcagagacagtggtcttgagccagcagccatccgtttctgattggtcagaccctatgccaagcaatttatgtgcatgactgcagggccaggaatgggtgagggatgtgaggctgtcacctcggtgcaacatttaagggggtgctgaaataacttactaattatgataaacaacgtacacatttttataataaaatatatattatataaaattaccatcttaaccatttttaaacgttcagtaggactaagtacattcacattgttgtgccgaagaatattttaatgcaatattttttcatctaaatcaaagcaaaaaaatacaggatgaaaatattaccaaaaatttaaactaaaggtgggatctggccctgcacagctcagcctcccttgcctccccctgtcccagccctacatgactggccaatccctctttacagagggagaaactgaggctcagagaggctacctcagtggcccaagattacacaacctgtagtttctattcagatgcagatgaggatgcctgctcctctgagcttggattttacacctgtccatatcacactcatctcaaagacagtggcaactaactgaggttcctagagcaacacctaggacagagtctaggatctgcaaatggggccagtgctatcatgggtcctctcatccttctgccagctccaccctcttctcctccttgtccctgccccacctctctaatcctctctccaccctgtgggaatggctgcatttgtatagcaagaggagccccgtgtctcttccaatcacacttccatggttccacgcagtctacgaaaatcaagacacctcctccaaatgacgctccttcacagacagtcttaacaatcagctcccaataggcctttcccctctctgtccctccctaccaaccgcgccctggctggccacactgagccacctgtctgtccccagacatgcatcatcttcctcctacaggtggatcttctggcctggagcatctctctgcgccttcaccggcaaactctccttcttcccccggacagactctggggtgggttcctagagttcttcaggtggagtccatggttccatccccaggagctctctggcagtttgccatggactgttttaatgacattaagtatccccatgatgcaccacagttcagatttcctcctcttctgttaaaacacaactgtcacttcctcatctttgttcctatggtgcctagcaaagtcctgggcacatactagaaattcaagatatgtttgtgtgcaataagagatgtgatccattttatctaagctgttgatttaacactgggccaacaaggagaggatgagatggctacggctgctccaattatctaggggagggggcagactggctgcagagttcagtgctgacaggctgaccacaaggcagcagcatcatgggaaaagcattccgtccagattcagaaagcccagcttcgaattttggtttgtggctttctaccaagggctccagggtaaactgctaaacctctctaagcttcagttttttcttatttaaaattggaaaaaaagacataatatatcatttatgatgctatcctgagaattacgtgatgattagaggtattaaagagttatcttgtccacaaagcactagagtgatattatttattgatttcttaacggtgctgataagcacagtctaatggcttccttcagatgaggtggttgaggaattcagaatcataaaaaccaagggcaacatgagcacatcgtgaggacaaaatgtactaagcaagtcagtgaggccacccaaaggaaaatatattctgtttgataaaacaaattgatgcggtggtttcatttagcagaattatcagcaacacacacactggaaaacaagcagttacatggctctacccaagaaattaatctcaacatgtggaaactgggaaggataaatgtgaagttagttatctctccaactgggaagattttatgaacaaccaggagagtgaaaagtttccttgcttggtgctgattagtacaggacagttattaggcagctggcacagcagaaaaagaagggccattcatcaattcagtcattcactcagtcattcaggtaggagctatttattcaggatctacaaggtgccagatgttgttttggggaaagacaaaactgatactgatcaaagacatgatcgtcatgtacgtgagaatgtcacttgtgaagtgatgggccttaaatacccaagcacacaggcaagaatatccctccaaattgtgagaagttctggatcaaaagcccagaatgctttgacaaggccatagagaaggccgaatatatacggaatgaacgtgtcaaggagtgtctcttacaacaagagacatttaagttgggatacaaaggtggaaagtcctccaggtgttggtagtcacatgtaaaggtcctgaggtagaaaagacctcaacgtatagaacaacggaaaagaggctagtattgcaaacatggtgaatgaagagcagaggggccccacatgaggctggagacttgcaggcccaggccagctatgtccacacagctgagacgggctgataccagttctgagatgcttaaaataaaatggtgaaatctgtgtagagcctttctcctaaggactcaagaagagtgatacaaagacagatggccataataattcagcagttgaaaaaaaaaaaaaaaactttttcagaatgaggcgacaacatgaaacgaaggtaatgtgagaaaaagagaataggcccagataatgtaatggaggtgaacatacagaaaaaaaaggaagagctgtgaaaagcagttggcggttttcaaaaagtgatacagagttaccatacaatccatcaattctgcttctaggtatatacccaaaataattgaaatgggtatgtaaacaaatacaatagccgaagagtgaacacagctcacatgtccatcaatggataagtggatacacaaaatgtgctatatccatgcaggggaatattattcagccacataaaggactgaagttctaaaacatgctacaacaatgatgaaccttgaacacatcatgctaagtgaaggaagccagtcataaaagtcatctattgtaggatcctatttatatgaaatatgcagaagagatagattcatagagaaagagcacagactggtaattgccagggcctgggcaaggcagaatgggagtaactgcttaatgaatatggggttttcttttagggtgatgaaaatattttggaactaggtagatgtcattttcaacacactttgaacgtaccaaatgctgccgagttgttcacttttaaatggctaatttgatgttatgtaaatttattctgaattagtttgaatgaaagggatagaaaggataggggaggaaatgcctgggaggtggagggtcataatctggtcataacagaaggtgttgccgggtggaagggctcgtttctgctgctagttcgatctgcctgcaggcaggtgcatctgggcttggtggtctatggcactccttggcctttgtcttcacctgaattaaagtcttcatagctcagtaagttttaaagacagtggagggagcttccaggtccagtgaggtgagaagtgaggggagccctttctccagcagcgtccctgcctcatggtgctttggtgctgtctttctgggctgctgtccccttctgtccccgtgggagtgggaagctgctcagacaggcagctctaccttcccaaggcctctgtgttagctctggggatcccggctgggtgcttgggaggaaacaggaggctattctgcctcaatgatttcccctcaaacaggaatgctccctgggaaatcctaagaagccctggcattggtttctttgtgagcctgttaccgcaggagctggcagaggatgctctgcttcatctgactcttaatctatttcagctgcttaggagtgacaggggtcaaggacaaatgacatttaatcatgtgtggtagccagtgctgcctgcagaggagaaatcagtaaagttcctttgtgttctaggaagaaactcagcgctgcttccgtgcacattaaggagaaacgctgcccttcaagccccatcaggttctgagcaatgcgacaggccacacaccacgcctcctggcaggcctcaaaaggacacgatgcttttgcttacctgaaaccattattttttgcagtaagcttcatttcctccaaccacctgactctaacttgtgcaaaatagctccgtgagcagtcagcacccatcacggtgacgctttcctttggcagaaccctcatgtgtttatataaattagtccacaattggcaattacattgttgttccaaaataagggcaggcaacatgtaaccccgggaagaacaatggtctggacacggaagtccagacaggactattatggaaaattatgggggatgattcatcagctggcctctccctgggcacggccatcctcacatacaatctttgtgctaacgcagctactttctggtaataagttaccataagagaagtgtaattagctgttgggattcattagctccagtcagtgcatcactggtacaacatcttccttgccagtttactgcttgttaatggggagcgatgatgtatttgtacctctacggaaagacagtgaaggacgcaggactaatctgaagtcctggcggtctgtccttttatgtagcagactgaaaaactgaaaatgagtgtatgacacagaggaagagcccagggtcctaaaaagccagtgtggaaggctatcagcccattcacacatattattactaaatattgcttcttcggttaaacctgttggaggcaagaacatgctgaccaagcatgaaacctggacagggctgtcttccctttagcttttccctgctttagaaaattttgtagtgggtacttctagaagcttctgtcagtttagaacaagaacttacaagacttaaggagtaatgacttttactttcaattgcttctcaattctgtttccagaataagcaattggctttctgtgacacaatgaagatcccatcccagagaggcagacaggggccccacggggctgtgcaggaaggcaagtgctaattctctctgctcaccccaaaggcacctctgcttcctatgagacccccacactactgttgagtcagtgttcagagaccccacctctcactcttccatagcacagctgcacagggcaatggaaaagaacccagggaaccagacctcccgctgagcctccaccgcccccgcctactcctgcagtgattgtcaaacatccctgagtaaatccggtggacttctctactggcccgcacagtgacgggacaaagtcgttatcctaggaaagggggccagagagcatagaatggcacatggagacttttctactcacttacttgaaatagtcttggtcaattagagggaaactaaatttgatttcaaatattcttggttaattaaggaccaaccagactcaagaaaaagaggatgtggggccagcagaatgtggagaagcgcagtgcagcacagatagcatccagctctgcatgctgacatcaggtggtggcaggtggtgaggcctctgaactgctgccttctttttttttttttttttttttttttttgacggggagttttgctcttgtcgcccaggctggagtgcagtagcatgatctcggctcactgcaacctctgcctctgggttcaagcaattctcctgcctcagactcctgagtagctgggattacaggtgcccgccagctcacccggctaattttttatttttagtagagatggggtttcaccatgttggtcaggctggtctggaactcctgacctcaggtgatccacccgccttggcctctcaaagtgctgagatgacaggcgtgagccaccgcgtccagcctgaactgctgccttctgagtgcctttcatgcctctcattgctgatgttttccttcctccaacaggatcacatctacaagctggagatcttcacttaaggttcatcaacaggggcatggccccacgtggactctgcttgttctgtgagctgtactaactcacgggttgtttggcccaactttggtaaatgtcagttttatttattttcaaataatgccactttgaaatgggaaagaataaacagcatgaaaatcgatgtgttacagtgctggagaggctgggtacgtaagcagtacatgaaagcgtttggtgtgctctttcttcttcaatttatggttaatagatttgtttgcttctcctccagggaagttacttcttatgcaatgtaatgtaatttgggaggcagcaggaagaaaaattacatttttaatgtcaagaagttatgaaggatttaaagaatgaaccagctttttatttatcagggagctaataccctgtactaatgttttatagaaatatctattaaacatcattttaaaccaattgataattcactaaactttttcattgaatttcttttaaagtgagtaatttgttcatattaatggaaaaatccaaatattcatgtcttcataggaataatgactattcattcacgctgaaaagataaattaaatatttgcttgtccttttaaaagaagcccatatttgcaaccaaattacaggatacataatttaaaacaaatctcagttggagtgtgcaaattttcataattaagtagatcaaagtttgcagaaataagtgatgaaaactttaaaagggaatagcatgatgggggattttatattaatcatttatattcaaggagaaatcattatactctcactttttctagcttaggaaaacaaaatagtgtttgggaagaaattatccccaatactatttcagggaacaaaaatgccaggaagaactttggacaatgatactccttttggggaagaaaggccatctgaaagaaatgaaaaatgaagctttttcgaacttttcctaatggaaaagacagggcacatacaaaattcctaacagatacaaagctcaagggctacaagatagaaactttaagccagcttcaagtaaaaagcttttatacgtaaagaaagaatgtgttagtaagagagaggtggatcagccacggagatactgaaaaaaggaatattgtcttctgaggcattaattagggaaaacatatcccagcttgtccagtctggggcatataatgatgacctaaatgcatcaggctgtcttatcttaatgatattatgcagtaatttcaactgcaaactccaaggattcttctatttgccactaagtgcaaagtattaccttttctatgtatggatacgtttagatagacacatacttaccatttgtgttacaactgtctgcagtattcaggacagtgttgtgctatacaggcctgtaacctaggagcaatagacatatcatacagcctaggctgtgtcataagctataacgtctaggtttgtgtaagtgcgccctatggtgtttacggcgtttccataagaatgaaatggactcaagatgcatttctcagaacacgttcctgttgttatgccatgcatgactgtataaagcacacctccttctgactgggtgggaggaagtgatctggaaatgttggggttgcaccacaggagacccgagccctcgtcactggtggagctgctgagatgggcagccaactgtcttttctgaggagctcctaagatcaccttactcctcctcactccactgaactctgtcccctcccatcgaagaggactgtcactgctgagaactgactcaataaaatcacttcacatctttactagacacactgatcaggactaagctgcccggccaggagcttcctctgctctaggaccaggtgtgggaaaatggggtggagtggggtgagtggtgtgtctcatctgttcccatgtccacacagagtccttctcattttcaagaacctggattaagagtgctgaattcaggctgggtgcattggctcattcctgtaatcccagcactttgggaggttgaggcgggaggatcacttgaggtcaggagttcaggactagcctggccaacacggtgaaaccccatctctactaaaaatacaaaaattagctgggtgtggtggtatgtatgtagtcccaggcactcgggaggctgaggcaggagaatcgcttgaacccaggaggcagaggttgcagtgagccgagatcatgccactgcactctagcctgggcaacagagcaagactccatctcaaaagaataaaaaaaaagggtgctgaattcagctgacacatgcccctcatctctggccaagactgggatgagctagtttggggctcatgatacaacactttaaaaacactttctcaaaaagattctttttaacagatgaataatattggcagacaactgaacttaacataaaaataataataattcctcttcttacctgtggctaatgcaagagtaagccacagaaaataaacgtccttggagctttgtagccagagtgtgattatcattaacattactttgtgaaggggcgtttctcaaggtcactctagaattagaggcaccgtgggaccaagcactcatccattttatgggttaaaatgactaattgagggtctgagtttaattacaatcgtaagcaaaggcacagtgcagatactttgacgggcttaataacattcttatgtacacaaagatagatggaaaaaattagggttgtatattgttgtcctttaggacaagatactgaagtgggaatagaataataaaaataaataaacgactcagcggcaccgggaaatgagctgtggaagttagccagccagccttatgcacatacttcagctggagataaagtcctaagtatccatgactaaatataatgcgactatacaggagtgcagatcacagttgttttattgagctagctgctagattaaaaggtaaaaaagtatgctctgcaagcttctacccatagttcaccctgaaatgatgataacagccacagcgggatctttaggatatgcatcggtgatattttaaatgggaaatgcagtcatgtttcacagaaaatccacaaagcatcaggtctgtacacagctgctagagtcgacatccttaaatgacactgatatggtgtcacatcccctgcgtaagaacctcaaatgacttctggctgtccatagtgtcagaaaaatccatgcaatgttcagaagctagttcaatgtcgggaggaaaaggaaaggttggctcataaataagagcagaacacacagaaatcagatccgtgtgtggggagaccctcatttcatggccatccagtcaagaggttggatatgaaccttctttggccgagacagccacatcttgacttgtagaactcaatcctgctacaggtagtgtttggttttgtagctaagctacagaggggaatggccttgtgcacaaagaaaaacagaaaaacatctttgatctgggttgtttgttgagtgtgtgggcactgtttggggacaggcagcatctctgagttgtctatctcctcctcttctcagtgctgcatcctcaggcggctccttggcttcctagcttagcagcccctctcttattttcttactggagtgaccataatagattcccagggctgtcagaaccgagtaccacaaactgggtggcttaaaacaaccgaaacttattatctcacgttctggacgccagaaatctaaaatcaaggtgccagcagggccgtgctctctctgaaggctcttgggaaaattccttccctgcctcttcctagctgctggtgttgcagcaattcttagttatccctgaattgtggctgcaacactccaatctctgcctttgtcttcacaaggccttcttccctgtgtgtctctctgtgcatatgtcctctttttataagatgccattcattggatttagggcccactcttacctagtatgacctgatcttcatgaactaattgtatctgcaaagaccttatttccaaataagatcacattctgaagttctgggtagacaagaattttgggggaagatttattcaacacaccgcagtgacttcagccaacatgagcttgtccagagagagcggagccagctcaatgttccctggttagcgttcagaccatggtccctcaacacatgtttttggttgaaggtgatgattatagcggccacaggttaagagatggatttgatcacacgatgtgcaaggaaacaacaatgagtgcaaaactgaattgatttcaaggtctgaacctcactctatatgaaattcatttccctggaggactccttcatcataaaacaaaacagagaagactaacaaaataacctcatttattcttacatcctaagcctctccaacattttgccacatttgtttggggccatattttaaaatgttttttgttaaaaatggatgcttgaatctggcagaattggagcaaaaggaacaactagcaaaggggaagaaatgaagaagggagcattagtgtgcctgggattaggggtggtggggaagaggtagcggaggcagagcgtagaaatgaagcccttcccttctgatcacccacagctctaacccccgcaaccccacctccccatgccgcttggcctctcacaatctagctgccatcatccttatcaactcaggcctccaacaaaatttaaggcttttttttccccacttctatcctttttcctcagtgacagacagatactccaggaacacaaagatagatctgctttttaaaaattcaatttcttgtccccaaatgaatttcaaacgaaaaaggactaagggcattaacttttcattttacatttcatatgtgcttaaatttttgctatgtcaacatgatatagcttcccatgaagattctccattcctttctagagaaggcaaagcaagtgtctcctctctttagaatgctccctgtaaatgtgcctccttcagtagtctacgacctggaggtggtagggaatggggtggcgttagggcatgaagtggggacagccactgatattggtacaatatccactgcctagaggaaagcttgagaaactggacagagcctattaagcctgcatgaaattgtctaaagacagaatagtgtcacattgtcaggttctggctaagccttaggcagattttactgacttaaatttatctctaataagcttttggacatttaagagcaatataatttgcattcatagattatttttttccaaaaaatgaaaaggtgacctctttaaaaacactaattccttaaattcttaaccttggctccccaccctgaaatcacataaacaagtctgaatcctgctaggaagaaaaatcaagagtaatgattttcaataatgaccagatgaatttacttttacctaccacatgctccttctgctggatttccaagctatactagtttaggaaatagtattctaggaaaagagttttattttcttggatgttttattttctttatatattcctgaaacaatagctacagaagcaaaccaaaaatatcaactcatcttaaagtcattggcaaaagaagaaaggagtactggaaaaacaatgtcaacattattatctaaaatatgccttaaaatatagtcttattttaaaacacaaaaaggcacccacagttctagttgtctacatgaacatcaaaggtggaggtcaagagactacttgcacttggctgagtggctaatgctgtcccaggtagctacacactccgtaggtcctagcagggaagaatttgaagtaagaaagaagggagagggagaagaccactggcatttaaaagccaaatgatgttggccacatggatgccactccgtttatctctggaagcaaatttaaggaaccaacagagaggaaagtgttgccccgtcagcaggtggtggttgtgtattgttttaagcacagatctgttagcagtctcctatcccataactttgaatttcctctctgtgtgatagggtggggatggtctgaaaccagagtcaggatgtggctcaagtcctggcttcacgacttaactacacatgagctcattgggctacgatgcatgtgagaatcaacaacatatctgaagtggaactttcaggcccctggaagacagagattttatgaataataacacttactttaattttatttaaaaatctaatctctattgatggtgcatctcaaactcctctagagtcctttcaacgctgggtagcgagtgctggcctctgctgccctccatgatgctttcccattgcatcatttctatgtttagcccaatctcacctgactcttcaagccttttttggccacacctagctgtcagtcactttctcaccagtttttcctcctgtactgccatgatcataacactaaattgccactaggctgttgtgctggggctcaccggctgagtgccatttcttccactcagtcatgagtttctgcagggcagagtctgccctctctcagcctccttagccctccccaacacaaagcaggtggtcagcaaatgctcctgggataaaactgctgcatagcagaagcagcacaggaagtcatttctttaatgtgaatagtgatcttggctttgttggaaaaatgaagaatgtaaatacacttgcatactaaaatctaaagccttctgtcatgatatggacgactgtgactgttctggtgtcacagatgtctgcatgacaaactgaatcaaatggcatcattttttgcttcctattatgtggtcactcctggccagcagcagaagcagcagcaagtgtcgagctgctgtatgtgtgaatagacagggatggggagtcattctggtctcaccaaactgtgctccagcaacacaacccagaccctaaacttagccagatgatgtgtaaaggggacccgtgagcctacactggtctagcttcttcatctactttttcatcaaaggatgtcaaatgtactttaataaaggtggtagcctatatcctttcaaacaccacgaagacatacttatgctactatattaatcagagagcattttaacagacagagctagccaggtccttattgattacacttctacaattgcttctgagacagttccttctgcagtcttcactagggaccctgacactgtgaaagtagggaatgctagcaagggaaaaacacttttaaatagttgtgaataagtgaaatagaaaaaaatcaggcatgggagttcagaagagcctacaattttagctttggaggagttatatttcttctggtgggacagatgtttgcccaaggataacagaatttaaggggttatgaaatggatgcctcagtagggggtttcagagtactgtatatttgccatatggtagcacctatccagagaaatcacgtcagatgttcatgatttcgtgactcagacgaaaagcagaattgtcagaggattcccattcctgcccatgaacgcatgtagatattcgtggaggcaggctcttatcttgctctgtgcacacacatttcacacaaacacataccgcctctcaagactggaggctgagagcattgggatgaatactcatgagatgacgattattaatgccactgaggtggattttgttccttctcagtagagactggttgttatacctagaaactgatcaactgtaggagaaatggcagctttgaaccatttcaactaaaacaatcctgtatgtttcactttcaaaatatagattatttggctaggtgttttcaatcaccccttttgcccctatcccagcaatttcatccagcagagatttgcaactttggtacaaaatacaacacttttgggagcacagtttctagagtttagaagaatcatatcttggtaactactttccttcctaagagcaaaaattaaacaagacataaagttgattctaagaaatctcaatagattcctgatgatttttgtgaaaaacgcatcaggagagaatcacaagacatttgctactttcattatttaaaaaaccatttaatacaacaggccttattaaagagctatttctaagaattatagaatcttacagtcaaacagagaatttttaaaatgagaatttttaaaaaatggctacttgtgacagttaaccagatccctatgtatctgttatgaactctgcccaaccagtcagcctgcctggttgtgctatatgcatgatataatgtgaaattaccaagaactattgttttcggccaaagaaaatgacttattttgggttggaataaaaatgtttgtttttcaccttagacctaagaaatcatgtgaagtaagtctaacattaattaggtagagaaagatacctatatgtctttattacctggttagaaaatttaaaattaacttcttatactccgttgccacatcaacattcatgttttcagaatggtctgatcctcagtaaaagagccactaaagttatggaaagagacagtgtctggccaggggaagatggtgggaggaggcactcgtgacacaggactgaccttaggcacccggtggcgttacgcagcacctgtgatgaatgcagctgtattttccgatcatcctgaagaggcgaattttcccagcctgagtgggggataatcaccgcgttggtcagtactgctagggcatcctggatgattggcattttgagtgcatcgcatgaggagaggttccaaaggactcctgcaagagacacacaaaaagaggttttgggtggccacaagtttttctcatctccaaaactgtcttccttatttgagttaacggaactggcaggaaggatgaaaatactgtggacacacatcctagagtgtgtccttaattttagaacattcgtgtgaacccattaaaagcattctgtgaaaaatctgatgagtgagcagaggaactgtgacatgattatctttatttcctcagggagcataatcaaggttgcgaggtctgattgaactgaggctaccaacaacgcttctgttccattttaatacaatggacccaaattgctaaattctaaccaagaccaaagagatgtgaaagttatttgaaatggactagtagagcatctttgtcttacccaagacctcagtgtgcacatgtggttgccatgaaagctaagtgctttcataaacaaccagctaccatgggtaggacccttatgagaatccagcatcaggtcagatgacaactggctcaacaagcaatttaaactgttgccccttgtgactgttttgtcagcttttctctgaaagcaatgctcatggaggacctacagaatgttcctccttaaataatgacaaagggagaggtgagaagaagagggcatgtccacaatggacagagcgtcacagtaattcatgcaggcagagcaatgcaaaatgttaacgacaaatagaatgctttaggcttttaaatattttttaaaaggagatgttctagaaaaggtcataaacattgcatatatattataacatcatttgaaaatgcttttaaataattattctttttttgttaggacagtctacataaagaaaaaaaggaacagagaataacattctatttttctttgaaagaaagcctgtatacaccctgaacctaaacacgtaccatcactgcagatattggaaataaaacactatagttgtctttggaaatagaacttgtagcttatgtttttaatgagctttcgatatattttaacgaaatgcgattttgttccatctactgtgttatgaatagaacaaacagaacatgtttatttccaaaatttgttttattggttccttgcgttgcacatgttgaactatccaaggacattaataatacaaatctgactgttaataactaaataagtgactataaaaataaagcaactataaagttcaataaaaatgtgactacagaggcaaactcaactgtctttagaaataccatttactggaaattttattgaagtgaatgcaaaggaaacaaaatgtttttagtgcccagcatgcataaaataatccttcagtacagggggttaacctgaaggcaaatctagcttctcttcttttatgaataaagttttattgaagcacagccatgtcggttcatttctaaattttttacatctgcttttgtcctatgaaggaatagctgggtattagtgacagagactgtacagcccacaaaccataaacaatttacaaactgtccccttacagaaaaattttgtccaactgtgctttagtgaatttgaccattttatatacactttcatttgtgcttgtattgccattagtatcctaaattgagtacacaaaaagtgctcaatggtacacagaaggtgctcagaatatattctgatttggactgatttgaaatactaggaatattaacatatgcatctatcttgttttaaataaaacacaaagctgcttattcatccattgagaaatgttttgccaaagtttggtaatctaaataatcaaaatgacttcattcatttccagcctcacaaaaatgttaatttttagagtaaaataattgattttgcagttttaaatagtatattaaaaagaaattagtatctaccccagtatttgaggataactttcaggaataccatgttaagacatttgtgtctgctcttcaaagtatacaatgcgaaaatataggaacaaaatgtgcatttttttcattcccaaatccagactcaaaataccaatatctaaaaattgaggcttataaatgttttaaaatatgggtgacatattttgctgtatggtatatatcctttaaaaactaaatagcaggcagggtgcaatggctcacacctgtaatatcagcactttgggaggctgaggcaggtggatcacgaggtcaggagctcgagaccagcctgggcaacatggcaaaaccccatctctactaaaaatacaaaaagtagctgggtgtggtggcgtgtgcttataatcccagctacttgggagtctggggcaggagaattgcttgaacctgggagtgggggggggttgcagtgagctgagatcgtgccactgtactccagcctgggtgacagagcaaggttccatctcgggaaagcaagcaagcaaacaaacaaacaaaatagcagagagaaacctttgcatttttttacatgcagtgagtatgaaaatctcaaggctttctatgagaatacagctatttttactgttttcttacaaacagaaaagaaatagggaaagggaggaaggaaatcaaagaaaacctaaaggccaaatctagtacctgacaagaagtgaaagaatggaaaggcagatgcagtctggaatatctttttataggctgttctatctccttcacttttccttaattagttaattagtgtaacctaattcagaatcacgaacaaacagaagttcacattcattccacccttccaggctgtctccatctgcgagtcacattccagtgaactgatcacagtacttgatccatatctctgaaccatctatctcaatttataactgcaatgcacaatgcttcctggacttattacaactgcaatgaatctctatcaagcaactttatcacctcttgatgaagtcttggtaaagtggatggaacgcggcagattttcttgagggggaattcagcaaaccagctgcatggggtcgtcaaaattttgagttttggttagattacctggacatgagacaggtttaagcatagaagcagcagtttctggagacaactgagatgaagatttatatcatctggcaggagttcaagtgggaaacaactgggaattccacatctttcctgctacacacacacacacacacacacacacacatacagacacacacacacacatgtcttgactgacggaagagagattagtggagagaactggacgtatctaggcatcctctgaacaaatggaaaataaattttttcctcaaacttttacttcactcctccctccccttttccatagtggtttaaaatatgtccacaaattcttggacatttccttcaaatggtggagcctaattcttctctccatgagtggggatttgatttagtgactcatttgtgaccaatgaaacatggtggaagtgactgtgacttgagactatgtcattaaaaaggctttgtggctccctccaaaccctctctcagattgttatttgaggggaagccaattgtcatgccatcatgaggatcctcaggcagccttatagagagaccagcatggcaacgaactagggctttcagccgaaattttggaagtggattttccaaccccaaccaagccttcgaatgactgcagcctcatgacagaccctgagccaggaccacccaaatctgtggctcctacttgtactccctcacacttagacagtgggtgacataaatgttggttgttttaagctgctaaattgtggagtaatttgttatgcagcaatagacaatatacctttcctttcctatgaagctcccactctctctgttgctttcttctctctgcttcactttcctatccctttgcctttctacaatggatggactcatttttccctctcgccttcccaggacactttaattcttactcctctcttacctaaatccacttgttcccttattccttccaaattccaatgtgagagtatacaagatatagcaaggatgatccagctacactttgtaactaaatttaaaatgcattttaagtgacaagtatttaatttaaaaatatgtatcattcttcacgtttgcaattcaataagtgacccaacactttctttaatttggaataatcctgctcttatttccaactgctgccttaacaaatcaccacacaggggcttgaaaaacacaaatttataggtttgtgtttggagggctggagtctgaaatgggctggcaaggctggctccttccagaggatcccggggaagatgtgtttcctcatcttgtcaacctcctgggggctgcctgcatcgcattccttggcttgagatcttacatccctctgattttggcttccatcatcatatctccttcctggactctgaccctcctacctccctctcataagggcactctgatcacattgagcccacctggataatccaggataatctccccatttgaagccctcctaccttagtcatacctgcaaagtccctttcatcatgaaaagtaacatttacaggctctggaaattagggggtgggctttttttgcagggtagggacattattcagtctactacgtatcccttcaaaaataacctgttatgcttaaaataaaattaaacttcctatggtagcctcatgatcaggcctttctctaaatctctaaattcatcttgatcacattcattcattcatttatccattccataatattaaggacctagtacatgcatggttctgtttgacgtggagtggagacatcagtgaagaaaacaaaaaatccctgtgctggtgggccaggtaccatatagctctagtcactgtgctccagccaaaatggcctgtttcttcttgaacacacaagctcctttgtgtcgcagatccctggacttgctgctgcctcattctggaacattgtttcctagatcttttcatggccaatacttcttccattcacgtcaacttaaatgtgctaaactcagagaggctttcctggatcagtctagtctaccttcccagatgcttgctgtcagatctcctatttaatttcagcagaaacctcaacactaactcattctgtcatttgatcactgttccatcctccaacagggtcccaggcataaaatgaaagcagacacttgtctgaatgcccatcgtatgcagaacacagagctacagaatccctggcatacagaatatgccctgacaaacatgaaccaaacaagcactaaagaaaaataaaaaataacagctggatggtatgatcttataggatgccatgtgctgtaagcatcgaaacttctgtaagtattatagcgttagcaaaatgacgtcatgcctagagaaaataaaacagcagctgcaagatgtaatttcacaaataataaatccaaacaagaatagaaaaatgttatttaagtgggattatttactttgaatctacagaaattccatttttagctagtagagaaaaatttatagcactgaaacatattaatctgctttgtattaaaaggcttatctctggtgcttcatttgggtaattttcttatattaactccctgataattctaaattagcccaggtaatactaaaatttcaatctgaggaaaaactataaaactgatgggattcacaccaattttcagcattcataacaaattaccctgtttgtttatatctgaggataacatgaaaaatggtttaatattttggttgatggtcactagaaaatttaaatttccctgatgaaaatatgctaattccttccagattataatctgtgacaaatttgttttattagcatctttcttttattatttccatccaatagctttcctttatcagtgtaaaattattgctgttccaaatataattttgaaagtttaattgcgaagacatttacgtatactaaagatatttaaaaatatagtttatttttatttcaggcacagaatggctcttttccttgatattatccatattcatgagcaatgattggtttaataaaaattccttaataaaaccttaattactttcatttgcttctttataatgctttaatacagggtaattgtagtttctttttactgaaagagatgaagactatcttggttaaaaaaaccccagatgaacaaaaagaatgttttaataaaagcaagttttaaatgatggtagaatcaaacactgcctggtggctatgcaggactttacgacagcccactggcttgctttcagctctttagacgtagcatgaatcctctcatgtgggtgaggctcaaaccaagcccaaaggaaagctgggcttcattcattttaaataaatgtttataaaaatgtatttacaattaattagtgaattaaggcatctacttagtgtatttatgaggatttattttaaacaaatttgtcatttcttttgggagtgacagtttgtgtacctggggggagggggaggaaaaaggagaagaatggggacaaaaaagttctttttttttttttttttgagatggagtcttgctctgtcacccaggctggagtgcagtggtgtgatctcggctcactgcaagctctgcctcctggattcacgtcattctcctgccccagcctcccaagtagctgggactacaggcgtgcaccaccacgcccggctaaattttttgtatttttagtagagacggggtttcaccatcttagccaggatggtctcgatctcctgacctcatgatccacccgctttggcctcccaaagtgctgggattacaggcccgccaccacgcccggccaaaaaaagttcattttttaaaaaaaccagagttaggcttggttgatggtgggagtgggagggggaggggtataaaggggctgtcaccactacctcctccacccacacccattcacactttgagtccctagtgtgtggaggttgaatgattaaaatatagaggcccaggacgccctgaagtcctgttatactattgtgtgtgtgcatctgctatacaaacgagtatttggatgcatataaactctcaatatggccccgagaagcaataaccctctggagtggctgctaatggagatcattttgagagtccttctagatggaaaacattcctataccacactcactgaatgcttttaaaaaattaaagcgtttatcttgagtcgatgttagatagagtttaccaaatgttgctgtaataacagctccttaggccaaggcttcttgtaggagtcccaggggttggttggccacaacaaatgacctctacgttttcctctttaatattccagaagaggaacctgctgttgcctttgcagtggggattacacaaaggtcgattcttttagaatttcaacaggctgaatcatcattctaggctgagtctcagagagccggcaatgggaagaaagggcctctgaggctgataggcgtgggaggtgaagagagagaattggagtgccatggtccataacaccgtaaactctcattctacagttgccacataacgcttcaggtccaaatacagaattttttaaacagaatcacttaggcacaaatattgagaattaggtagaattattcttgctcattttcaaaatacatacaaaatttatttagccccagaatggatgaagaatgagttgtccttgacatttgaaagtaattcagatctttgctgttgcatacaaggcaaattctggcttaaactgactaaatttacctgggtctccatgcaatgttttaaatctgcagattctaaaacaattttgttataagatacagccatcaatactaaggtactgtcttgttcgaagccaaaactgatcccagcaacattctgatgttcaaatttcagtaccagcagcaaacattaaaagtttagatcaagatgataaacatttagatggcaagaagccagaagtcatattcactttttttttttttttttcagacagagtctcactctgttgcccaggttagagtgcagcggcgtgatcatggctcacatggctcactgtagcctcaacctcctgagcccaagtgatcctcccacctccgccacttgagtagctaggacttcatgcacgtgctaccatacctgactttttttttttttttttggtagagacaaggtcttactatgttgttcagccaggtctagaattcctggactcaagtgatcctgccgcctcagcctcccaaagtgctgggattacaggcaggagccactatgcctgaccctcacctaaatttttgattagtttaaaaaataaccttcacttttgttttcagagcctgaattaattttatttaaaatcagttaatattacagacaaaagactataattgactgatttttttaaaaatgaaaatcaaaactcagatgtatctatgatctctcttttcattctaaaatggagtatacatatcctagtttctttagaattcttctattagatgtttaccaaaaaggcacaacagatcaggctctattaatggaaaatgatgcctgtcccaaactggatgcctatctgcaactggcaatgcagctactacaagaagtagaaagctcttcacacagtagtttttttaagtaattataattgaaaataatttgtatgtcagtgtttggtagtggccatctgtaaaagtcatgggttcatctttgatcacagcattttataaatgaaccatagaatttcatatttctcaggccccaagagatcaacagttaggaatacaaaattaggcttgcttagaactatagccttcctcaatgaccttgggtgtgcaagaactttgaaaaaatgtcaccaaagcaccaaggctgagttgtataatctctggaaagtggtcctggaacttttttcctaaaagttatgacagttaaagactatactcttttatctgacagctgtcatattcttctatgtgtaaaatgatttcttatactttgttgtgtttcttggtagttttgtgccctgaattacatacattaaataaagtaacttaagtttgacttttcaataaatagcataatgaggaagaggagagagagaaagtgaaagagagagagagagagatttaaagacaaaatacccccactatctgattaaaaaaaagtaaatgcaggaggtgaaatcaccataatttttggccctgggttaaacgatactgggacagatacattttcctatccctgtgttagaccatgctgagactgatcaaaaataatttaagtgcttgctctaggaaacactcgcctgtgaatgtttaggctgtgaactagagagctggcttatcaagagtaatagtttgctcatcatgacccatttcaagaccctcccctcactgtgctactagttaaaactctgcccaatccccatggttccccaccttgcaatacccaccttaaaatctcccagccaaggacctacagccttataaataccctgccttcattttcccttttgacactaagactctttcaagggagcattttagatccactgcagtgagggaggatacttactgcagtatgtctaacaaacccagctttgctgatcaatgggtttttatggtagtctttggggagctgacagctgacaaaccatataaattactgaaaatgggtggatggctaatgtcatctttggtaaaaaatagagtctggcaaattcttgaatattcaggggatccattatccataaattcatcaccttatctctatgcatggaacaaagggtattgagctgtttacagttccattaagtactataacccagaagttacacagccagcacacatcttggcaaggcccctagctgccattccaaactctctgggtctcgagtgagcatgcatatataacctcttacaaagatagagacggctattgccttggggtttctttttttataatataggtagcacatctacctcataggtcctgttgatgtcaacataagcgcgctaattgaattcgtggacgcttgcttatccaagagtccccggattggagaccctgttatgcactggggccactttaaagagcatcttgggttctacggctttcaaagaaaagcaaagcaaccttgatgaagatatggtggcagagtaaaaagagcaacagctttttcacagagcatcactgaactacatgtccaaaacaagaccacattgaaaaaaacacaacacaaattgtagccgaaaatatctaacatctttgagttcttgtcatgcactaggatttttgttaatcacctgcatgtattaacttgtgtaaaccttcaaccaagtccattttacagatgaggaaactgagacacagaaaagttgagttacctgtcaaagtcattcaacttttggggaaaatgaaggtcagataagagtctgactgtgatgcatatgaacaatcagacaaacgtcagacacataaatttgctatttgaattggagggaagagatgtggcgtgctatcctttcaagcagaatatatgaacacaagagaatgttctgcttttcatcttttgccagttcccttttcgcccaggtaatgtagcttgagaaatttaaagaaggcatttgagttcacagaaggaagaacattcagttttatatgtttttaactgacagatacaattgtatgtatgtatcttcatacaacatgatattttgaagtatatacacgttgtgtaatgattaaccatagttaattaaaaagaactttcagctttgaaactacttttacaactaatttttcttgcaagcatttaattctgccgacctctactaaaacacacatacacacacatacacacacacatacacacacacacagctacaaccttctgtgggaagcatggaagaaacatcagattgagatttggggtaatcaaaaaacccaattgttcatctattcaccacactaatttcatgactagatctttttttcagttacatcaaaattgtctgatactgtattagtccattttcatactgctatgaagaaatacctgagactgggtaatttataaagaaacagagatttaatggacttacaattccacgtggctgaggaggcctcacaaccatgggagaagacgaaggaggagcaaagggtcgtataacatggtggcaggcaagagaatcacgtgcaggggaactgccctttataaaaccatcagctcttgggagacttattcactatcatgagaacagtatgggaaaaacctgctcccacgattcaattacctcccatggggtccctcccatgacatgtggggattctgggagctacaattcaagaagagatttgggtggggacagagccaaactatatcagatactgttgctctatcataataatgtcactgatgatcatgagccctcatttcctgagacattaccatgtcacatgcactatttaattaaatcctgaccacaaccttagaagaggggtactgatctgtgaaggaaaccaaaggctaaagtggttacagaaatctcccatggacaggtaatgaatgagagagagagctggggtataaacacaggctctcacacttccaattatattgtttcttacagacattctaataagagattatttttcatggaaaatatgctatcactggataataatattaacactcatctttaatttctgctgatcatgctcaaatttatatttctgagtttcatttctataattctgaatgtgaacatttattactgcatattttcctccaaacatattctcttcttccttttggtttttcagcaggtattttgtgaatgcctgttgagacaagacattgctaggtactctaaggaatacgcagtaaattagtaagagtccacttggggagaccaaattacacttgcccagggaaaaataaaacacattttatagagttgtagatgctaaagtccatcaactgtcagaggtggtgtgtcatgaaaattctgacagtgaaaagtcaccatgggagggcatcacggaaggttctatgggagagggaggtcttcactggcccctgaagaacgagcagaattagccagaatgagagaaaacattcaggtatcaagaaaaagtgagcaaaggcttacagataagaaagggtgatggataacaatcctaaagaccgtgggcctaattgtagagtagatgccacctaaaatattaattgagtaaaaaagttcaacaacaaaattatacttacattcggacaattgtggtcttacactagaatagtattaggtcggtgcaaaagtaattaaaaacaatgacaaaaatggcaattactttcgcgccataatatttctcatgtgatccacctggggggcattaagaaagataccgatgcactagcttcacctctggaaaatctggaaagtgatctggggtgggtcctgctacctaagaattttttttaaaaagtagccagagtgagggaccactggggctgggagttattttatcttagtcctggtgactttaactgacttcaccaacatcagcttcctcctgagaaacaggaaaaaaaactctaagttatgactatgggaaagtgactactgagtttcatatgtgagatcttcatactttagcctaatcatgactgaacaacttcattcatttatttatttgttcatttgtctcattatccatcctttcagttgacaaaatcttctttgggtccagaactgtttcaagccttagggcaagcaaaccactaaagaattcaatctcacaaacattcagcaattttggttcagttcctctgcagagctgggaagacaatgataggaaaatgaaagaagtggtctcaagcctcaaggagcttcagtgggtgatagaggataaaacaagaaagcaaacacatgtggtatgtggttaaggatggagagcgccaatggggaggaaataacaaaggttgacgttaagagaagatgcagcgtggagcttcctggcactaccaagaacaggatgtcacaaaactcataatatcaattaggcagagagaacgtcctccttggaaataaaaggaaggtctgcgtggagagagagtgttggagaaggtatgatggacactgaattcactccctgtgcacacagctaggtttccagcaaggactatacagtggaagtgaggactccaggaagagagtgggacataggtattgtatgttttggacctaagggaaatcactgtgcttttgttttttagtgtctggatggcgaaactgatgttcaatgatcaaattcaaggcatttaattttcagcttcctaccagctccatatatacaacactgtaatgtctggcactgtatacagtcaggactcacattgtcataaaaaatgtcaactttgcccacatgccgaacttcccgggtacccgtgccctctggcttgcagccaaccacagggttcagctaatggaagaataagtaggcagtcagagggcaggaggagagagagctggggaatgttatgcccactcctctgctgtgcccctagggctgggaagccttgtggctagagcagcctctcttcacggctcccaattttcccaagttctggagactgtgtttgcttccactgcttcccgctgctgaccaccctctagatcagtatactaaccctgtcgactcctcggaagagtccctgcattggattctgtagagaatcccagctgagtgttcttttcatgtcctgtggaaaccttgatgagagctgatgtgcagggggcactttctaaaaaggacctcagaggccactataagaagtttcaattttatccaccaagtgcagtgggagggataccattaagcaggtaactgtcataattgggtttttgtgtttgttttataatgtttcattccttcttggtggatcaatagcattaaataacaaagtacaagataaattcccaattggagctataaggttaggctttgaaaaatcttttattaaaacttaagatgaaattcccataacatacagttaatagctttaacatgcacaattcagggttgtttagtgcattcacagcgatgtgcagccattacctctacctacttcccaaacatttctgtcaccccaaaaggatggttggtttttaaacaccattctggaggcatgcagcagagaacaggctgaagtgcggtgaaaagaagtgggcaggcaaggtaggaggccacttcagaaccctaagggagaaatggccagcagagatggacgtggtcaagtctgagacgtaattcagacgtaacactggctggctggcagctcggctggatgtgggggtgcagggagatggagacgttctggccttgagcacagaggtgaggaacactggaggagggagaggcctggcaggaagttgtgggctccagtttgggatgtgttaacgtttgagattccaatcagacatcactatcaagaggcagctgggtgcatgagttgagtgctgcacaaaggtagaaatgtagagccttcagcatttaaatggtatttaaagccaagggactggatgaagtcacagaagtaaagaaataaagggttcaaattaagaaccagcagcccagggctggtcttgcattgaagagtctggtggtgaaggtaatttggtataaagaagaaaaagcagtgtaaaaaaatgtagttgcacaaactgttaatcttgggatggtttgctactcttgaatgtcagtggaaaccttcttctgttagttgctgacttattttttttttaaatatcacaagtaatttgaaactgtttctcttttattgtgcatatttgtaaaaaatactgagccgcagttcccatttaaaagcatctgtttcaggactatcagagggttgattgaggacaaataaaaatgcgttagccagttgatcattatggcacgtattcagtgattatacgcagagcacgtcacaagaggggataaaaatcacttattttaggaatttcctgagtcaaggcaggagcaacatcagcagagcgtggcaaagcacgcagaacggtgcagcctctattatgattggaatgtaaagtgtaataggattttcagaaaacaatttagaaaaagtgacaatcttgcttatttaaatgctatgtgacattcagcactactccttgaggtaaaattacaaaactgataaactggcttttcaagatattattgaatatgctgaacacaggtaatgcatttatctattaactaacccttaggttagtataaagctacattgtttcctgagaatggaaggtgactttcctgagttgtgataccaaaactttggaatttctatgcttgtgtatttcaaaccaaattttagattgcttctatttttttttacatagtaatttctctgtatggatatatatggtataaaataaattccattttatattataattaatctttatcaaatcttaggttcagaaaaagtgcatgtttttggtatatattctcaagttttctagatgaacataatagtattattttctatgattataaaatacacatggtaatattaaaatcttcagcctattaaaaagggataaagaataaagtaagaataaaatcacccagagataatgagatttgggagacaagctcttgtttatcgctctattcttatcatatactcacatgtcactttacagaaatagaatcccagcacgcacgctgttcgttaacttgacttttgcattcaacacatgttacggatatattttgatatcaacatctagccacatcttaatttttaatgcctggtaatgctctatttgatggtccatttttatctgattgtgtattgatggacatttaagttgtttctttctttttttatttatttattttttttgctgacattggctcttactatgtactagagtgtttgaaatgctttccatatattaactcatctgctctaaagatgcttcttaatagtctctcaatatgaattcctaaaacttggatcgctgggtagagtctacacattttaaatactgaggtatattgccaaaatgctctccagaaagatcaccctcttgacactgtcacccaatagtgtgtgttgctgcccctcagcaaccctgggtgccagcaatcattctcatctttggagatctactagcagacatggcatctccttcccatgcgcattccttttaattaaccttcttcttatgagtgtagtagctggttgcatgttgttttttgaaatgccaattcatttcttttgttattttatttcccagttgggtcatgcatgggaatgaacacataagttaagctactaaaagttgcagagctgtagagacgctaaagaactgagaagttatcagaactagtactgatgcccaatatcattatttttccttcttcttatcatttttgtgacccttagtctattgacacctgtatttctcttttcatggtatcatttaattcatttgttttctacagtgaatcctctatttaaaaatccaggggacatttatttttgctgtttcccactgacatgattcccccatcttctgtcttggtgagagcaagctttgacgatttataaacacaaggtgtaaaaaggctttggaaacatgtagccaccgacatgttcattgttgacaatggacattaatattcacacactgtttccatggcaaactcttgtctctgttgctagtctaaggatgcaaagctctagtcattcactttaccaagtttatccattttactgtgtttggaggttgagaatgtaagcactgatacagttgaaaacaagatgaattccttcatggagtgagatcctattgaactatctagtagcttctacctctttctccaaaccaccttactctgtgaagactggtttccttatcctaacttgcaataatgggaactcaagatccagcaaaatctgaattgggctctactgtcatgactgattcataatttctagctaaaaatccaaccataacctgactgtgctcaccccctctgtttatctcaactggctatttattccaatctatcatgtcattgctctcagattaatgttcctaccctgcaggagggattcatggcactgccctactcaacaaccatctgtttgtcccatcctccacagatttagcaacaaatgacataacagcatctaaaagtccaagtttgtaggatttgctgacttgtttttcatataagtttcttacataaactcttaataagagtaagagtaataacattaaaatatgacctctcttctgggagctgagctaatgaggtccaggtacataatcttgtgattgaatgttatgaacagatggagtttataaattcctgcaaagatgcatgagtattacatcccttatttcacgtcaacaatttccaatgcactcaggttctcagcagggactatataagttgatggtaaggccccaagaagagagtgaggtttagacattctgtgttttaccctcaggggaaatcctggtgcttttgtttctaggtgtctagataggaaaattgatattcaattataaaattcaaggcatttggttttcagtttcttactatgtatctacaacatggtgatacctaacactgtctatagtcaggacacccattgttcttagacagaaagaaaggacaaaaaacagctaaaaaattattggcctatacaagactctaaggcactccttatttgtgattccagaattttttaatatagaaaaattaatcaaaatatatgtataaaatatatgtattataagttattaagagaagcttttacctatcacctcctggagactaaaaaaatatttaaaggaagtgaaattttgaggaacttttttttggtcttgttcacagataattagatctacaaaatgctctcattaaactacatggatcaagttagatggaaatttatatcatccatctaaattctgaataatatattgcaaaaacaacctttgtcattttgatattaagttgttctttatggcaataattagatagaagtgccatttatttccttaggtgaattatgatttgtgatgataaaatcatatcatcagataaaaagtatcctcaattccatcgcaagaaaacatgcatcaattaatttaaatactatagcaagttgtttataccagaggaatgtatataagatgatacttgttggttcctggtagctactgatattctggcagtggtgttggcgaaggcaaagaaatagaaaaggaagacttgaagaagacacaaagttggcttaggattcaagctggttttatattgtttaggatagaaatgggatctctcaatgcccatttctattcctgcaatagtgttcaagtattctttatagatgtgttaacatactgtcacccatgatgactcacacattaagcaagtcttactatgaaatcaaagatggatgagcatcagtgaataccaataagtctgctactgacctaagcctttttctcagtaggttaaaaggagaacacaacagtggttattagttgaggaatactcttgaagcctgggaatgcagctcaatgtggggaaaattggaatatagtttccaccaaattagtccaagagggatttattgaactcctatgatatgctgggttgaacatcatggaaacaatcatgactatgaaacttcccctactcttaaggagcttataggttaatgtaggtgatagagaggcagagatgatacaacttgaatggaaaacctgtgatatgagtcctggtaggaggagtatgattaacaatgcgtcataatggaagatgatgctaacaaaatgaggcaaatgctggttatggaggtctgagaaatttgagatgtaagacatcagtagagcctagcagaattttactctttaaaaagtatatatataattggaaatttatggtatataaatggttttgttaaaattaattagactcagggcactcacaacattgaatcattttaagttggcaaagaatgtaatgatgattatcaatttagtgtaccaggaagacatatacaatacattcttcgccttatattgaaatttaactcttagaaagacatatgtcctactgatctttatgatactgtggaactacaatagcttatagctagaaaactcttatttaaaattaccccactgagatgacagtgcatatattttacaactatttcttaattatgaagatggtatgttcaacaatgagcagataatttttcatagcttgactaacttttctcaatttcagttgcctacagtctcttggatggacacatttcaaggcaaatcacatgggcctttattcttaaagatacagcagagcaattagtccagcgtggtggcaggtgccctgtagtctcagctactcgggaggctgaggtaggagaatcgcttgaacccaggagatggaggttgcggtgaaccgaaattgcaccactgcactccagcctgggtgacagagcgagactccatctcaaaaaaaagcacaaaaaacaaaaaaacaaaaaaacaaaaacaaaaacaaaaaacaaaaaaacataaaacagagcactgtactatattcctaaaacaaggttatcacagaaaatatgaaccatgcctttaaatatacatatttatctcgaactcctgacctcagatgatccacccacctcagcctcccaaagtgctgggattacaggcataagccactatgcctggactaaatatacatatttatctgtacctaaccctgacattctataatgtctccatttttagttatcttcacaaaggagataggagatatatttgttataagagatatggttttaaaaaatcattttctgacctccacttctaaaagttagtaaatttgagggctgaggacctattgacacctcaaccctcttattaaaggcttaaatgactctcagaatagataaccctggatattatataatatttaaaaaaatatgtaattggcttggagaaagcaggtatttgtattccaaaatgatgctgcgtaaacatggaagaacttttggtttggtgcttattacattaaccttttaatatttccttctcaacctaacatggggataacaatgacacacattttatttgctggaaataataaactaaaggctctgctcattgaagaaataactcacagcaatgaccttcattgagggatcgctgaggctagagcactaattctgtaactagcaataaaaacagggttgatatggtttgctctgggtccccacccaaatctcatctcgaattgtaagccccatgtgttgagggagggacctggtgggaggtgactgcatcatggggggtggtttcccccatgctgttcttgtgatagtgagtgaattctcatgagatccagtggttttaaagtggggcacttcccccgcatcgctctctctctctctcctccactatgcttccttttggccttccgctacgattgtaagtttcctgaggactactcagccatgtggaactgtgagttaattaaacttctttcctttataaattacccagtctcaggaagttctttatagcagtgtgaaaacagactaatacaagggtcatgtggccttaaatgtaatatgttattttggaagcagagtcctaggttaatatttaaagcatttaaagaaagaaacataatagcgattggttgagaactcacttttaagtttcacacactgaaagcacaagcaaggcttatgtgcctcacatattgtagagtctcagcatcatggtccctgcaagcagatgggctcctctgttcatgtccctgacccccaaggcaggatgtagagtgaagaaggacctcacttatcctgctggggacagggtctgtaacactgatctcttttccatatttgccctagggcttagctgagcaacacactctagatcctgctacctcgtagaaaacagtgaaaatgtgatctggctctttagagaaccaaactgaaatacatcactcctaacgatgccaactggcaactcctataaagagttcccatgtagcagggatgctggctcccatctgagttgatgtctctgtcctcttcagagttcagacagggctgagcactcccggttgcctgaggatgtggagctgacagagtctactagtatgtgggcccggaggttctggggaagaaccaagtctgtgcacttgaggtctgggatgtgtttgggcaggttaggcaggctgggcagaggctgactggtggggcaggaaaagctcctaggagggaactgatgtgaatgcaaaccagccagcgggtaccaggagcagggtgcagtggcggggagggtggacccaatgactggagtgggagccattatttgactcgcccttagcccagcaacagagaggcaagtctcaattcccgggaaagaggctaaggtgggaaaagctctttctgtaatgcctggggtataagaagtgctcttcagggattctagtacaaattgtaatgcaaggggcagtgagccattctttctctctggcttacctactacctcatagctgcagtctcctgggggctcagggtagacacatgtggggccactttgcccgggaagcagcaggtgagatggcgacaaccagcagagcacacaggctgtgccccggggagccatggtgaccagctgagagaactgcaagctctaaaagcactgtggaagcttctgccaagcccagtgtatagaacagatacacaaagaagtcggggatagtagtgcttccagtgtggaactgcgtctggtagagcaggatggtagggagggctgtgtgatagccaaaaacccaggaggctccgtgtgtatgtgtgtgtgtgtgtctgtgtgtgtgtctgtgtggtgtgtgtgtggtgtatgcgtgtggtgtgtgtgtgtgttatgtgtggcatgtgtgtgtggatgtgtgtatgtgtgtgtgtgtgtgtctgtgtgtgtgtctgtgtggtgtgtgtgtggtgaatgcgtgtggtgtgtgtgtgtatgtgtggcatgtgtgtgtggatgtgtgtgtgtgttatgtgtggcgtgtgtgcatggatgtgtgtggtgtgtatgtgtggtgtgtgtggaggctatgtgtgtggtgtgtgtgtgggggggtgcgtggtatctgtgtagtatgtgtgtggtgtgtgtgtagtatgtgtgtggtgtgtgggtgtgtgtggcgtgtgtgatgtatgtgtggtgtgtgtggggtgtgtgtggggggtgtgtgtggtgtgtgtggtatgtgtggggtgtgtgtggatggagtgtgtgtgtggtgtgtgtgtggatggggtgtgtgtgtgtggatggggtgtgtgtgtggtgtgagtgggcgtgtggtgtgtgtggggtatgtgtgtgtgggtgtgtgtgtagtgtgtgtgtggtatatgtgtgtggtgtgtacgtgtgtagtgtgtgcatgcacacacccgggcatgtatgttcatgcctgcatgtgctggtctgtgtgggtatgcctacattgcacaggtatgtttgcatgcacccaccttcgtgtgcacatctaagagtgtgcacacctgtatatatatgtctgtgtgtgcaagtaaagttagtgacttagtttttggaggagagggatggatgtgagacacttggttttaagtaaatttgcctcaacttcaacctctctcttcccccatccatgtctaggtagcttttccactgcccacgatggcttcaaaactcttaattgcaggtgattgccctcaacttcccgccctcaacttcccacccgcaactcttactactagccatgtcccccaaggattgggtaatactatctttgtataaaagagatacagcaaaagaaactggcaacagtcaatggggagaagcaatgccaagggtagctgtgggctgttgtccttgcaaatttcatatgactgacagactttctgtggcctaatgattttttaaaaggtaatttgcatagatatagctgtttccatagcaactcagattgtgtttcattacactgcagccctaatggcaagcagctttaggaaagctacctagagatggtgagggagccccctggaggtaaagggaattttagtaagatcctggtatttggagtttggatcagcaaattttagagatattcctttccattcactaagcatgtggcttatctaatcagacatagtgtttgcttttgggagagttgcccttctgagatcacctgatcatttccttcttttcaatcccattttcattagattcaaattataaatacctagccatgctcaatgtgaagtttatacatgacaaaaaaatttcacatctgtgtttatacacttcaataactaagttaatagcaagggcagttttgcagaaaattattaaattgatagactgcttgaaaatcctaaatgatccatgttcatctcataactacaactgtatgttaaatacaaatttctatctcctgttaatttaacgaagccttaggaagtctcctgaaaaaggcatggaaagtaaggcatattaacatgcccctccacccatacgtgtccttaataaaggatgcacgtgattggctgtgcataagtgattacacagatcagaaaatgccccaaggtcaaaagtagagaggatggcatcgacactctccagctagcgggtacagatacccagcagctaaggccccactgctaaagaagagcaaatcaatttagtttcttttttttttggtttttttttttttgagaccaagttttgctcctgttgcccaggctagagtgcagtggtgcaatctcagctcactgcaacctccgcctcctgggttcaagtgattctcctgcctcagcctcctgactagctgagattacaggtgcctgccaccgtgcctggctaattttttgtatttttagtagagacagggttttatcatgttggccaggctggtctcgaacccctgacctcaagtgatccaattgcctcggcctcccaaagtgctgggattacaggcttgagccaccgcgcctggcctagttttgtgtactctctctctttctcactcgctcatgctgtctctctctgtccctccctctttctctttctctcaaactcttttctttcattaccacaagcatgcgtagaaccaatataaaattaaacatctgcttcaaaactgcaaactcacttaaaaggcaaagactgaaacataacaaaaaccgctaaagttaatgtccaagacttcttttggttaataaaagtgtttctgaatgctttgaaatcagtatctcgcagtcttagatttccatgcatattactgcctctcactaacgatggaggggaataatttttaagaataaaggatgggggatggttctttctaatctaaaaagaatcatttgacataaaatgtgagaaatgaaagtagccttttttctactgatacctgtgaatgcaaatgtggttcactgttaagtatatctggaaaccagataagagcgcatgtttatgtttgcttttaattaactgcacagataagcctcagaaaataaatttgtgaacagagcaggtatgccacttgaaaacagaattgcacttatgaattaaaatccattttctcaaaaaaaaatccaacatgcatgaaagccaaatactatgtagggcaagcagctcttttaactaatatgtatcataattttaagtgctaactgtgtttgctatagactgctgtacttgaagtactgaatgcttttatgctcaaggttccatggtttttaaattgcctgaaaatatgtcctaacttttaagttggccgactgtcatttgcatagtagattaatccttgttcactattgtgaattaatagtctgtggaattattttgtctcatcaacgaggacacagctgactctgggtgtgtccctagcaatttttgtgtgaagtgaatcaagttatgtagaaacttatcaagcacgttcctcattattccttccacccaaaggcccttaacttctagaagaattgtagattaaaaggcaaatatggatggaaggagaagaccagactgtttgaacccgcagcactcggactcaatgcaaggagagtggcaagcagatatgcagaaggaagctgctttgcgcaggagtgcttgtgccttagtctgagcaggtgtgcaagaacacacatgcccacccctgcatgcacacggatgactcagttctcaatccattcttattaaagaagcatgcaaagagagtttgcccctgtaaccttcgtggcccatgttttattctcctgctcccattacctgcacgccaaacccatatgcatctttaaaacccatttcaaatgttgctttcttcataaagtcttccttgatctcttcaactgaagtttctctttcctcctctaagctcctctggccctctctccatgcttttcttatagaacagttctctatctccctctccctaactcagtggactgctcctggagaacagagctcacatctacatcatttccatatgctcttgtctaccctgactgagcaaccttgtagtgctgctcaggcatctattgtgaactggagaagaaagaaggaagacaagaaggtcaccttctaagcagtcccatttcctgacttctctgggattacaggcctcatgatacaggctcctattttaggaaaccacttcacagagattcttcttctgggcattccctggggatggcacacagttgatgtacacagctgccatgatggcaacgacaacagccgtcatgatggaagagcgagttgctaagtgaaaagagttttgcatgtgcaaaactgaagcttctcctcctctaggctgagtttcatcctctaacggataaccaaaaaggaagtttatttcaaacgtttcatcaggaatgacaaacaaaaacatctgttggaaaggaaaccaggtgttgggcaagggatgtagacgttatataatttggtgttctcctccaggatccagtggggattgctatgttgtgttcgttaacactagttaatgtaatttttgtgataattgtagagcaaatagagcaaactctcaaatataattagggaaaagtgtttctaattaacttgtaactcgtgagttgcaaagtaaagccacaaatcagttatgcattgtcagacctaacaaatggaaatgcgctgtacatttcaatctcggcaaatacaaaacaaagcacaaagacccagaaaaactttcctttaagcctttatacaattttggcatgctctgaaatgtaattagagataagcacagatacatctcacgtcaccagccctaatgatcacggaggtgaaaactgaaggcaacttcagacggttcaagaacatccaacattttactgctgcagaatgtaaaatggatcatgctcacaaaacactctctgatcggtgtacagaaggttctgatgaaacttcacaaggtttcatagggaagtaaaggactataatatatgcaagctccaccccagttaacactgccatcagtaacagttgcttactgctggctgtaagtcagagggggatacaggaaatttcttctatatccagtggaagcgattccacttattttctctctcacttgaggaagcacactgtaatatgaggtaacctcaaattcattctaatttgaaaaaagtgataaacgggccatatattttcattggatagtgtagttaccattagcgtcaaattattttggcgtctctcaaaacacatccatgtctcctaatcctccacccctctgcagtccactgtaattgttggtcctgttaaagtagaaagtggtgtttctcaaacatgcatgatcctaagaacctcgagagggtattgctaaatgtgtggattcccaagctattatcgtgaaaatctagggtccagaaatatgtattgttttatcaagtgcctccaaagaaactcttatgattggagaaactggaaaatcactggtgtaaagcagactggctttggaaatcaaggactacactagtaccacagaccagctgtgactttaagcatgccccttacatccaacctcacaggacctcaggagtattcaaggcaatgatagactggacggtacgtagcactatgaccggtaagtgtgggtgttcgtaaatgtatgcttatctcttcttggtccacaagaaagaaatgcagagaatacctggattctcaggttaggcacattggacaacaataagaatgtaaaacacaggaaataatgtgacatattggctctagaggcatctgcaaagtcctactctgtgacaaaggtaataaagaaggggtattaagcttgacttacccatatataaatgttagcagtctaatcttaccatagcacaactaactacaactcccttaaaaagactgtttatgagaaacagagacaaatgggacagaatagagaactcagaaagaagactgcacatctacaaccatctgatctttgacaaacctaacaaaaacaagcaacagggaaaggactccctatttaataaatggtgctgggagaactggctagacatatgcagaaaattgaaactggaccgcttccttacaccttacacaaaaattaactcaggatggattaaagacttaaatgtaaaacccaaaactataaaaaaccctagaagaaaacctaggcaataccattcaggacataggcacgggtaaagatttcatgacgaatacatcaaaagcaattgccacaaaagcaaaaattgacaaatgggatctaattaagctaaagagcttctgcacagcaaaagaaactatcatcagagtgaacaggcaacctacagaatgggagaaaatttttgcagtctatctatctgcaaaggtctagtatccagagtttacaaaaatacttaaacacatttataagaaaaaaaccaaccccattaaaaagtgggcaaagtacatgaacagacacttctcaaaagaagacattcatgcagccaacaaacctatgaaaaaagctcaacatcactgatcactagagaaatgcacatcaaaaccacaatgagacaccttctcataccagttagaatggtgattattaaaaagtcaagaaacaacagatgctggcgaggctgcggagaaacaggaatgcttttacactgctggtgggaatgtaaattacttcaatcattgtggaagaaaatgtggtgattccatgaagacctggaaccagaaatatcatttgacccagcaatcccattactaagtatatactcaaaggaataaaaatcattctattataaaaatacatccacatgtatgttcactgcagtactagtcacaatagcaaagacatgaaatcaactcaaatgcccatcagtgatagactggataaagaaaatgtggtatatatatataccatagaatactatacagccataaaaaggagtgagatcatttctttgcagaaacatggatggagctggaagccactatcctcagcaaactaacacaagaacagaaaaccaaacactgcatgttctcacttaacttaaaagtaggagctaaacaatgggagcacatggacacagggaggggaacaacccacactggggccagtcagggagttgggtgagggagagcatcaggaaaaatagctaatgcatgctgggcttaatacctagatgatgggttgctaggtgtagcaagccaccatggcacacatttacctgtttaacaaactgcacatcctgtacacgtaccctggaactttaaaataaataaaatttaaaaattaaaaacaaatactgtatatggaaatgtcttgttcactgagacactggtgccaccatcctggtcactggtaagagagccatcccataaggaagggggagctatggctggaagaagccatatggctagaagggtttctgaagactctatgggatacagctgcgttatcaccttggaacacttaactccagatttcacgtatgggagacaaaacttcctctagtttaacagatcattatccggggcttttcctttcttcaaacttcattctaagtagtaaatttctatccctttctaatctccttagcctgcttgatttttcttcacagcacttgtcacatgctgaaattacagatttatttgtctcagtttattgtctgtcttgtccactacgacacaagcgttaggagggcaggtctacgagttccagcttctaatagcccacaatggttctgttaatagattatgaaatttcacttattgtcttgacacagttcactcctctacatatgaatcaatggaaataccaagactcctctcaatgctgctccttcttttctcccttcctccatgtggctccttgaaaaacaggtgccatgatcttgaccattaggaagaaagccatatcataaggaaggctggtctatggctgtaaggtgcctgggtccttactccttgtatcccaagcacctaaacttcacttccatatacatttgactttgaacaacatggtttgaactgcgcaggtacacttatatacagattttcttccacttctgccacccctgagacagcaagaccaacctctctgcttcctcctcctcagcctactcaatacaaagatgatgagaatgaagaccttatgaggatccactcttacttaataaagtgcatacatattttctcttccttataattttcttaataacattttattttctctagcttacactgttgtaaaaatagagtatataatatgtacataaaatatatgtaaattgactttttatgttactggtaaggtgtccagtcaacagtaagctatttgtaattaagttttggggagccaaattgtatgcaaattttcagctctaggggttgtcagcacccctaactcttgggtcgttcaagggttaactatagtaggcactcagcagcaatttgtttaatgaatgaatgaatgagactcacagtctacagaatggcttctgtctctaggactgagggtggagtatacagaaagttaaaggtgtggatttcctaattggattacagtcagtctgtttggggaagcaattaggaatcagaacagtgctgagggttgtaagtttttgccctctgcctgtgcatatgatttgggcttgcctctgtgaagagataatcctaaaatgttcaaaatgacaggagacaagaatgggcaatgtctcagcatagaaggcatgagatacaaagctggttaggagatgacttgccatcaaaaggtagaccaaatacttatctcctctgcccatcattgatccatcagaattaacagcaatgtactgggaaggattcttccccaggcctgatgtttccttactgcgaatggagcacaattatgtaacactggactctcccagcccctcacttgctcttcccctgagaggtagaggaacttgtccaaggcactagtaagcgtgcagggcttggcccagctctgagcttcttccactttgggatgaaaggccatgaggaactctgcttcccctggtctccataagatgtgccctagtggctggcagaggagaagggaagctgccctgatccaacggctgcctgtgccatggtagataagtctaactaattctggcatctggcattctgtgtgagcaaaccaatgtggctaaaaggcctggagtctggcctccaacccaacccctagcagtaatgaggtgacaatgtggccttcttctttattctgttagaacttggttgcagaagacagtatgaaatagaaggttctataaactatggcctgagctacctgcttgcataaatacagtttaatacacagccatacacatttgttgatgtattatctatggtgctttcatccagcacaggtagagttgagtagttgtaacagagacctagggcctacaagctaaaatattttctatctgtccttttactgaaaaagcttgccaagtcctgttctagaatctagaagagaatggtagaaaagcatattgcctctagtgcaatgctttcaggttcacgaacaacggaaaagtagaaggcaggcaggattcaatttcagcaaacactgctacacttccaagtgctgaaaagcaaagtgtccaacttaggaagcaggttcaagagaactgagccttcctgagatctgcagaaggaaagcagaggaaaatgaatcccagaaggacatcccatcccagcagtaaaaagaagtgctggaaaaatgcatttctcagggcctagagcaggagcaagcagagacagtggcctgcagtgcacacagcagaggtctgggcttgaaggcgcagcaggttcccccaatggcaagagcagcttcaattcaggagtctgttgagggtgattttgcaatcttcgtagggataggggagcaaatcaattccatcataaaaagcagagaaatcactgttgccccataggattgaggaaaacctgctaacaaaccacaggacagtggaaggcttgtcacgggacagaacacactcatgggacactggaccaaaacacctgactcccatagaggaaatccaaaatcaaaggtttccattatgtaggaagggaaagaaaccacctcatataagacctggagtggtgggtttgtgctgtgtcaccccagctgaactgcaactatgcttcccaggatttccctccctgcttggttgcaggttgagactgtccatggagacatctgcgggatgcctggcaggtccaagtgaagcacagtgctgagctctgagggctgcgggcagagggcatcagggctgctgcagtgtgtgcacgtaccccctgctgctgctccaccttttaggccacagctctgacagctcccaccacatcccctctttccacttccctaggtcctggccaggaataatcatgcagagttccgtggcaaagagcggcagctttgtgtatcactcatgtggcagatttgcagccagcgagaggcaaaagaggggtgccatttgtccccatgagtggcagctggctctggcttcccctgcttcacatcctgctgttctttctgactgctgcctgctggcccgtgtcaactgcaggcccatcaccagacacagcggcaaagccttccacaggcgttttcaccagctctcaccgtggtgtcaggtctaatcctgataacaagtccccctttccatgtcatctacagtgcttctgcctccctggtcaaaccatgatgcacctggagacaggcgctgcctctgctgccagtatctaaatgttgcaaggtggcaacaattcctgtgattccagtttcctaaagaagagacaatgggaatcgaggaatctcccttcgagtgggaaatgcatcatgccagaatgaacctttgcctggacttatttctcccaattcaggttaagtccacagatgatggactctcaaagccacacaacaccaggctggcatcccccgactaaatccaaggggtctccatgtgctcacttccctcagacactgtggggagcagaataatcattctccaaaggtgtccacatttgactcctcaggacctatgaatgggctcctttacatggcaaaaggggcttgcagatgggatgaaggtaaagaatctaaaatggggagactaacatggagagaatcctggatcagcccggtgggcgcaatctaatcacacggggctttaaaagtagagaatcatttctggcagtgatcagaggaaaatgtgaccatggaggactcatcagggatgcaatgctactggctttgaaggcagtggaaaggggtcatgagccaaagaatgtgggcagctttggaagctggaaaaggcgaggaaatggactgtcccctagagcgtcctgaaagcaacacagccccggtgacagctggattgtagccaggtgagtctgtgtcaggcctgtaacctccagaaccgtaagaaaatcaatcttccttgtgttaagctgctaaatgtgtggtgaactgtcacagcagccacagatgaccaatacaaactccactgacaccctaggcaaacctggtgagggctggcttctgggaacatgcctgtgcctgggatactttcccttagggggtcacaatgacttgcttgctacatttgatgggcagggaccattgttcacacctttgaacagtgagaggagggagaactgacaatgcaatcttgcatcctctgaggtcctgaaagtatgtggccaattccagcgtgaggcagccccgaattcaggctgctaaaggacccaggccccatagaggcacaagaatccccctggctgagactgtgcagaataaaaaattgggagaagatgatttttacacatcagctaacttaagaattgtggattttgaactttaacacacaatggcaagaggtattgattctttgactttaattcctttgaaccttaatgtcttcggacttcaacatgaaagtggatttaaactttgatttttaatttctccatgggaatttgatatttggtagggtttatattaaaatttgaagcatctctacattgctggcatttcattattgaaatgtctgtattcatttttatctttgggatgttgtttaatcttctcatagaacctctaatttgctaggttggacaatgtacctggacattatttggaataagaaataaaactggacttaattttaaatcttgggaacatagtaaccctgaatttggtttaaataatttgctcctctgaccccttttggtgcctcttggtgtaatatatgaattgcccaccaagaattccaggtgatccccaaaaagtgccatcaagatagaagaagagctttcttgacaaattacttagctcctgctctggggagaggggctatgcctctgggtgatcataacaaagagggtgaaggaaaaataggctggggatgttagtgggataaatgcatcctctctgttccagtgtctcctttcatgcagggtgcttcattaatgctatacctgaacttctattaaattagcaaggtcacttggctgaccttaaagaaggcctccagcctggcttctgtcagcaacagagataatatctgtaaacatatttatactttgtttaatattcaaaactgttcagagttcactgtatgagttctgaactcatacaggacagaagatgttatttaccatggacataatggaatagagaagagaatggaaggagtaattcagacaagaaatttcatcacatttctgtaagatacaaaacagccagaggtgagctgacagatggagctcagggagaagccagcatagcccaggatacacacagaggggaccctatcccagggaggtggctaactttcctggtggaacactaggaaagatttatactcaagagatggcaggcacctggggtgcagaaatgggaagacaagctagaaaggggtgattgaaaggaagtagtcacctctcattctccactttcacctaggttgaaagaatacccagcagacaggaaagtactgtccccttcctccaggccaacaaacaaaataaacaactcagaagaatctccacagagatggattgtgatggggagaaccaaaaaggtactgaggatatttgggccttagagaaaaaccctcctgattaagacacttaaaagactccccactacaacagttccctcccacccattcgccctgaagtgaagcttcactgtgaacaagcttcaccgacatgcagagagctcagaaaaactccattccactattttaaaaataagcagaaaacttgaagaccaccacagatttgaagtaagcctgcaaaatcagtgaaaaagcccaccataaaaaaagaaaagctgacaatgaaaaaaattgagataattcatgccaaagagataaaaacaaacttcagttctaactaatatccttagagaaattcaaaaatatcttacattcataaaacaaaaataggagctattaaaaaacacaaaagagaattcttagaatttttcttttaaagagatgatattctcttgggcccctggtagtgggagcatggaagtcacagaaaaattgggggaaaataaatgttggatatcagtgaattctttcagaacatatgataaaaaggcaaagggctccaaattacataagaaaatacaagagaaataatccaagaggctcaaaatctgactaatttcagaaagagaggacagaggaaatggagacaaaagaattattttaaaagagaagaagaaaattttctggcactgaagaaggtcatgactctttaaattgaaaatgttcaacgatttttttaaaggcacacacctagatatatcacaagagaatttaatagtattaaggttaaaattaaattatagaaaatattcctgagaaaaagaattttccatctagaattgtgtatctagtaaacatcactcatgtgtgagggttaaagacttatttttttagaatttaatgtcctaagcatcccttttcaggaacttatgagagagaaaaacaagagagaagagggcataggatcttggaaacagaagttctaatccaggattgctgtgcaggtctggagagcaatatccaaatccgtcctgaagacagaagattctggaagggacttctatggagaaaggagggaattaatgatgcccgaaatgaaggacaaggttaagtcctcagcccgactccttaactaaaaggaaaggccatctggatatgcgaagcatcagacggatggacactgtgctcctggagaagcagagctctcaagacacgtgctttcaccaaaatgaaacctatttactaagttctatagtttaataaaaaccattttattataatttgtaaagcattctgaaatctttagttgggcatactcaaaattttggtcaattatttccatatttagagagagaaaaattatattagtcaggcccaaaggacgtgcagcatttctaatcaaagtttatttgcttcggagcttttcaagcaatggctagcatacaatagcttcgattggatttaaataaaattatcatcatcatctcatagtaattattgcataggaagaaaattatttattgcaagacatagcaggcagcaaaatatattctgctgtgaagagatattgccgtgcaaacagggagctgtttttttcagcatgcatgtttatgcgctgaatgtaaatgcatgtaaatatctcaattttaactctttatcattgttcaaattgtttgccaagcaatattcaatacataatttaaaactctgcaagatcatttctttcttatttataatttggcactcttgacatcataggttcttctggatatacagctaggtctaatctaaaatctggtttataaactgtgctttagttttttaaaaatcactaaaattgttcttttgaatatttgtttataatatatcctagtctacaaataagtaagaaattcaaagggagacctcaccctgccttcccctgtaattttttgttcaacatttgctctcatccatgagataataggtaggaaagtgatcagaaaaaactcccctgtactggtggggctcctgtaacgtactaagtcatttttctttgctgagctctgtattagatccacgggagaattgcaaaggaagtaaggggtatagttcttacacttagatctttgttttgtttaattcatgcatggatacctgacctaattcctaaacagatttgcagtggctccttgcgacaaaagacgtgaagccagcctttcttcttgtaccctactccacctcttggagtcatccactcccttgcggctcatctagcaagttcccaaaatgtggacatgtttgtcaggcctatcgctttaaatatttagcagccagtgctgcacactcctgaccattcagagcagagcctcaccactgtagggggcactggtgtagacatctccgtggctgcactgtgtggtcaactgagggcatccaaggcttggtcaacagaatccaagctttctctgaggtgaattccttttgcctcattttaggtttgctttgtgcagtgaagctggctttggcttgctttacatcattgaggcaatgactgtgcagatgtcagctgagtcctgcaggtttccaggccccctcaggtttctgtcagtaaggaaactcagaaggctttgtctagagccaatcactagactggcttacagtagcaattcttttcacactagaatgttctcctagatgctctcttccaatttcctttactagagtggaagcttggccaagtggcttgtggattttctaaagaatccatgatggcaacttcagaaaccatgaagttcagcttgtcaacatgttctgatatgtttttctttgagaaaggtgaaactgatggctgaagttcagccaagcacaacatgaaaatgctctagaaaggcagaaaacatctattgaagtaacaaccactgtccatcttaacggatgtggctatcacggcaaaagacagcatttcgtctaggaggagacagacagagagcctcaaacccccagcacatgctgatgaaaacacagtgggtcaagacatgacagtgggtgcaaacctccttcttcttaaaagaagtggaataagagtgtatcctctccatacatcaagcaagcatccttcctacagcctgcgtttcaccaggaaaagaaacaagaggttatgcctttggttttccaaatggggctcacataggaatttctgatgttgcccaggcacacgtgaacggccgacacccagaagctgttggaagcaatgtcgaaggcaatggagtagactgcggtcagttcctttacagctgcttcaaatggcagcacaggataagacacatgctgcagaagatgtcatgtgtcaggggtatgggatttccattctgttttaagccatcattcatctcaacctttggcacgtggctgagtttttctggcaatcagggaagccacaacagaggggttcttctacacaatgaattttgtattggagcaaattcaaattgtagtcaaatccaattcttttcaaatcataaatgaatccatacggtgtacacagaaggtgctctgctggtcttcctttctcgtggcttcatgtatctgttggtggagtcttactgcacggaagcctcctgtccccatcacatgcactgagctctttcttttgcaggcagttccaacttaagcacaacccacaaatataaggatgggtgttcctaaccataatggtaggaaatattttcagttacataactcacccctaaactatcatagatatcatactgtgtagataaaagtacttttactttccctgactcatgtctccccacattagtttggtgtgaaacattgctttagtagcacggcaattttaacaattattattttttccacaaagatgattttctagttatagaaagaaaaaacaaaagaaaaaaaccaatttacatctagttctaatacaaccaagagtgagaaagaaatgtgacaataatctcaaagagtgtacatttaagaaaatatacgaaagttgggagtcttgacccgggactggacaaatatttatgactctctagcttgaataatgtattttctttaaaaacacattttcatctacttcatcagcatagctacaaggaaattttagagttaagacagaaggtcgacggaatcacagatgattaaaagatctttttagacagtcaactatgcaatccatttgctaaatacttgctgatggggtactttttgatgaactgaaaaccaaatatcacctagaatggcagtgagcctgattaagatgagtaagcagcagagttatttgaaatgctgtattgaggccacctgggccattagtactccaagtaacactgcacattttaaaagggagggatgacagcttatggctaacacggactgtgtttacatgtattccatatatgtgccaaatgttttacagagtctcatttatgaaaccttcacgactatggtgtggctactataattatctccattttactaagcccaaaagttctacaatcatgaaaaagctttaatgttccctttttgaaaattccttaatatgtaataattgtgacttttaatagacatgaatatttcatttaaaaaattaactgctaagtaggataagccgtctgttgttaaacacactagaaaccagaatatataccttattagcaaaaactgacacaccttgtcctttgatcaattattattaatgctattctaataaagagccctgggtattgtacgatgctcaactactacttcatccactgacaaaaactgttcatgatcacagaattttagtgaggattacatttactggattattgaatatgaatccatgcatgtcacatctgataccattttcttcagttgtttactcatttgaaaacacatattgagaccgcctatgttattagaacaccacaatatttatttgattagtacatttgcctctgtgttggataatggaaagtttatcttgagatataatataataatttaataatgattctaacctgtgaccagctcccggatctccaggtcagtcgtcttgcggagtaacctcaccagtgctgggatgccaccacagtttttcagggcaattttgttatcatcgttggccttcccatacaccaggtttctcagagctccacaggcactacggtggacttcggtcatccgatgatccaacaggtccaccaggagctggatgcctccttgtctccttatctgaaagagcaaaggacaccacttttgctttacagtgtaaggtttccctacctacaccaaaacatgtttttcatataaagtatctgctaacaattaatcgcaccaaactgaattaaggcatacaaaaggaaacaagaaaaaaataagtgtttgctttatatttgattgccggtatttgctttaatatcctaccaataaaaatccaaatgtatttctttcgaactatagaattttggaaaggtgattttaacttcatattgagtgccttagacatttctctccataaaatatgccacaacctcatggatgaagcacatgaagaaataaaaggcattagagtgatcctcattccctagacttattaaatttaaccattgtcttaaagggctgcaggaatgatacacaaaatgttaaaattatgcttaatagggatatgctctaaacatttcaaaggaatcagaagcgaaacgagagactggaagaattgacacaaggagttttatctcagaagacccgcggaaataagaacgtctcttacatgagagacagaaggtgtgaggccaaggcacgttatgcttaatttaggtatttgattcaacaacaacaaaaccactctacattttactcttctttttatcaaaagaaaattttaatcttttataagtaaatgcaaaatatttttgctgtgtattttgagatgcatgttctcctggctgccctttgatttggggaacaattttaaaatttaaattagaaacaaaataaagtggctacttaacacacaggctatattagcaaagctgcatctgaaaacttttgcatgtatatggacaaagagcatgattcgtgcaggaatacccttcttttacactttatgcttcaccgttcttcagggatcgaaggattagcatcttctctacttaattttttgattacagaaaaactcattcatgtcacagatgtgctgggacacctggctacatccccagcctctttcttttctctttctttcttttcttttttctttttctttttgagacagagtctcgctctgtcacccaggctggagtgcagtggcgccatctcggctcactgccagctccgcctcccgggttcacgccattctcctgcctcagcctcccgagtaactgggactataggcgtccgccaccacgcccggctattttttttgtatttttagtagagacagggtttcaccgtattaaccaggatggtctcgatctcctgacctcgtgatccgcccgcctcagcctcccaaagtgttgggattacaggcgtgagccaccgtgccaggccatccccaggctctttcagtagtgcccaagtgctgctctgtgaggtgactctaaccacaccgtttaaaactgcacttagaaccacaccctcaccccaagccagcattcttgtttatcttcaagtgctattgaattcttcataggatttgtcatgttctaacttatttgttatgtttatcattattgtccgtcttctcctgttaggatgtgtgttctgggaggaaatgtctctgttatatatccctatccctaaacccagtgcaatgccagacacctcataaatgttcaggaaatatttgtcaaatgaatggagagggttaattaatatattacttgctacgttggtgttgctcagctttgctaaaatagtgttttcaaaatgaagaaatatccctctttaaagacaacaaacaaacaaacaaacaaacaaacacctcttttgtgaacagccaaggatgtatccagaggcctcagccctgcagctcttccaatccggcttacaaacaaaatagagcatgcttcattcatacagggtggcctctgatgattccgaatatgcctacgggaattattttcattcatcagcaaatgaaagcagaaaaagtggaaatcttcagagcactcttggactctaaatccctaagttggaaaccatgaatgcagcgtttcacatatggtgcctccaagggaacatgacagggaaggaagagggagggatgtagagggacagtgtggttgagggggttatggttgcccagcctgagggtggtcacagcacctgggtaagggagactcaaggatcttttgggtcaaataaggaaagagaaaaagaagtgggaaacaactttacccaacttacagttctacccagggcttgcttggcacccacccaagagagatgatgtttgtattcctatataggtgtcttgttcatgtacccagattataagcacatccactttattatagtgcttgagaagggatattccacgtgtacaaaaaaggttaaactatgagtatcactttctctatgagtgtatatttgcccatgtgtgatttagttcaaagttctctgaatttagttatttaaataatgatgaaaccattgaaaagagataataaatccattcttgcagtgaatctattggttatgtactaaaaacagatggcatcatcaatcaatctatgcattttattcatatgtatatattttagctatattggatgttataattaatattcctaatttattataatacatttccaattcatatgatttaatgaattaaatgattaaaatatattaaaagggaaaatgaattcaaactgaatgcagcatgaattctaaatgctaaaatgaaaacacaatgttttcagtatggccctaattaatgccatatacccaaatttatagtgagattttcaatttgattttaatctatttagataaacataagtaagtcaattaacctttttcttttgctcttatttggggtcaccagatcctctatattaaaacttgttttcttggggtttaattttatctaagaatgtgagaaccctacttctgttttctgaagccaaacattactcagaattaaaatgtaaatggccacatgtgtgaaatgggatggccaggtccttggttctccctcctccccctgcagcctcccctctcccatcaggaccagaagggaggccctgacatggactccagtcctcttgcttctggtggctgtgcgtggctctgatgctgtccttttcactttccctctattttgcttttctccaggatccttcctttctccaatttcttttttttctttttctttttctttttttctgagatggagtttcgctctggttgcccaggctggagtgcaatggcacgatctcagctcactaaaacctcctcctcccgggttcaagcaattctcctttctcagcctcccgagtagctgggattacaggcacatgccatcacgtctggctaatttttgtattttcagtagagacgggatttcatcatactggtcaggctggtctcaaactcctgacctcaggtgatctgcctgcctcggcctcccaaagtgctgggattacaggcatgagccaccgcacctggccccttcctccaatttcttgcacccaatccatctaccagtttcttctggtacctaacatgcaatctttccaagcttccaaacaaacctattttaaacacttaaaatgtacaactttctgaaaacctatcagaagaaacttgtcttctttgaaatggcacctttatttattctcccccaaaacgacaagttgtctagttccaatttatccccctagtcgatcactccacatccagcaagctgagcccaggtttttgttaacatatgatcattgcaggtcagtttaccctctcctcacattattactttaatcatcttcatgcaaaattgtttttgttttgttttgttttgttttgtttttagacagagttgcgctctgtcacccaggctggagtgcagtggcgcgatcttggctcactgcaacctccgcctccagggttcaagcgattcgcttagaagacatgaggtttcgccatgttgcccaggctggtcttcaactcctaggctcaagcgatttatccgcctcggtctcccaaattgctgggattacaggcgtgagccactgtgccaggcctcatgcagaattctttaaaagtcaaatcttgaaagattttaggtttcatagcattaaaataaagtcaataaaatgctagttaatgtatatcttgttatttatatataattcaacaataaaataaaatgcatacaaatgattaaaatggaaacaatgaatgttgaattacatacggggaaatgatagcttcatttgaatctagactgaacaattctcatatctgctactttcctggacctaatagaattggacagtgaccagaagggacttttcatacttgacctgaatagacagtcttaaactcacttattgagtttaagtgagtaaagtggttctttgacaaatgattgaccttagtcagttgttcctgtgtcaatggctcacatttatttttctgcttagctgtgcacttcaggaatctagatgtcgagagtaatctacaaggagtaagggaggtggaggctggtaaaccccatccccaggggaaacaaaagatgaattaaccaatcaaataaagcaaaactatgccctgcctgtcttttgttttgtttttgggttgtttacagtgagggcattcttgaacctgatgcagataatctctggggaatgaacactagaatgtattcccagtttgcaccaggggagaataaaaatggttttcataccctttgccctaaaatccgctgctttgaagtatgtttacagtttaaactctagaactgagagtatctaaaaatcatgcaaaagaaggatgcagtgggtatcttccttgttttttccttaaaaggtagaatatatctaagcctttcaaatcagaaaacaaatggataggtaattaaattatacacaagagatatgcaagtaatgcaatagcacctattgcaaaaatagggccccatttgttactcttaacataatctgcatatattgacaatagcatatatttgccaatgaattagctatcatcattaaactgatatcaacatcaatgagtaatttatagcatattcaattacagcagtgttcagatatttatgacagtcttcataaaaatgtaatgataatgatgatgtatagtggataaaaaaatactttaaacagcttgcaatagaattcctctcgggaggtatctgtctttatttaaaaaaaaaatactatgacaagttgcttagaggatagtgagaccccgagggcgtggcctcccaggcattcagggcaacagaagatatcgctcacctgctctgcatttgcaaaagggagggatttggagctgggaagagaagacagaaaaggttggagtagcttttgtcaacctattatttggtgatacaaggacctcaaaacaggtaaggacctgggtgtgtgctgctattcctctcaggaatctttcattttaataaaatggatatatctttaggcttctgggttcatgctgaaagaaactaggctgtgcctgagactcaaagtaaattttaataatagtgtgcaagactatcgctacatactatatatatatgtatagcatatcatatatacacacatacacatatatagtatacacacacacacaaactatggatactatgtactatagtaattactttcttcagatacttatgaaaactcaagtcccaatgtctgagaactggtttatagaaagagctgattaaaaagaagataagggaatgcggtgatttttttgctaaattttcaattaactgttatttttcaatggtactggctttgaaaaagctttttaaaatgatataattattacacattcttttttaatattacaaaattccaataattttctctgcttataagctactggaagatacaaattttatagatcccaaactagatgactaagcagatgtatgtagaaattgcaaggttatcagtttgtaaaacacacaatttacctcactgaatttcaagccttactcttattgaaaagccagttaaaccatcagtttccataaaatatgaactgaggtaagtccatgtagttgcctctgagtaatacagaagtatatttcataaaggtcataattttttagtagaaattatttttgagaatctctctccttccaattgtatgaaatggcctgcgttctccattcgataggtgaaccaagatgagctatgtttctttctcaattgtgttttcgagagaaagcacattgcagtgactggaggtgctgcctcagacctaggttcaaatcaaatcttaaaaccggtttcccccaggcaagttacttaaatgcctgtaaagcatgaacaaagtgtgaacctacctcataggttgttttcaggactgaatgagatttcaaaagtgaattgtttaacaaagtactcagtaaacattatgtgtcacagaaccatccactgtatcaactttttaaaggatattcttaattgctttcttacccggccaaaatacaaattaatttaataaaatgttgatatgtgatagtgaaaggaatacaatttagggtttaactttataaactggatttaggatgtacggtatatatcgaatagatctcttgctaactgtgagacgagcagtgaagttttctgagaatgaagcaggcttggaggtcaaatgcacctcaaagctgtttttttctggcaactgtttttctgagagcagacaccctccacaaacacacttgtgagtcctcagaattgctgaacaccgtaaatgagtttcaactttactcattaagtgcacccaagaaaggcctctccattttttttaaacacaaaaaatttcaagcgattcctcaagtttcttttctaaagacaccactcaggaaatgtgatcttgataagtctaatggtttctatcacttcgtgtaaattttgagctgtccttgcagatactgaatgcaaaaatcacaaagcattgacaattacaaagaatgcctccagtaagtcttagtgcattctgactaaactcaaatgtgaatttttatttccacatttagatatttcatgatgctaaaatcccatgattttctctaaattacaaagtgttgatgaacccagactagaaagtacctaagaaattctagggcctggaataacttgaataactgctttccctgaataacttcataacatcatcagtcagaggcaaatatcgtgtggtgagtgcagggtggatttctcctcccaagaccatgttcccaggtttaaaggctacacttacacttactctctctctctctctgactactatcctatctctgcagatctgtacatacaatctgttcaagcagatatatgctctacttcacagtaggagatttaatctattggatgtttcataagaatacatgctacatatataccatggactactatgcagccatataaaaggatgagttcgtgtcctttgcagggacatggatgaagctggaaaccatcattctcagcaaactaacacaggaacagaaaaccaaacactgcatgttctcactcataagtgggagttgaacgatgagaacacatcgacacagggaggggaacatcacacactggggcctgttggggggtgtggggcttgcggagggatagcattaggagaaatacctaacgtacatgacgggttgatgggtgcagaaaaccaacatggcatgtgtatatctatgtaacagacatgcaagttctgcacacgtatcccagaacttcaagtatttaaaaaaaaaaaaaaagaatacattcaaggcctcatgttatttaactttattatatcaattacatatagttagtaccataccctaaaacaaatattcactgtctataaagatggacattgtttaaaatatttaaagatggatggtgagggctgacacattctttctctctcacttctctgaattctgatctttcggctttttttgtgtgctgctggacagctctcatcctccccacctgattaagcagaggtctctccttaggggcctggattagatttccttgcctggactccaaacccaccactcgcctttgttattggctttagctttgtaagtccttgcttcacagctaactgagcagactatttgaacttgaacttgactctgagaaaacctgccactactatggcatttaagcaatttttaatccataataaagtgaagacaccggttaccagccttatcatttaaccttgttgtgggtgtgatggtcaatagagtaaaactaaaaaactgaaataaggaggtgagtcatttggaaaaaagactcagattatcaagattgatgaaaaaaccttttggaattaattagaaaattcagtaaaatacaaacttaaaattttaaaaatgaaagcttcctcatggatatatataaaaattcataattttcttatatactaaaaataattggtcagaatattaacagaaaattattccattcagaaaagcaacatggtatagaaaatacttaggaaataaatatgttatgaattgggaaatttctgtatgaagaaaacgacatgtatttactgaaatacataaaagcagatgtgaataaaggtaaatggactaccacattccttcagtgttataaagatttccactggtctccagattaatttaaatatttaagcagttcaaatccaaagcccagtaaattttaagttgtttttggacacagtgacactaaagttcatctggaagaatgaacataggaaaaaaatcacaagaaaaatagagaattatggaaagatgaacatattctaaagcaccaatatacagaacaatatgaaatgaccccagaatcaatagataacaatgggagagaagaaaaaaactccagaaaagatacacatgtttacaagactttaggatttcatcatgaagcagtatggattcgatacctagaattagtaataacaggctcaccacataagggatgacacagcatttgatttcttcacaatgacaaaaagtaaattccagatggattagaaatgtaaatgtaaaacataaaacaaaaaagcactagggggatctacaaatggatatttatatactactgggaagacctaaggttgatacaaaagccaggagccataatgaaaaggaccgatgcacacacattataaacaaacttaaagtcgggtggaaagaactaaacaaaatattggctacgaacatgatagataagaagtttagatacttagcattgctaaattcttccttgaatttaacccatctattggctgtaaagtgatatctctttttagttttaatttgtgttttcctaattaccagtgacgttgagtctttgaataaattctttaccaaagaggtaaagaatcaacatgaataaaattaaagtactttactgaacaatataaatacaaacattaataagtataaagaaatgctctgttcatgaatgaaaagagtggatattgaaaaggctataaattccccaaaatttatttatacttttaacacaatttcaatcaaaattcaagggattttctagaacatgacaaaatgattctaactttcatctggaatattaagcaagcaataaaaagtaagactatttcaataaggaggaatacaagggagacattattttatctcatttataaatgctacataaagcctcaatagttaaaacgttgtgatactgatgtagtagtcaagatggcttagtggaacagaatggataaccaggaaatagagcccagtgtacttaggagctaacgtgtgataaaaagaattacaagccaatgttaaaggcctgaatcacacctaaaggtcttagagaagttgactatagatcatgtacattccaagaatttaagaactaaatgaaccaaataagggcaaaaataagttaaaggaaatctatgagatttcaagaatgaatgaggagtcctgaacacaaacaagaatggaatcaatttaattccaaaagtaataactgtatgcagatataagatactgcttcagctttagtatcctagtgatacagaggccgaggtgggcagatcacgaggtcaggagattgagaccatcctggctaacatggtgaaaccccgtctctactaaaaatacaaaaaattagccgggcatggtggcaggtgcctgtagtcccagctacttgggaggctgaggcaggagaatggcatgaacccaaaaggtggagcttgcagtgagccgagatcgcaccactgcactccagcctgggagacagcgagactctgtctcaaacaaacaacaacaaaaaaagtgtaaatataattttaatatatccttatagggaagcatactatccatactgaagttaggatacatctttagatggttcaggtattcacttccttttctttctcctcctccactccctcaatacaataaggatagagtgtgacactgggtagttttatagagataatttaaataaagatataagattgggcgtggtggctcacatcagtactttgggaggccaagatgtgcagatcacttgaggtcaggagtttgagaccagcctggccaacttggcaaaaccctgtctctactaaaaataccaaaaattagccaggcgtggtggtgcacacctgtaatcccagctactcaggaggctgaggaatggggatcatttgagcccagggggcagaggctgcagtgagcctagatcttgccactgtactccagcctggatgacagaggaagactctgtctaaaaataaataaataaaaataaaataaacaagaaataaagatctaagactgactgataacaaatactcttcaaatgccggtcttactttttaaaagaaatagtcatctcccttgagcataaatatctactttttaggtgaatggttactaatctaattatctcttcatttggagaggataagatctaacatatttatttgtatgtggcaaagctaaagtcacagattgttcaacatctcaaagagaattttggatgacctcacataaattttgaaaacacacaccccaaaaggtagataggtaacttaattatttgaaaatcattaaaacatctaagaatgtgattataagaggcccacaaatactgcccacaaagctttcattttataaggactggacagttgcttgtttggcaaatgtttcctgtgggccttgtctgctcaaggtgctggggcttagaggaggtgagatgggccatggtccctgctggaaggagtcaaggaacctgtggagtcaggaattaagtaaggaaaccaacaagggagcaaatatgacctttgcaataatgaaaactggaggcggctttactgaaagaggatctcgcaattttctagtcattattttgtaatcttctgcttaaagaagatccactaaacggacaagttttaggtccatcaacaactgggttcttctgggtgataagaaccaaaaagaagtcagagaaggaagaaaggataaatagggtgtgatggtgttgccggggagtgggtcagcgcacactagagcaaagactcagtgacatgaagtgacagaggccccaaggagagggagacctggaaggcctgtgtgctagtgatgagcaaaagagaggcagtggggctgggggaggcgagatgaggttgcagggccctgggtttactctgaggaagacaggaatttaagttgccctaactcattgcttttaaagaccatgtgccatgtgaggacagactgaccatcagctagggccactgcccttgtccaggtaagagaaccacagcagcttttgactgattgacaggagtacaagcactaaaaaatggccaaattctaggtctgttttacaggtagggtggtaaatatcaagtctgactgaaagaaaggaatcatgcgtgactacgatttggggccttgggcttttaataaatgagtgtgttgataatcatcacagcagtagtttttggttgactgacagatggcaaagcagttcagaaagacacagcccttcatttaaatttctatgttactggcatgacaaaagcacacattttaaaaactgctattcttttgttcatgcaaaatggaaaataacatctttctaaaatatagagttatgctaagtatacatgcagaaataatagagaaattgttttgtgtcttagcctatggttgtaacaaatgaggagtattaaattaaaagtaatatattccaccaaaagaatttatgatagaaatgtcgagaaaattttcttacatatttattttaattttaaattaaaaatatactgactttaaaaaaatttaagtcatctcaagactttcattaaaccggtaaaaattgtatagaatataatttgctttattatatgtattacatgatggaaagtattttttgttatgcacatatttttttttctttctattttaggtgacggagtctctcatatgttttgaagatatatttttgtagtagtaaaagccaatgcttaaccacactaaactgtggttgagaaaataattccagttttgttcagttcagctgatatttattaagcattggtccacattccctggggttgtcatggtttagtgaaggggatacacacaggaacaaatacagtgtatgaagcccacaggaaagtcacaaaaccagcctccttaggaaatggggtggggtaattgtttctggaagaaataccagctgaactgacttcttgggagttgaaaaactggtgacctatacaatgtagtacacgattaaactctcaaatgcttggagtgcagtaggtccacgctttttaaagttgagagcacatatggtagggttcagggaaaggacaggcatcagtatgccagacaatggtgcctcttcttggcccttaaattcacccaaagattgggggccattatttttcatactaataaagacttggagactttacgaagtagaacacaagatgtatgggaattttaaagccaaagtacagaatgtaagagcgtggcacgtttctagagagctgctctggtcaacaggccctgattcctggagcccacatggctgaggcctggctccacagagagaccagcagtggaaggctggagagtgggagctggtctcggtaagggcctgggcctgggcctgcacggagcccctcccagaggtaagagacagggagcgtgggggatgctgggaggagactagactggagctggcactgaaaaccacataaatgaggaaataaacacataaatgaggtgataggacccacacatggtttctgggcaggaatgacaagggaggttgtggccaggaagacatgagaacaaatttgagagctggttcaaaagaaggaattatccatcatgtaaaagtgtatcttagctattcaatggtttgaccattttcctgacacctagaaatttataagaaatttatagcataacacacacaggggtttctacatctctcaaccatttttgtttcaatcaacttaaatgtttttactccaatagctctgtgttctgagccccagcaaggtaactggtggagccatcttgtgtttctgtgtttagctcggcctccacaatcagagggtggaggccgctgggatcccagaggctgagcaaaaaggaaaagcttaagttccaccactcagagctccccggagctccccgaggagtctgctggatttgaccactatgacccgctctttcgagactccacaaactgaaccatgtcaaccttattttttcacatttctattgaacacaaagaaagctgttaccagggaaatctgtccgcaacaaggcaaattgaaatatgatttatttaatggtgctgctcagctgattaaatattattcactcttcattttgtccttcagcccaagcagaacattgatatgacacttggatcttggtataagaaaatacacatttggtgcatctgtgacccttgaaatttacaaaattatgtaccaaaaaatcccatcaagtgcaatgcagtgcatcccacactgatgtgtcatcctaatggagaaggagaccttctcccaggcattccatggaaggccactgcagaaattctgaaggctcacaactctcctagcagtttgggggttagtactgctatgttacacgcatgccgataattttatatgcacatatatatatatatagtataatgtcatacatatataacaatgtaaacatatatgtccataagtaaatgtatacatttaaaagtgaaaatcgttcagaaaggtcttctcctccttccctcaccaaaatgggattcattcagttctttatactattttattccaatttaaagcttgtagcgttaattttctttttttcttgtaacccaccacttgtgggttcagagggcctgcctgtaggtactctcctttccaataattcaaatagctacagatgttgagaaggctgttatttctttaataatttctgttcaaagattttcagttctggagtgtaccagattcaatggctataacctcaataataaatagtaaaatgctctgattttaatctactttcagaggttagttcttatcagtgaactcttttaaaatctttcatgcatgaaatgtcaggtttataaaaatcaagtttctttgttctctgttttatttactgattttctaattttgcatttaaaagaatacaggctatataaatacctttgtttgtatttttaatactttaaaaattttcagatgagttatttgtttattgcatacaatttttctccagactggaaggaaggcaatgattatactctcagatttcaatagaccggtagatgctgaggactaataacgaagcagggcctttaggggagggttttttgtcttttatttctacattctgcacacacagtagtcaaagtcatattttcaaaaaacatacgtaaccaatcagatcatgttgatcactgctcaaaatcctctaatgattcctgccacatttagaagatcattaaccttggccttcagtcctgcctgacctgccttgtcttctctctgcttccatctctcattattgtttcttactcacttcggcttccattgccttgggcttctggaaattcctgagcaggttgttctcccagagtctgcagagtagcttctcttccatcatgcaggtgtcccctaaacctgattagccatcaagaatgatggtatgaccaccccttcccccttcatcctcaatcttccccttctctaggttccatcttagctccatttaccacctgacatatttcacatacttattggttcattttccgcttccatcctcacccagagagatgtcagtgctgtgagagcagagatcttgcccgacttgctcaatgctgtgtccacagggctgagaggagtgcctggcagccagcagacattccatatatccatgtcatctttagactgagcgcagttttgactactgactttgaacttctgcaatatgtctgattggaacgtctgtctgtcaggagaagtatcatatatcaagcagattcacacttgggaacaaggacttccagtgcctaagaagatatctcggaaactcagaatattatacaatcatgaatatcatgacactggtctggcaaacatcatgcacctctaaaaatgtttttcttacagctttatctttttatttcatgaagtgagagtaattttcccacaagtacacgacagcactatgtataaaatgcctctgccctatgtacacctgcatcttgtttgtgggagccagtgctgaatatattagctaattatagatatgcagatgccttgttttctttaatgcaaaaatatgtaaaagcatgtgaaatagtgtagcactcaggtccatggttgaatatccaatttccattaaatgaacttgggttaaatagtaaagagacagataaagtcggaacaataaggaagattattcataattcaaaatcttcacattctgctgtcactctttaggctttaagacactaaaatggggaaaaatctaaattgcaaaacaaattatcatccattgattcatttattaggatgttcatcacagagaaattaaacacacagcctggaagactaccaaaagggggaaaatgttacctttgggaactctcagagataatatggaaaactgttaggtatttactaatatagatatgcttacaggggtgagggaaatagtgattttgaatgacaaattaaagaaattgtggtttacattgaaattttcaaaaggggattttcataacgagagttgggacttattcaacatataatcgacacatttgctttcaagaccatgtggtcattaatatggaatggattgatgtgaccagccaaccaactagtcaaaggaataatgctctgttaagtggtaaaaaatcctgaatcttatctgaaggaagatagctccacagagcaggatgtaatgtggcatcctgcaggcagacgtgcagctgtgcagggttcctctaagagctgagagagcattttccgcactctaatacacggtggtaggcagaacaatgcccccccaccgccaccctataagatgtcaatgtcccgatgcctgaaacctgtgaatacatcatgttacacggaaaagaggaattaaggttgaagatggaatgaaggctgctaattagctgatcttaaagagtctaacattaactatctgggtgagctccatgcaaccaaaaagttcctttcaaagccgaagagagtggcaggagagtcagaacagaagaacaacagtgtgagacagactcaaccagccattgctggctttgaagagtgaaggggccatagaccaaggaatgcaagaagcctctagaagctggaaaatgagagaaaacagacttcaccctagaggctccagaaaggaacacaaacctgccaacactgggatgttagcccagtgagaccaattttgcattctgagccccagagctaccagatagtaagtgtatgtcgtatgaagtcactaagggtgtggaaatttgttacagcagcaatacagtgctcatacataggtggaaaatctgctgcaaagttatgtgctcatgaggagcacttcaggctcgctggataagaagtggctgctttgatcagcacacctgcaaacagcagagggttgctgtgcccactcattcccaaagtccaagctgctccctccaggaggttgtaaccaatagatcatcctcctgctataaccaccagggctcattctttggctgctggaggaggtgcctactgaaggaggtggatctatattgcccgcctaaatataagtctgataggaccaaggcaatctcaatgtgtgctgtgcacacattgcacttctatgtaccaagaagtaccaagtgtgaagtactctttgtccattttcttgactcaatggtcaactcactggccattgtccacaaaccactgttaaatgactctcttttcagataatttcaatgacggaagacagaaaaagtcttcccaaggtggcagattgcacaatggatggctaatcctgtctacacaagtaagaaatcgttcattataactagcatcttttcagatgagtcattcaagagaatacagcctggtcaactgggaagatgtgctctggtattttggttttgctttttgtcctgttaacattaactttcccacaaaccagggaggaaggaggtggcttttcaaaagtgttctccatcatcttgtgctcttgtctgcaactcctgttaatatttatcactggccttgttctgataaagagtcataggcagtgcctatgatttcattgtggaaaagaatgaagcatcagaaaggatgcagagagacctgaattctgaggcttcctgctcatgcatttagtggacatctctggcataacataggaatttattaaggaaatccttacatttaattagagagttttcaaggcagaccctttttatgtctgtatttgaaattttccagggtctaacaggaatttcaggccgaaatgtctcctagggatgcaagcattctctaccagtgcctaagagcaagccactaatcacttttcaaaaggtaagtatttaatggtggactctggtggtcagtatgttcaaaagcttaaggttgtctttctgttgcccctactagcttttgccatgaactccaatctctttgggtgtttgttgctatttgggtaaagcagtttgtggatcttaggcatccaaggttgcggctcatattattatccactgaagaccttgagagcttcttgttgtttgggaccaccttaaaaaataaatccctccctccctcccttcatttcttccttctttcctcccttcctccctcccttcttcctccttcctccttcccttcttcctccttccttccttttcctcttcatctgtcttttttcttttttctcttttttttctaatgggacttaacaatatccctgaatataagataggatttcttcaggatccaaggagttgtaccaagtgttatatttcttactcatttcagggtagcatcagggaaatattttttcgtcagttgacaaatatccctgattcttcaaattttccccgttgagtcatcctcataattctccagaattgacaagccagcatcatcttgtcatcggagtcatgctggtgccaactctgacagtcttctcatttgtaagcccgataatcattataccagtaaagttgcatatcagagtatcttttatcattagtaagtctggatccctacataaaagttttgggccatgggtaagggaatgagcatatctttgtgtgaaaactgttaaaatagattgtgtgtgttctctcaaataaaggcaaattgagattggctttttctcagaaactaggattgaaaaaaaaggcatttttcatatggatgacagtactgtaagcccctggtgcctaccaagcttcctttttagcttgaactacgttgaatactgtcaaagccacatggagcaccactttatttagaccttaataatctataaagtcaacccagaaaagctgactgctttggtccaataagccatctgtatagagaggtgttgcgagccaggagaccagcctctgtgacatccttagttaatacagatgtcaccagtcccttcccagaaaatccatcttgttttcgtttggggattgctgggtctttctggcagagaggcactcagtcaatgtgcacaattacaacaggtatacccaccattttcaccacagctgtcccctcatgtggaagctcaccctggcctgcacatagggtgtggctggatatgagatgagacctttcattttaaacagccaccattcctttctctctctgagcagcctccagttctttagtatgatggccaggtataattacactgatcaagctcagtgtaaaatgtggtttcccaaccaatggccataaaagtagcctcagcatgtggtcccagatctctcgctagaagtggtggaagagtagaccagccatccccatgcagtgggggtcacctggctggtcctcctcacccacttcaactattaatcctcccaccatcacaagaatcaaatggagttaaaatctttcttcaagatcaccatgtttcctcccttcctgaaactccagcagggaatttttcaaatcagctaacttaagcataaatactctaaatttcctagaatcttacagaggagagaagaacatcagtttttatttcttttttcttccaaggtatttaggttttacttatcagtggacaagtacttctatgataggctgagtaattctcctccctgaagatgtccaggccttaatccctgtgaatatatgaccttacatagcaaaagggactttgctgctgtgattaagaaacttgagatgggacatttgttctggattatctggatggtcccagtgtcatcacaagagtccttataagaagaaagcagagagaggggatgtgatgttagagtcagaggtcagaatgatgaaatctgaagacgaaggaagagaccacaagctaaggaatgcagccagccttcagaagctgaaaaagtcaaaggatcagaatctcccctcaggacaccatgactttggcccaggaaaagaactttggaaattattcagctctgaaattttagatctctgttgacagagttctttcttctgtggtccaatttcagtatctcttagaatagggtagagttgttctagcctgtgaatagggggcctacttctcactccacctccccaactccactcaccaatcattgccaaacagctccatcttgaaaggggagctctgtaagacaactgaagggaagcgttctgctcaactgtccatgtcactattttatcatttgtaaacgatattattattagtgtcttcacaacatgagagaaaaacagaagagggacatataggagggaaacatttaactcctggtatgcttctccatcacctgtgaagatggtaaaaatccataaaaaaaaaaatttagagtgtgtttgcattacatagaaaagaataaagaacagctgggaggttgtgtctcattccccagtgaagaggaaagaaggaaactggcttaaaagccccatagatggtggcaacagaaaaaatattagttaggttaagcaaaattaaatgaagggagtgccaggcagtcggtgaagtctgagaagatcccctgggatttaagggaaatgcagacaggagcttctactcctcacatctccttcattcggtccatacttggggttccaaagctcacccagccctcctaacaatggcactgtcattgtctctgtgctccttttcatttgtctccattttccctggacccctgcccagacaacagatttgatcacctggggtcagtagcaacgataatccccacttccattccaaagcttgaaaggaaactgtgcagcgaacatacccttctatgcgagggtgtgctgggatgagtcccaggcatgctactggaacgctctttgcccgtctccataaatacttagagattggatatgccagtattattcacccactgctacagttcagagacgttttggcttaacaaagcttgtgtgggcctaatctcctaatatatcacaccgtttccaggggacatacatttcaattgcaagattctttcaaacaatctttggaagttgaagagagcctgtatagatccacaggaaacacagaaatcatcccataagtacaattaaatgcaaataacaaaagagttaatgccaactcagtgttctacttgtcatgcaagaggcaaattaattaagaaggattgtaagtacagaagagcaatgtgaattttgaagagctcttagcaaagcagatttttttttcttatgtttggagcatggttaaaaagtgcactagggctaacaaactagagtagtcatataatgagcacctatagcttttcttgaaacatttaaaaaatatttgtaatgctgaagtgcatctaataggaagacacagctcttccaatcagcgtctgatacgaaatgactgaaacatggtcaagccagaaatttgcatacatttaaagtcagccaactggggcacctgttcaagtcagggaggctcttcccctccattgtgttaactatttccaagatggcacatgtaggtgcccacagagcagggttattatgcatttgtagttccaccaggttgaggaggtctaaatctttagatttagaatgaactggaacaataaacttggaagataaggttggaagagtgatcagaggctcaaaagcagtaagtctaagatcatttgcatagggtggattaatgaaacagagattgcaaaaacataggaaagctcataactgcaatgaaatcttaggagatgacggcgccttataatctatgcatggacatcacatgatacgaagccttcttgtattgtttctctcagtattttcacaaaatgttctctccagttctgtgagccagaaaaacctggagaacgtctggaagggaaaaatcaagaaaatgacagataaacaaggtgtgtcttccttggttcaacgatttagagatttttacttggaaacaaggcctgagcgtgctgagtcggtagcaataagaagccaagtgtcaccaggaggagaaaggccaaggttttgctgccacttcccctacagactaaagcaaaagaaatgaccagaatgccagatgaagaagtttatggtggatataaagttaaactatgtccctgaaaaagcaactagttcttcaggtacaggtcttcttctctaaacgatgacatatcagaaatgcatcaaaacggcaaagcacagtgagaaatccctcagtgagtgccggctccttcacctgtgatgcaaatgcgaatggactgacattcacacaggtcatctgtttcttctgctcaccattgcaaagactacaaaccttttgtgggtgggtggagaggcggggggaagataaaaagaagacccattaaaatagaagggaagcatggcccaaagaagaaatggagttaaaataacccaaagtgatatttagcaaacccagaaaggaaacttcaaagagatctgaaaaatacctgctgcatcattgttcgcaagtcatgacccagtttcagagactgctgtctgactcacgtctgttttgcaaagagaactttgtgtacctggtggttttaatcaggagtcttgcctcgctgcagggtagctacatttcatcacaatattggtctgattccttaacttcattcactttgggctattaaaatggtctccttctggttataaagaaaaagccttgtggggtgtgttggctcacgcctgtattctcagcactttgggaggcaaaggctggaggatcacttgagtctgggagttcaagatcatcctgggtaacaaagggagaccctgtctctacaaaaaataaaaaaattagtatggcatggtggccattgtctgtagtcccagctccttggatggccaaagcaggaggatttcttgagttcaggaggtcaaggctgcagtgaaccctgatcacaccactgcactccagcctgggagatagtgagaccctgtctcaaaaaaataaaaaggaataagcctgtccattttaccacttccatcctttccccctccccatctccaacatcccacctcctgaagcaggctggacgtgagctccagccccctggtgtgcccttcccacccatctccttccatcctgttctttctcctttctcattggaggtgggagggagaaggaagaggtgtttccttacataaaggcaggctagaggccaccaggccactgcctatgtctgtgggccatctctgccaaggtgactcctgggctttagcaggggccagttaggtggctgaagctctctgccaccccatatctttgcatctttggccctacatctttgatgcctacaccttgcttcaccccttctgccatgctcctgcaggaacacgtctaaatccctccatcactagtctcttctctcccctgtgaccctgcccttgtccatcttccttgaagggacctttaagcataaaggaatacagtccttgctcaaagtctggctgaatccctgtgtgatctccccactgtactccagcagcccaaggcaagtcaccagctcagaagctgagttgacagccagttggggaagaagatgccagttttcctttcttgctgcctcctacaaactttaagggctattcccatccttaggccccatcttcccccagtgtagcttcctttcctctcctagttctcctgttaaacttctaaatggaaaagatcatcaaaccagtgaggtctctactgcccctagagagattagctcttctatcaagagctgggcccttgaacttggtcctgggggagccatatctactgaagtctctactcagtgacctctagagccaggagaggtgctcatttggcacctcacacagaactgtcacgctgacatctgatgcgtccctgacatttgggaggagaggcctttgttggaggagccctaaaatctctttagcctgcagggaaaatctccaaggccaagacaagcctcttgatggctacaggatgctagaatcagcttaggtttaggaggaaaaggaggagaaaggagagttaaaaggagcaggcagtggagataggagggtagagaggtatacaatgtgcaaaaaatagatgcatatggcagctagtagcagtggcccacctggcctgggatcccctgcttctcatctgtcccatctattggtaagtaaaaacacgactgaatcaccatggtttggtgtctctggagtccttcttactcggcttttccccctgtattctgagtccatgattctgccttaccctccaagttgatctatacctccacgcagcggtatttgtcctctttagttgtaattctgtcccaggctgttagcaatattgccttcttattatctcctccactgaggatgactcatggtcctttccactcaaagcactggcccaataattcctgagtgtgcctcgtccatcatccttcatgtgtgaaggaccaagccttcatgaaaatggaaaaatatattggcctctggctgcaatagtgctcactgtggatcacatatcacatctctcttgtgttcacaaaggttgtagaccctgagaagctttaacttctccacagagcaaacccctccaccgaggcctggtacactgaccctcagcacattccttgctctcttcttcctccttccctggctgtatttaaacatgacaagattccatatctttttgaaataggaattatagctctgtttgttaaagtcactgccttccttctttttctttgtgctgacctaacttgtcacatgtcacccagctgtttcctgcaggctgtgtgcatgaccgctagtatcctggtggccaacctcacaggagagcttcatcttgccttgtggctcctggactcttccacagtgctgttctggaaggttcttagtcaaatgcccctccagtttctcccacttactaacattctcttatttctgagtctttctggtttacttcctaattatggattacatgtcctatcataaatcattcacatctccttcagatccaataagtcactttgtttttatgacactttctttgtttttatcatactttctcagtcatttttggattattacaagaggctactgtaggttactgggcagccctttttggcttcttttacatcttcctgctgtgaagtgtgatatatgaaatggtgtctctgtggttcagagctctaaattggagtcagaaagtcattgtgagaaagactgcctgtgtgtcttgctaactggcaacagcaacaacaaaaaaaaccaggaacttgtcttgacctttgaagtgggtcaaactgcagtgaccaccacattctggaaaacagctgaatttctccagtattgcaacccctgaacagcgaccaccagtaaactatggacgcatgttctaagtcagccacctctaccaatgataattctccaaaacaacttgtgtaatcactctgagcttccttttggttttctcttaaaatcctctactcccctctgtctcttcagaagccaaattgtttcctgaattataattcctaacattaagacccctataaacaccaccttgtcttcttgaactgcagtttggtctttcacctgttcttggttgacactacccagtgaatttacccatttcccatcttcttcagagattctcttcctcttcttttatatcaccagctacccctcctttgaccatttcatagattccacaacctggtgaagcactgtttcttaagatgtatttctttccaaaccaccctgccaaaaagcactcccagctccttctcctctgatattaataataaggcactggcctacgtggtttatgtgatccaaccctgggatattacctgtctgatctcacctcctacccctcgccacctcacttgctaggttccagccacactctttgttactccttgttataggttgaatatcgtcccccacaaaagatatattgaaaccctagtacctgggacctacaaacgtgaccttgtttggaaatagggtctacatagatgtaatcaagttaagataggctaggtcctaatccagtacaacataagcccttataagaagaggagaagagatacagaaagaaacacgcctagaggagatggccatgtgaagacagaggcagagattagagataaagccaaagaatgctgagtactggcggccaccagcagaagccaggcagaggcaaggaaggattccaccctgagtttcagagtgaccatggccctgccccttctcaatcttggacttgtagcctccagcatcgtgagagaacagatttccattgttccacatctctcagtttgtggcacttggttcccacagcccttggaagcaagcacaaatgagcacatgccttagagatctagctctgaggtactctctctgactgccttcaagctctgctccgaggctacttctcagagatggctttcctgaccattttctacagaatggcagctgcctctcttcacccactccttattgctgtccacccgctttactgtgttgtatttcctccatagcccacatcaccatctcacccatgatgaatgtatgcctgtgtattagtcctttttcacatgtctgataaagacacactcgagactagataatttataaaggaaagaggtttaattgactcacagttccacatgactggggaggcctcacaatcatggcggaagatgaagaaagagcaaagggacatcttacatggcgtccaacaaagagagaatttgttcagggaaactcccctttataaaaccatcaaatcttatgagacttatttactatcacaagaacagcacaagaaagacctatcctcatgattcaattacctcccactgggtccctcccatgacatgtgggaattatgggaactacaattcgagatttgtatggggacatggccaaacaatatcagcctgtatgtgtttattgttgcttccccctactcatgggggtctattttgttcactgctggattattgaggtcaaaaacagagcctgcaactttatagctgctcagtgattatctgttgaatatgaattagttccactttcacatatcaatatatcaagtacttgggtctatatgttgctttatgttggtatgtgcagatggctttttgattctaacttcctaaagggcagtagttgaatctagttgtgtaaacagtggcttagcacagagccacacaccgtgtgtgtgtgttcaatttcctttgctgacaatagcagatctcaaaacgtggatgatgaacaatacaagtattctgtctataaaactatggaattggttttacatttaactgttggaaagagatttccttatttattttgcagcacatgctaaaaataactcatactcctttgccacctgctctgtgctggcagtctacctgtgttctctctgccatgatatggagtctcaacgcagtttcatagtctgggagactgagtctcagagaggtaaagaaacttgctcaaggtcatggagctagaaagtagtacagcagccagggttcaaatgcaggcagcctggctccaaagccgttgctataagctcagtggtatcctctctactgatatttaatcaaagaaatacaggctcttttccaaaaatgtgaaacaatttatgatgaaagaaagagaagaaatgattcaaaggtagttgactgaaaagatgaatagcacattccctcgaactatatgaggtagaaagaactaagaataaagtagaaattatgaagcactttaagtctagtagacaggaaccagtctcaatttttttaacagatgaaatgttctaaatttgttggaataaaaagttatgggggaggggaaaggtatgcatattttatgcacagaaatcaatttctatgttccatacttaaaggtaatctgaatttagccaaaatattattataaatgatataagtatattgcaactatctagtctagacacacagacacacaaacagacaactgcaaatatgagctgtcttccatgagttctaagtgggtatgccttaggttatatttttctggcaacttctaatttaagacttagcatggccatcagtgtaggaagcaggctgttttccctgactccacaaggctgggatgtaagctggactctcgccagctgtggcttcatctcttcatcatgcctaacacatggtattagaatgccctgttggctgggcgtgatggttcatgcctgtaatcccagctctttgggagggcaaggctggtggatctcctgaggtcaggggttcatgaccagcctggccaacatggtgaaaacccgtctctactaaaaatacaaaaatttttagccaggcgtggtggtgaatgcctgtaattctagctgcttgggaggctgaggcaggagaatcacttgtacccagggggcagaggttgcagtgagccaatatcgtgccactgcactccagcctaggcaacagaggagactctgtctctctctctctcaaaaaaaaaaaaaaaaaaaaaaaaaacaaagaatgtgaatgctcattttactgctgtggcttcacctctccatcatgcctaacacatgctattagaatgtcctgtttacttattttctgtcctgcaggttatggatttttttttttttttgagacagagtcttactctgtcacccaggctggagtgcagtggcatgatctccacttactacagcctcgtcctcccaggctcaagagatcctcctgcctcagcctgccaagtagcagggactacagtggggcaccaccatgcccagctaatttttgcattttttgtagagacagggtctggctatgttgctgatgccggtctcctgagcttaagcaatcctcccacctcagcctccaaaagtgctaggattacaggcatgagccaccacacccggccagattccttaaagacaggatctatatgctattgatatttggaccctcccactaacacaaagcaagctatcagtacactcttttgctttccactaggactgaaaatttcatttctttaaaaacaaaaatgttttatagcagttaggatgataaggtaattggaaagattgttaggagttaaaaaaataaaatcaatattgatttcctagagcaagaattcttaccttgggcctgtgtaagtttactatataagatctgtaaacacttcatatataagacagctgaagctactttttgatataacaaaaagtaatcaggtcgaaaccttaaattacatctttatcagtgctggtcaccggacatttctatcaaaaagaaaggagtacaagtcaatccttctcacatataaagtcacataataaagtttgaatttttgaaataaggcatgtttaaaaatgaggcatgttaatagggatggtctatgtttaaaagaaaatacattttccaattatttgaacatttataatttttgttagattaacttaaagttttaaaaagttaattgatttattaacttataacaaaataaaatatttagctgggcatggtggtgcacacctataatcccagctacttgagaggttaaggctgaggaccacttgtgcccaggagttcaaggctacagcacgctatgattgcacaccactgcactccagcctgggtgacagaaacaggccttgtctctaaaaataaataaatcaatagaaatatttaaacatttaaaaataatccctatatgccacttgaaaatgtgcaaacacttttaaaccactaagatacatattaccttgaatgcagccatattgcgtgtgtgtgtgtgtgtgtgtgtgtgtgtatatatataactgtgtatatatacacatatatatacatatatatacaactgtgtatatatacacacatatatacatatatatactgtataactgctttcatgtataactctttttgtataactgtgtacatacacacatatatatacatatatatactcctctttttgtataactgtctgtatatgaaagggggtgccacctgcatgccaactctggtgtgtgcattggaagaaatgggggaaagtacaggcaggaggaacataaataaactgcaatcctcactacccatgaaatgcacttagtatccccaaatcaatgggatactcataatattcttagctgaggtgagtttccaaaagaatgaagaaaggattcattaaaaatccgcaaaagggacatggatgaaattggaaaccatcattctcagtaaactatcgcaagaacaaaaaaccaaacaccacatattctcactcataggtgggaattgaacaatgagatcacatggacacaggaaggggaatatcacactctggggactgtggtggggaggggggaggggggagggatagcattgggagatatacctaatgctagatgacgagttagtgggtgcagcgcaccagcatggcacatgtatacatatgtaactaacctgtacaatgtgcacatgtaccctaaaacttaaagtataattaaaaaaaaaatccgcaaaagttagcaacatttagtcacctcctaaaagatgcttatagtccatacacctgaggaagtgtccatgtttaataattcctctgtctaaaggcttaatttatggtgactttcccaacaatctaggagacagtgtagatgacagacacagttcaaggagcactgccatccatccacactaatcatgcctgcgccctttaaagtgggaggatccacctccatctcagatattcattcacccatgaatacggaccacactaacttactgtgtttgcagcaatcacctgaaccctcactttattccttctccttctcccatcctctttaatttttccttgactgcttttcttctgatcttatctcagtctggctctgactactgcctatgtgactacacttctatctcagtttttaaaaacttgctgatctacaaagtatttaaagctaatgtcctaccctggatcagagaactcagtggaattcaaactctgccttagtcactggagattgctgagctagatcccacccagccctccctcctcagttcacctcactgctgggagggtgatatggtttggttctgtgtccccacccaaatctcactttgaattgtaaaaatccccatgtgtcaagggcaggaccaggtgaaggtaatcagaccatgggggtggtttcctccatggtgttctcgtgataatgagtgagtctcacgagatctgagcatctgacatttcccctgcttgaatacattctttctcctgcccccgtgaaaaggtgccttctgccatgattgtaagttttctgaggcatctccagtcctgtgagtccattaaacctctttttttaataaataacccagtcttgagtagattggtaccaggagtgggctgttgttgtaaacagacttgaaaacatggaagcgtctttgaaactaggtaatgggcagaggttggaacagtttggagggctcagaagaagatatatagaagtacaaaagtttggaagttcctagagacttgttgaatggctttgaccaaaatgctgatagtgatatggacaaggaagtccaggctgaggtggtctcagatagatatgcggaacttcttgggaactggagcaaagatgactcttgctatgctttagaaaagagactggcagcattttgctcctgctctagagatctgtggagctttgaaactgagagagatgatttaggttatgtggcagaagaaatttctaggccacaaaccatccaagaggaagcaaagcataaaagtttgaaaaatttgaggcccgataatgtgatagaaaaggaaaactcattttccggggataaattcaagcttgctgcagaaatttgcataagtaacaagaagccaaatgaacgttaatcaccaagacaatgggaaaaatgtctccagggcatgtcatagaccttcagggtatcccctcccttcacaggcatggaggcctgtgggagggaaaaatggttttgtgggcttggcccagggcctctctgctctgtgcagcctcaggacatggtgccctgcgtcccagatgctttggctccagccatggctaataggggccaaggtacagctcaggccattgcttcagagggtgtgagccccaagccttggtggcttccatgttgtgttgagtccgtgggtgcacaaaagtcaagaattgaggtttgagaacctctgcctagatttcacaggatgtgtggaaacaccctgaatgtccaggcagaggtttgttgcaggggtggagccctcatagagaacctctgctagtgcagtgaggaagagaaacaaggggttggagcccccacacagagtccccactggggcactgcctagtggagctgtgagaagagggtcaccatcctccaggacccagaatggtagatccactgacagcttgcaccatgtgcctggaaaagctgcagacactcaacatcagactgtgaaagcagctgggagtggggctgtaccctgcaaagccatagggcagagctgctcaaggccatgggagcccatctcttgcatcagcgtgacctgcgagtgagacatgaagtcaaaggagatcattttggaactttaaggattaatgattgccctattggatttcgagcttgcatggggcctgtagcccccttgttttggccaatttctcccacttggaaaagatgtatttacccaatgcctgtaccccattgtatcttggaaggaactaacttgtgtttgattttacaggcttataggtagaagagacttgccttgtctcagatgagactttggacttggacttttgggttaatgctgaaatgagttaagactttggggattgttgggaaagcatgattgcgttttaaaatgtcaggacatgagacttgggagggaccaggcatggaatgatatcgtttggctctgtgtccccacccaaatctcattttgaattgtaataatccccagatgtcaagggtaggaccaggtggaggtaattggatcatgtgggcggttccccctactgctgttctcatgatagtgagtgagttctcacaagatctgatggttttataagtgtctggcatttcccctgcttgtactcaatctctcttttgtagaaggtacctgaagaggtaccttctgccatgattataagtttcctgaggcctccccagccatgcagaaccgtgagtccattaaacctctcttctttataaactgctcagtcttgggtatttcttcatagcagcatgagaatggactaatacagaggggaactgaggagatggtcttaaatccaagttcactagagcagcaggaaaagccagggatgaggattttatctgctgacttacggaagcaaattctcaaaattgcacatataagatctggtatcattttgaaaaaaaattgatgttcttggctttattatatgaaaaccgtacaaatcacaggaataaggaacaagaaaggcatgatttatgaccctctgcatatagaagatgtagttctgcccttcgttcaatggcctacccattgtgtgagcaaagtcaatatgaatgatgaaatgtagactgaagggctaaatcagttcaataaaatgcagtagaaagactagaggactgagtaaatttggaaaggctagtgcctgcaaaattagtatttggacaacaggtaattacaaaattcaatgtctgtgtatgaaaacacgacaggcagccatctgtcacaaaggtagaaccaattactaacagtttgatcttggagtgaggatgagagaacaaaatagatctgtgtagaatccttattagagtttacgtgtctgtgtgtgtgtgtgtgtgtgtgtgtgtgtgtatgtgtatatgcacatatgcacgcctccctatgtgactgaatgggagaaagaaagggaaactctggaagcttcctctgtgttttatttaagccttttgcacttcccatgttcctttggctaacacttactaacttcaatctcattttgtcaactcaggatcagggtgcgcactcagtcatataccacccttcccttccttctcatcccagcctcccaggtcccctgggaacattatcatggggcctggaagtgtttgcagcctttagaaggtagcatggagggctgccatcaataacatgaactgctgctaggagtgccagctgctgggggccaccccaaacagtgagaagtgatacaggcaaccttgatggcacccacagcaaaattaaaaaataaacagaagcacacatatgtacacacacgcagagacagacacacacacatatgcacacagagacacaggcacacacacagacacatgtacacacagagacacatatatacacactgacacttagaaatatacataaaataaaacaataactttagtgtcttaaccgttcctggccaaaaagaaggtggatgaatgcacatttcgctactaagcagtttgtatatgttaagtcatttaattcttgcaaagattctacagagaaggtatcagtatcttcattttaaagattagaaaagaggccccaggataatcaggtagttcaaggtgactgagctggtaagcaggaaagccagcccgggaagctcatccatctgccatgactcatgtgctggttgccccttcactggaaggcctgtgttcaccacagtgcactgggggtcattctgatgtagccggaaacaagtctacagctgctgtcactacagctcttatcaggtggcattgccactgagaggccccaaggctggcccatggatcacgtttacagagccagttagaccatgacttcagacttccctgggccatgaagcctgcattgcctggccgggtgactccttgtaatagagtctgactctatctcttgatgtttgacttctgacagctttgaagcctcacccttccttcctctgccccacatctgagcaagctgataaaactcaagagcttccttttttggtatccgcaggagtttcaacccgtacaaggcccagtctgcatgtgagaacccacttcccacaaccataaaaactccacgacagtttcctttccataagctttctcaagacaattttggacatgcctgggagccactgtgcttggcctggaaagcctcactgtgtaagtgacaccttttcaggccctcttggtgtgtgagtcatgccagcaaccttggcatcagaacaaccaaattttgggtgggagtccatcccacttcggcggggcactacaacactcttgaatcaattcatgctaacgatgaaatgaaatgctttcatgaccttcagagaaaccctcaaagttatagtcttcaaaaaagaagactgaaagaaaagttatagtcttcaaaaaagagaaaagttatggtcttcaaaaaaagacaacatatgatgatggtatgtgatcccccagtcagaaatctgtcctttattttgcatggccattgttttttctattaaaaatagagaatgactaagttaacatatgtttgggacaggagtcacgtaactttaatgcatttttaggtcactttaacagttggtattttttcacatttaaaatttttcttagatggacaatatttctctatatctaaactttggcactgctgacatttggggctgggtgattctcttgagggggctgccctgcactttctgggatgtttggcagtatccctgatctctacaagggatacccacagcctcctccagctgtgacaaccaaagatgtctccagatatcaaatgtaccttgggacaaaatcacacctggttgagaaccattgctctatattcattccacaaagaaacaggactttcctgataagaacaaacatggaccatgttctttgcagtcccaggggaagagagatggaaaaaataaaaagccatgaggctatgtatatcccaatgcaagcaagcaaaatctataataaattgcaattttatcttcaaatctctctttccactcttaaactaatttagactcatcctcagaattgcttacacgccataaagatgactcgttatagtttataaaatctttttgaaaaaaatgactactcagttccttatacgcaaatgcttgtcccttgtctaaaaaacttagatttggctgcagtgaccactgtgattttccaaaaatatcacacagcataatatatgcacttcatgtatcccaaaaacacagagcatgttaacagttgtttacatgatggacatggacaatagtctccttaatggaacacatatccacatttaatccattattcgtttgtaaatagcaccaaacacttggttataacacaaagccaatttagtgcctagagtccttatcctgtcaatgagttcttcaggaaggacaggtcatagcttatactgactataacaattttattgtaatttggagataacaattgatgtttagtatgtctttaggatttaggggcagagaaaactcccagagtcggaattgggaagagaaagacaaatcacgttccaagtatggcatttgacaatccagcctctattaataactagcatacactattggtcctctgttcctcggtattcaaatactaaaaaacgaagaatgcatgaacaggcatgctaatcaattagatgaaacatgctatgttctagtcataaatatagatctaaattttaaaagcataacttcagttctcctaattcttttccccatcaacattaagaagatctaagtgcttatgaatctgacaccaatcatttcagaatccaaggagcactgacctcggctttaattttgttgtctccaaaacagaggtgttgcaagtaggctgccgcgttagactggaccgagggaaactggtgctgcaacatctgaatcacttccggcagttccgggtctctccatccaaattctctgaacaaaaggaaagaagcggggagaatatgagagagaaatcctaccacactgttaacacatggttagctcgtgtatgaaatgtacctgactctaaaagaaaatatttcataaatgactgttctggttttcttacatgcagacccatttaaggggatttggaagagattcccttgagtaaatagttttctttcttttcttttttttttttttttagacagaatctcactctgtcgcccaggctggagtgcagtggagcgatctcagctcactgcaagctccgcctcccgggttcacgccattctcctgccacagcctcccaagtagctgggactacaggcacccaccaccacgcctggccaattttttgtatttttagtagagatgcagtttcactgtgttagccaggatgatctcgatctcctgacctcgtgatccgcccacctcggcctcccaaagtgctgggattacaggcgtgagccagcgcgcccagcctagtaaatagttttcaagtgcaaacgtgtatactacatatattggttttatagattatatatacagatcaatctatcaactgaagttacatgttaataaagattatgaaaaaataacctaaaatagcatatgattttaatatacacattttcatttaagcttgagtggattattcatttatttatttttaacttttttaagagatggggtcttactgtgtcacccaggctggagtgcagtggcataattatagctcaccgcagcctcaaactcctgggctcaagcgatcctcccacctcagcctcccaaatagctggggttacaggcatgtgtcaccacgtccgtcttaaatggatcaggtatagaggtcatatctattctagtatattgtttcaatagtctgattcaggcacaggattaagctaaattatcagacaagagaaaacagaattggatgagtccaatccaaaatgttgtgatagcagccaatgtttatatcattattatttttattactgttgttattttcacaatctcttctttaaaaatagacaggggcctacatgattctctggggataaaaatgtaataacataatgactttataataggaaattatttatttaagaagctagaattatttgcagaatgttaatacattttatgcattgcactttctttttcctgtctcctcctttttacatctgagctactccaagaagctggttgtcatcttaagcaatatggtttaaaatatttaagtccattctaaaacattatcttgattgtactgtcatacaaagaaatattcttttattaaatctctccactcaaccagttagaccatgctgctaacaggacgaactgtatgaattctatccctgcagcagggaaccaatttttaacagagaaataaaatagcaacctccaagaccacaggtaaaaacttgaccccacaagccaccaaagggcactatttatccaaagaacaggctggaagagaaatgagtcagttctgcaaccacctctattcctcatgaaacaactcaaaagcatacatcctatcaatgccaggtcgatgctgtcatctgggaagagaagacatgaaaaatgggacagagaaggaacagacaaaggttaaaagtgtcctcaaagattttaacctcttctctttatctttcctttatcacagttggtagaggttgtcaagtaaaccttgaaacatgttggtgcttcctttacagcaagtgaataaaatatgaaatagaatacctcttgaaatggcttcgtttttattggaaagataaagcattctatttaatgtgcactgagcattttataaatttacatacagtcagacagattatatatacacacacagatatatatacacattatatatatacacacagatatacatacacactatatatatacacacacacacatactcagaaagacatacagtataataatatacttgtgaagaaacctactcaagtgattgctgataatgaacaaactattgaatccttcttggctatgtgatcacagtagaaaacaatcatagaattaaaaatgtaaagcctgtttttctctcaaatttaatttcttttgttttataattctaaaccacgtctgcaaggctcagatagcacagtccttcttataaaagtagccctctagaattatattctttatgcaaattaattcgaaatctactaaatacctgtaaattaaaattaggagtgtggagacactggatggctaagatgaattcaggtaaacctatgcttttggaaagtgattaataaaggattcattttaatctgttttattaaccagtcaggaattgctctattaggtgatggcttacacggcatatgccaagtgcaccttttgaacaagaaccctagggaacaggtttaggggctctttgcacacatgcgtgcacctgtgcacatgtgcttgcacacaccctcaaactcagacaggaaggatggacattccaaagactcatgagtgcagaagggatccacgtccctcacactaggtcaaaagaaaggctgctgccagctctgccctgtccccaagcccaaaacctctggaatcccaagcatcccttccctccccacttctgttctcccagacctcaccttcactctgctgatctgcaaatctcctcccacctcccaatcaccactcttcccacctgaggcatttaaatacatttaaatacgcagatacgcacacgtgattgtgctactttcctgctccacaccctactatggctcccaccatccttgagagtctaagacactcccatgaccttggaggccctgctgggctcgcccactcctgcctcacaggcttctgcctggccctggcctgcctctgctcctgtcctcctgtcccctggcctgcctggcccagtggcctcccactcaaatgcggggcctcaggctctttacaacttcctcggggaatcccgtcccaactcctacccacgcaatgcccagtggaggatgacaccgtcatgctgtgggccatgaggtgaccatctctcgcttcactctggtaggctctgaggccagggccccaactctgttggtcatctttgtcagctggctcctacagttctccctgacaccagatggactccacataaacgtgttttgaaagaatgaaggtgctaacgaatgaagaaagggcttggacatggacagtgtttccacagttctaccagtgactctcagaagagcaagagtcattcctagattagccacacaacacacacacacacacccccaacacacacacccaacacacacacacattcacacacacaccaacacacacactcacacacccaacacacacacacacacccccaacacacacacccaacacacacacaccaacacacacactcacacacccaacacacacacacccaacacacacacactcaaacacacacccaacacacatacacccaacacacacacacccaacacacatacacccaacacacacacattcacacacacccaacacacacatacactcacacacccaacacacacacccacaacacacactgacacacactcacacacacccaacatacacacaccccccaacacacacactcacatacactcaaacacacacccaacacacacacccaacacacacacacccaacacacacacccaacacacacacccaacacacacactcaaaacacacacccaacacacacatactcagcacacacacccaacacacacaccccaacacagacgtacatacacaccaaacatacccaacacccaacacactcacccaatacacacatccaacatgcacacagacacccaacacacacacacccaaaacacacactcagcacacacacacccaacacacacacatccaacagacaaatacattcagcacacacacccccaacccccacacacccaacacacacatacactcagcacacacaccccccaacacacacccaacacatacactcagcacacacaccccaacccacacacacccaaaacacatacactcagcacacacatccccaacacacacccaacacacacactgagcacacacacccaatacatatacacccacatcatgcacacacacccaacacacacaccaaacacacacacccaacacacacacccaccccaacacacatgcacacacaccacacacacctaacacccaacacacacacacccaatacacacacccaacatgtacacacacacatccaacacgctcaaacacacccaacatacactcacacacccaacacacacagacacacacagaggagtccttctccatgctgctaacctgagcagccttctctatgcctccatcgcatctcacaactctgtggcttaagattctccagtggcttcccactgcacttagacaacaatctgtgagggtgacgtgaaggtgcaacatttatggggagcaactctggggcacagtgaaagggagtgaaggagaaaaagccccgatcattaagccagacaagactggaaggtgaacgtaagttagcattcagatcctctggccttaaaccagcttcccagaaattgggttggagttgattgtgtctccaggcagttgacttctggtttattctaattggcagtccctcaggactcagtcactgcagcagttacccactaagaaaagactaatcttttcaaatgttctcctcaatttcacaaaatagatgctaaaagagcaccctccagcagaaagtctgggggaatgatttatctccaaggctctttttctataacagttttgtttcgcttagatgagattccgtttggttttctttttgctgatcatggagatataccccagagaaatagcagcaggcctgcagaaaatagtctgtctggatcatttcggccagaattcagtgtatagtatggtttcttcacataaggtcttaatccttaaggacaaagaggatcctgtaagacaaaaaagttctggaaagaacaaataccagaggagggaacagcacctgccaaggtgtggagtcaccgggggtggggggtcggttatttgggaaaggggagccattcagcatgtctggggcatggctctgaaggggatgggggcctccagagaggacggctgtctgggaacagggggagttggagcaggggctggaaagcaagtttgagatgagatcatgaaagatcattcattcaaatacaaaaaaatctgaacctggtctgtggatactgttgtgaaaaagaaatcgagtaagatttgtttagaattacacaacaggaagataataatctccagtaataacgtgagcgcatactaaaagtcagttgccaaggttctctggtcacacactttaatgttctaaaccttaacgaacattgtgtggtttattttcatcttacagaagaggcaacttaaggtgttattgaacttaagtgatgaagctggaataaaattctagttgtctcctctcgaatccataaatatagccataaaactatgttgcctgctataatcattctcttgaaataatgtctaaaacagtgatttttaaaagacaatgtctaaagaataaatagcgtctaaaacagtgcccctccgaggacatttagcaaagcctgaagacagttttggatggcacccgtggaaggcgctgctggcatccagtgggtagaggccagggaagcagccaaccttatgcagtgcacaggacagtccccacaacaaagaattattggtccccaaatgccaccagagcccgagttgagaagctctggtctcaacatgtactgtatttgattagttttgttgagcaaggatgttgtaaatctttccctccttgactgttgtactagaatgagcacaggatttggcatcagaatacctgtcaagaagttcagaatttgaacatctggctctgtcccttttatcccataaatacaggacagtcccttagatcttgctggccttggtttccatggatcaatatataaagaataataccacctattttactgcatttctcttaaaatgccaaaataaaataatatatatgaaagtgcttgatcaactactaagagctagatattttctagtaatttttactttaagactgccaaaagggatacatttctcttaaaatctatgtaataccgctgaaggttttataaaccttataacctttcactgatacgtattcatttagacattatacttatttgaagaactcttagtgtaaagggagacactgcttcagctagcagtacaatttgccctttcaaaataatttcctttcttcctaactccccttgggaggcagtgtgctagagtgggaaatggtctttggatgcaaccagacttggttcgaatcctgctccaccattaactgtctctgcagccttgggcttgggtctgagtcttgctggctggcagggaggtgctcactgtgtagatgaacatcgagtccatctgtcccactgagataaaaattcctacctgggagtattattgggatgattagaaataatatatgtgaaccccttagagcagtggctggcacccagcatgggctctctagaaatgtcaggtattgtatataactaagaagaggagaaatgagaaccctctacaatttcccacagtagccaaactcgtaactctcatttgtgactgggcttcactttagaaatgttaatggaaatggggatatgcaaatgtaaccttttctccattaaaacttgtcacacaggcccacaatattgtgagtaaatcctcactcttacatgggctatctgagttgttaaaatcaaaacgctcagcacagctaaacagccaacagttcatgactatgttcaacagttcatgactgttctgctggtacggaaaccaaaaagttgatgcattgtcacaatatcttatcaagcttccccattgaaaagagtcccaggacaactagaatcctcacaatttcacactattttcagcaaagctttatggtggcagacatggctcactttgattgcaatctaaactatttctattgagggcagggctgtgtggacattattaaaatgtatgataattttaatcctttagaaactctaaactcaaaatgttttaaagactgtaccgattttgactttcatatttagagtcaagaggaagtaggtgattttgtttttcatttgggcttattgatgtagttaggaagggtgcaggggtgatggtcataagttagatagatttttttaaagaacaaaatggagatatttacattcttgttgaccaaagagaacttattcaacaattaacatataaaagtattaatatcttaatcctcattcctggatagtttgtaactaaaaacaaaaagctgtcctatacaattttttttttttttttttttttttgagacagtcttactctgttgcccaggctggagtgcagtggcgcaatctcggctcactgcaacctccacctcccaagttcaagtgattctcctgcctcagcctcctgagtagcttggattacaggcacccaccaccacacctggctaatttttgtatttttagtagagacaaggttttgccatattggccaggctggtcttgaactcctgacctcaagtgatccacccaccttggcctcgcaaagtgctgcgattacaggcatgaaccacggcgcccggcctgtcctataaaattaatcacattttttcaaaacaccaacatggcttttatataaacaatagcactagaattatgactatctggaaagtaagctcaacggttataccatttttaaggaagaaatggccttctccaagcatatgctaaggaaaattaattccccaaactgtatcataaacattaattcattcaaccatgatttctggtcctggcctcatgatggagcagccacagatctccctggagaagtgctcagctcatgggggactagaaggtgctccacccagccagcagctcctccttccaatcagatattcccttctcatataaaatttgtattattaattatacccaagttttcacaaaagattgaggcaactcagacaaattatatatgagataagatgacaaaacggaaatgaaaaatcaagtacacaaaagagagagaattcaaatgttataaacacagggtcagcattcatgcctgatttgcatcaaatttgattatttccttacaagtagccctgacaacaggagagaaatgaacaaaggcgaaaaggggctattcttgttcgttcagtgaaaggacagaatccccactgggaatttagggggcagggatctgagaccttttctacctgtccctatatttgtgataaagactctggttaggacactgggaaagactgaagagtggcccccaacgttatccaggtcctagtccctagaatctgctaatgctgccttctatggccaaatggactttgcagatgtgattcagtatcctgagatgggagatgatcctcggttagccagtgggccctaaatgccatcataagtgtcctaagaagagggacgcagagggagactggacgcagaagagggcaatgtaacactgacgcacgaggccatgctgctgtgctgagcatggaggaggggtccacgagccaaggggtgcaaggaatgcagctctacaagctggaaaaggccaggacagtttcccctagaacctctaaagggagcctggcagtacagacaccttgactgcaacacaatgaatttctgttggatttctggcctccaaaactgtacgagaataaatgtgtgttgttttaagccaccagttttgtgttaatctgtattagcagcagcaggaatctaacacagaagcccatctgaccccaggacacggcccttttaagcctggaaagagaccaccccattagggcaagaaggtgagagaggccaagaagcaccacctctgattccaatttggagagtcttcgatgtgacttttgattatgaggccgactcttccattgatttactctgactttctgaccacctctcgttcatctaagagttggaaatgcaatttccctgagcttcggcttatttcagtagggcccagtagctttcacctcttgccatgttcctgcaggctgcctgcctgctttgtctaaggattcagtcaggaaccctctcactcctccaaacaatgtttaatggccactgcgtgtttgtccaatggaatacagtgttgaatggagcaaaggttcctattcttggggagctgactttcgattggtcactggtcattaaaattattaaaagagcagaatgtactatttgtcagatagtgatacatgtgtagtgggttgaagagtgtctcccagaattcatgtcctcctggaaccttagaacgtgaccttatttggaaataggatctttgcagatgtaattgaggtaaggatggaaatgagatcagactggattggggtggcccctgagtcaaaagagagtgccctcataagagacaaaggaagacacagacacagagagaggcaatgtgaagaggaaggcaggggctggagtgatgcagccacaagcccagggacaccgaggattccgggcaccaccagaagcgagaagaggggcaggactctccctcagcacctctggagagacgctacactgctcacaccatgattttggtctggcagaatcaatttctgttgttttgggccacccagttggtggtgctttgctatggccaccaccaggaaactcatacaagttggatgggaaagtaaagccaagtagagacagggacacgacagtctgtgtgtctgtaggtgggtgggggggtggggggtggttattataaatacagaggccaggggagactgctccgagaaggtgacaccggagctgagtggagggaacattccagaacaggaaaacggaagtaacaagcctctgaggcaggagtgtgcctggcatgtcagacaagaggtaagaaggtcacggggtgaagagaagtgagtcccgggccctactgggagaccaacagggggccctgatgtgtccgacatcgcaggcctctggcttctgctccaagacatagggaagccactggaacgctgggatctgactcacattcttaaaagatccctttgacggtggctgcctggatgtgtgcatctattgactctcataaactgcaggcctaaaatcttgcatttcttgggtatcaattacacctggatgatgctgagttctggaaaaggcccccgctggatgctaggttaagaacagattctgaggggtggggcaggagctgagagcagttgggggcagatggtggctcagccccagcagggacagagggtgttgagaagcacgggcagtctggatgccctttgaaggtagagcctgcaggaattcctggaggggtgcatttgagtgtgagaaaagaaagaggccctctgtgagaccctatgcaaagcctactccacgcctcccacccatatcactgggggcctgggcccactacgcaggttagtcaaggaaggccaccttgtggggactgtggggactgggatctcttgtttcacaattagaaggaacaatttcaactagcaagttttctcctggctggtaaagtgaagagagaaaacagtaaaatgatgagaaaattggctatttctgaactattatggacactaagtgccttacattaatcttagtcaagcaatgggcttcttctctgaattcaatttattagaagttaggggtgaggaatgatgtaaaatgattagccccaatttatgctaatagttatcaaatttaattacatgtagcttaaatattaacaaatttctgcttctatatagaatatttaggtcctttagaagacataaatattctcaaagaccattagattacaatggatatcatcaattatgtcataatacctatgcaatatccaattaactttaaaacagcatttattcattcattaatgcaactagactttttcaataaaaatatgctacaaaatggaaaaaataacctcaaacatgtaagaatttagttgccctggaaattctaacaggttctgtctggtggtaacagcccaagggaaaaaatacaaattagtgtccataaactttaccttgtaaagcatgatgactttatagaaaatgtttatgttcaccactatgtatctattttaaaattaacagcccgtgatgtttcttagaaaatcacctggagctgtgaacctggagtgtaaataagagggaagggatttgatgcccaaaatactcggatcaggagatttaagaacatttgagcagtgttttttactttgttgatatcagggtaagatcagaattttgcctcaggattagattaagaatttgagaaaaccacaaaggccttggtcaccctcaaaatgttttattatacatacatatatatatatatatgtgcatgtgggcacatgtgtatgtatatgtgcagatctgtgtgtataatatatagtgtgtagatattatatatgtataatacatatagtatgtgtgtgtttgtacttatgcacacatataatgcatatatacacatataatatacatgttacaggaaacttgatacatagacttaaaatacattgtgtataaaccatagactagagcacactttcttataaattaggtaaccataccacttgacaattgtccctgagaaaaatataaatggtgcacttgatgaatctctttatgaaaacttaacttctgatagaagccacaatgatacaggtagatgcattctaataacaagaacaccatctcttgagattccacactaagctctgtgtttctggaagtgagaacgtgtcctgaagtacctgtcacagtgtctttacaatgtgaaccatgaacacatactttggggctgacggtttaccggagtctagtcttggctagaacatgatttaacaatatccatttttggttttcatcatcatcaccttatcttagttcttcgaagaatgccaacttaatttatctcagataatattgagcagagatacttcctctaaagaaaatcttaatagaatctaacaaaatgtggtctaatttggcctaacatttggtcgctgtgctctccaaagctgtcagcctctagtaccaaacactggttcctgccctcagattgtagtgggcaacacagtgggagcagaattatctaccagaaaaagcctgttatctaagaaggaagagcgtactccttgttcttgttttatgggttcatttcctgataggccatgtggtgtggcattcaggaagagtgtacttcagaaacaagctgctagcaatgtcactgccatccaaccgagggcatcaggatcacacctgtgtttgaaccaagttgggcttattgctcgtaataagaaaggactcacaccatgggaaaccatgggacatatcagtaagagggcgttgaatagactgacaaaatttgacttgttttgtgtgtcttgggaagattcaaaggagcaaggctttgttctggattgggtgctacgaggatgtaggggaaatttcatggtcagggggcttgaataatcttatctagaaggagaaaaaacagagtaatgttcaacctgtgattggccaagaatgagcagtcattcatatcagccaggctactgtgagttgtgtggtcatttttgtggtttagggaccatcatattttctattcatatttaccattcgtattcatatttgacacttcagtataatttttgaggaatgacttcatggattacattagattgttttaacctgaaatacattaggaatgggaggaaagcttttgagtgtggttatttagccgctagaatagtacaaaaacaaacaaaaaaaaaaccaaaaatctaaagccatttaattagatctacagtcattagtgtccatgtcaaaaaaaaaaaccaaaacacactcatctatgtgtattgcttcactttgtccttaaagaaatcctaaagaacatatgaatatttgggcatattcttaatatgaggatataaagggctgcagtgtccaagtgtccattcataattatttctcattactagacattaaaagcaaagcaattccatagggattttctttgatcatatttcagagtactttgctataaaacttttaacttacctccatttccagagtctgcatttctttaaatataaaatgtggagaatattttcacccttcagtttgaataaaataaccaacagtggaccatgggtgaaaaggctgttgaaaggcccaactataggtcattgtcttggatgattctgtatctgtacaactgaatacataagcaagttttgttttcaagtgcaacaataataaaaaataacgttgatttcaatataatggtacccaattacctttcatttctacccattgataaagtcttagactagcctttttcttacttctgtgtctgctcaactctaagtagaatgtgtgtaattaatttgaaaattaattgaaagtttgcggtgaatttaaagggtgctctctctctctctctctctctctctctctctctctatatatatatatatatatatacatatatttttttttttttttagagacagggtcttgctctgttgcctaggttggggtgtggtggtggatcgtagctcactgtagccttgaattcctgagctcaagtgatcctcctgtctcagcctccaaagtagctagtactacaggcacgcaccaacacactcagctagtttttaaattttttctacagacagggtctcactaggttgctcaggctggtctccaactccaaggctcaagtgatccttctgcctcagcctcccaaagtgctgggattacaagcgtgagctaccgcacccagcccatagacctttataatttaaaatgaggtagaggggtacacagggcagatggaagacgtttgactacaccataaagactaagtggcagagacacatagttttgttcgtgcaaataataaatgcatctatgatctttttcactaattaagaacgatggtttctttattaagcattttaaaaggtctatttccatagcagcaaactgaagccactaggaaaaaaaagaacttgggtctttaagaatgttggtttattatttaagtgttgtacagatttattttttataaatcaaatattttttatttgtgagaagtgactgaacacaattattggccggagtgtttcggctgcttgactttatagaacttgagtttcctgaactttatgggttcacaaacctcttcatgtttcacagggtgccccccaggccaaaataaatgcctgacagttccatttagtaagttcttaggtctgaacagcttgaatcatctacatcctaacatgtccgtgctttggggcactgcacaacttctcaaaacttggaagcagacaatgccatcttcacatcctctcctatgctgattgtcactagcacttgcttcatatcacagaaacctctgaaaatcctggtatgcaaagtgatgacatcattgaaaggaatgtggcacagctggattttgaaactgaactaatgggagctcatgtttcaacctggtttcaagataccgtatttatcttgaaaatttaaaatatccctcggaatccctcgaatttcctatgttgccctgggacaccttggcatatagtttggaaacagagcaaacgaatcgtcctcacgacagctgtgacctaaccattaatgaaaaacttcagcaaaatgaacaattattgggagaagggcaaattatgtgtatatgaataggaagttcgtcttgtaaaagtttatactcagaatttcagaatttcaattaagtgacacagtagctaagtaaaataaataaaaacttgtagtttgggaaaatagacttacactcaatttctaaaaatttgcttatgtaaatgttttgaaatgtatcgttttatgactttgaaagtcctaaatcacagctttccttaacaattatttatatatttaaaaatactataaattttggggaaaacatcagcatttagaattgctttatctttttttacattagcaagagtacagtagaatgagatcttgcaatgttcatgacaaaaacaccattttagtggcagtagcattactgaaaatgctttattatattcagcttgttcttcactgcatcaaattgctcttaatgtcttcaaacttgtacgtgaacttaagggacctccttcacacccatttgttgccctttccccagatcctttgttgggctgatatggacttagactgcagaatgagaaatcaatgagagacttgacagccagagaaagcaaacaaactcagtgatgtgaaaactgctgtcaggtcagtgtaacaagcagctctttctagatttcactgcactgcagtgatcagaaactggggtgggggggagattataccttagttctatgtctatagacaactacagattcaataatcagagagattatctcctgtacataacaatattctacaataagcactggcataagttcatttcttacaagtagaagtcaacataatgtaagctcacatttaaggagcatgttctgtgttgctaagaactgctcttatgccttcctcacttaatgttcatcacattcccatcagggtggtgccataaatattccattttatagatgtaacatttgcagtatagagagcttcagccacttgctaggagtctcagagatgatcaggtgatggaggcagaattaaccacaggctctcttcagagcccacagtcttacccaggtggctcactctctcatcaaacactttttgttactatttttataagccactgcaagttgggcaccaaaatgaatgtgtactcctcagtaatttcatgaggataaagtaaaattcatctactgtaggactaacaccatgtttcttatggctctttcaattatgattgccttctcccctctaaatcaagagttgtgtaatctaaaaatagcagtatctcacacagagatattttatgttgctgacttttataaagcaatgaactgtttgcaaataaatatctctgctatgctttctccatttataatctcaggcaacctcagtctgaggttattccagggcccagggtcaggagatggaacagagaataaaaggtcatacctgaagaaaaaaatcatcagtgctctcaaccagttcttacacctctccttttcttttctttcatgatctgtctctaaattttacttggcttctcactgggccccatttgttcaaattcctcccagatttgtcatgtcctgcctttctctggcttttgtgagttacctgtgatttattcaattaaggactattgatatggtttggctgtgtcctcactcaaatcttatcttgaattgtagctcccataattcccaagtttgtgggatggatctggtggaagataattgaatcatggggctgtttcccccatactattttcatgctagtgaataagtctcacaagatctgatgattttgtagcagttttccccttttgcttggctctcattctctcttgcctgctgccatgtaagacatgcctttcaccttccaccatgattgtgaggcctccccagccacatggaactgtgagtccattaaacctctttttctttataaattacccagtcttgggtatgtctttatcagcagtgtgaaaacagaataatataacgatgatgtaaaaatacaatagaccatctagatatctatgtccataaagagttatgctatttgttgatgcaataaataaaaccttctggataaaatatttttcctaatctgtattattctgctcaccttagtgttctcctgccttaaatctcccaaaagggagttgctaagccaatcaaaatctactggtttgatttgaaacagatattttctttaaataaggtctgatacaaaacacctatctttctgtacactcagtatatttaattttttatgtttacttacttggtgtaatctattgccttgacccaaaactatttgttattttttattacaatccattatgactaaaaaaatgctttacatcaaacgggtatttagaaaatgatgaccttctagtcatcaaatttagttagttgaaacattggatttttaaaatttacataatttactgcaattttaacacactcagtttagcagagtgatgggatttactagttgctcaataaacattagtagtcaatccacttttcttcccagagcctgattttcagacatcttaaatgacttgtgcaaagttggtaaaagaagctcccatcacttcaagtttccctgaatacataccctctgctcaatgcataaagcaaagcccaccctatcctggctgtggttctcaggaaccacacatccaggtaaaggaagctggatatgatacctgaatgtgtctgggcacaaaagaataatttaatcataggtagagcaaagaacatggttcctaccttgcacaatagaactgggaactctcaaattttctggtgctctttagggaatgtttttgactccatttgaataggtatcagaggtgcaggctgtggtcagaggcaacatctccaagaaggctttcttctactaggtcagaggaaatgcccatttcctaggttctgagaacattcagattcaccatacaacagtgcatgtcaaaattacaaagtggaagacggtctagaaatgttttttacacttcaagaagtatgaaatgtataaaatacttttctgagctaggagaaacaggtgtcacccttacttttagacttgcaaattataatgcagggcagcctcccttcccaactaagaattatctggcccaaaatctcagtagtgctgaggctgagaaaccgtggtgtatactatattatgcacattttgatagcccagaacataaactgtaagaggcactacattaggtcaaaacactgtcagttcagaccaacatctttctctgaataggaccaaggatttgggttgctgttgtaatttaaaatttgtctttggagtcatgccagagctacaggtttagggatgcatttcaaaacattttccctccatcttctattatgtttgtgtcatctatgagtttttttcctaaatatcccttgacttgtttatgtttcaagtctttacaacacacgagactttaaatttactgcctattgtatgatttaatacttccttgtggtaaatagaagaagggaaaaaggactgaattaacaattcctggggaaaaaaaactcacttcatgaaaaatgtccatgcatctcagttgcagtgaggacttgtcacatcggcccatttctgcaacagttgggcctccagctgtctctacacatcatttctggagagcagactttgcgctggttttgcacagaggccgactagaactttcgacaggcaagtgtgtgacacagaagcatcttgaaatcctagcattttttcctgttcatttaacagctagggaggtttcaaacatctttcaaaaaatactttcttagaactaaaatcaccataatattgtgacataaagaaaaattcaatcttgtctcatgctctcattttctttgaaacacaaaatccatacttggctgcgaccacaaaggttacgcattctatctagtaggatgcagatgaaggaaggcacaggcacggttatcatggaggaacacaaatctttatcaggtctgtttcttcagtaactgttggggaaaaaatagtgggaataaaagtttggtttctaagctcctcccagcatcaatcagtcacgagagctggaaactcactttccataatactcccattgctggagccatggcccagggcctcattacgtcttgctttggaaactgtgatggtttcctaatgggctctgttgctccaggctgtagcctctccattttatcctgcacaactccgtccctgtgaggcttctaaaggcaaaccccagcattttactgaccttccagcaaccctccattgcactccatcacgggactttgttccagaacagccctgcgttccggccactgcctcctccctggctatactccttgtgcctgtgtgctctttggtgcatgccctgtgctcaggccgaactgtctgtagttccctactcatgccaaactgtgtcacttcctcctcggctaacttggccccatctcctacctggcaatgctggttctgctccagcattagcacctgtaaaactcctttcctaatgacaaaaaagttgataatatgcctaggtcatatttgtgtgttgacatagatacataaaacccatttgtgggtcacaccactctgaaaaaaatactgtctggtttttgaccccatgaaaatttccccagcctctctgtggcaaccaaggagaatgtgtagcacttgtcacgttgaaacttgacacttatttgtgtaattttgtaatgataatttcctctactcaacagtaaactccagagagcagggttcatgctaagtttaactcatcattatcttcgcagtacctggcatacttctttgcatatagtagatattcaatgaacaaatgaaactattccaagataaagtcatctcaaagataaaaataagaatgatgacagaaagagtatatatgcaatattacatatgtactaacttatcagtggcttgctctctggcttaccatagctcctccttaaccccattcattaattcagcaaacatttacgggataccaatgaggcatagtgaataatatccactggccccaggggctacggatgaggaggtcaaggtgggataaaagagtgggcaacatcagtgtacgccagggtttctcaacctcagcactactaagatttggggccaggtaattcttggttgggaagggaggctgccctgccttataacatatttatgcaacatgcctggcctctaccaattaaatgctaatagcacccttttcccccaagctgtgacaactaaaaaaagtccagacattgtcaaatgtcccctggggagcaaaattatctctggttgagaattactgatgtaaggtaatatttctgatacagcaagagaaaggtcacaggaaattaatctctgtatgacctctagtcatattacatagacctttgttggcttatttcttgctaataatattgccaaatggtgtagcagtaggttttctccactgaatctcagtgatttttggtccagaattgtgttgtgaaggaaagaaagaatgggaaagggtgtgcagcaattacctcttgtttccttggttcaagcacctaagtgaatgattagccattggcacatgtgataagactgcaggagtcatgggaatattctcagagttcatcaccatgcaccaatttactgtattagtccattctcatgctgctatgaagaaataaccaagactgggtaatttacaaagaaaagaggtttaagagccagttctgcatcgccggggaggcctcaggaaacgtacagtcatggcagaaggcaccccttcatagggcagcaggagagagaataagtgccagcaggagaaatgccagacgcttataaaaccatcagatctcctgagaactcactcattatcaatgagaacagcatgggagaaaccacccttatgattcaattacctcccactaggtttctcccaagacacatgaggaatatggggttacaattcgagatgagattcaggtgggaacacaaagccaaaccttatcacccaccctaacaggagcctgatggttgatgggctttctacagcatgtcctgcctctcagtgtcccatgaaccttgccaggcaaacgaatgactattttctgctggctcctcacttatagctctgcaatactgcacttatttagatggtaaggcacctgacagtctccatgctaagtaactctcctcatgcatttcaacatcgccatcattctcctattactcctccaagccctcttccatcggggaatagagctggtgcagcgctttcagttcattgtactcctgggggagaataatgctcttcaactgatctggtgtctcagtcaaacttagatccctctgaaagtcagatcctttcagcgtagcatccctgagtgccgtgttggcaggaagcgagactcgtaccttaggctgaatggatttcttctaaccaatcccagatatcagagtagtgcaaagtcctgcccatcagggaaccaacatatgctgcatcttcacaatgtccacaggccagggaggcagccgacatatggcccaaagagggaatggagagctgaccaggcccaaagcatttggaggggctggatgggcccctgctctcctttcttttctctccctggcagcatcatggcttccatctggtcatctaaaaatcttttaaaacactcactcatcaacattgctattactgttcacaagcttatgctcaggcaccaatccgttcagtgaatttttcagggtcacacagaaacaccttacaaaagctgaaaaagacttccatgcccctcaaaggcaagcgaacctggtcatcacttcatccttattagattaaaatgatctaatcttggtaagtttcgctttgtctactcttttcatttttgcacagaaaaggattatgtgtgcgtttttttcaatgtggcaggttatgaaaaacactcatgagcagtttcttcacctctgaagtggaagaaagtgagtttttctgagattgcagaatttaaaaaataatcaaaacctgaggattttaggtcattattaacagaactcctatgtttagatttcataaagtcttgtcagaggtgcatttcaacagaaaaattctgtacattctccatatcttttttctttcttacttctcatttccctctgcacagaaaagatcagctaattaggagattcttatgtctccttcctattcttcatctatccccaatacatgaatcagtgtatcctttttgtaggtcatgctctgtttggctaggctacagttcccgtgatttaatcaaacacaaatccacaagttgccctgaaggtattttgtagctaggattaccatctacaatcagttgacttcaagtctaggaggttacccttaataatatgggtgagccttgtaccatcagttgaaaaacgaaaactcaagacttcagtagtaactcctgcctgagtttccagcctgatggtctgccctgcagatttcagacttgctaactcccacaaatgcatgagccaattctttaaaatcaatctctctctttctccctctctgtgtgtatatgtgggtctcttgggatgtttattcctgggatatacccttttagatcccagccaccacgccaaaaaaaaagatggcaccatgtagagaagatgctaggtcaattgcccctgctgagctcccagttgacagcagtttcacctgcctgcaccagattgtgccatcctggacatccagccctgtgggaccattacatgatgcagcccactgacatctcactgcatgctcatgagactgcccaagtcagaactgtccagctaagcccagtctacacagagaatcatgagaggtgaagattcactgttcttttagacactacgggttggggtggttggttatgcagcaaatggcaatgacatataggaagagcttttgctatgttgttctcgagtcatgtttgtatttgaaaaagagcttcttcaaatgagtcaagaagataatgcaatgtgtccaaatagcacctggattttgctgaattctttctcttcagacaggaataaaagatctgaaaagaaccgctttgttgaggccatcagtttgttgttaacaaccctcaaagtcagcctggaatggatttagctcactgtatcaagactgtggacccagagagctgttcatctgctgtgctttttcactaatattttttaaagggataaacacgttttaagccactcagaaattgtcctaaaatggagatattgcaactactacttaatttttccaactcatttatgactttcctatgcagctctgcatatggtgagtgaaataatctatcagtctgtttcattacatccgagatggcccttccttgaatgatgtgttcatatctaatatttgctgctgtgaagtgatggagataggaaggaggagtagaacagaccataggaatgagaagaaacatagcaggcaggcaaatatattttaaatagacaaagactcatgctgagaggataaatggacagaatgttgtttcctggtgtttagacctctttggaagatcctgtctatatgatgctattaaattacaaattgccactgtaatgtataaaataacgacatattttaaatttgttgcttcttccgaagagctttatttacacactaagaaaaaaggcttaaaagcacaaggtctcacacgaaaacccaatgaaaaaaaaccagtaaaattatcttttacaatatcaaaatatttaaaaatttcatgtaatatatgtaaaaagaggacaatcaatgtcctaatctgttttatatggctataacagaaaattcatctgtgagggccttcttgctacctcatcccacagtcgaaggggaaaaggcaagagagcacacacaagtgagaacccactctcacaataatatacctgctcctgacataatgacattaatctataagccagtcaccactcaaaggtcccacctctcaacaagatagtactggggattaagtttccaacacaggaattttgagggacacattcaaaccttagcaatcaacaatttgaaaaaaattcaaggtgacaaggacaaccatcttattggcaatcattaagggggtaacataaaatttactattatagggaagtataatagatgagttggtgagtaaagactgaatccatacaaaggttattaaattaattctgacatatccgtaattatgacgggcctgagagcaggactctcaaggttttagctgtcgaattggctcacacatcttggagggatgggtctggctcggtgcatgcaggttgatcccaggcagggtgctaacattttcaagatgatacccagccacagtcacgcgaatgcttgtgtgaatttatacttcaccttggcccagaaaggacttggtgggggtttcctctactctaacaaaaactaaaaaattaaaattatggctcttcacacagaggcaaatgacacaggtagcattagtgacagtgatattgggctggccgtttgtcccagcctctcatcggtctaggccagatctcttggtcttgccccaagacaaggggcatgggcttgagcctctttatattctgggagttccttcctccagaactcgctgagagaatactttatttgttatttgttgcacactgacactgtgcttaggatctggcaagctacccaatgtcctcccgggtgctttgcaatcgagactgacaaatacccaattataaaatccaccagctgaaaaggcagttaactctccaaaggacagagtcacttagcatttttatttggcctccatctcagacactaaagcagcctctcagtatcctgctgaacaaaccaagggtcatgtgtttctctagctctggatggtgggatgccccgagggcaaaacatcctcgtgtctcacccaccccaagatggatataggggatcttccaccactgcaaaccttggtctttctaacctaagttagaatactatagtataaccaactagtattggtaaataggaaagaaagggagagcatgagaaataatggattttgcagcttttatttgtgagtgaatgggcccacaattttcccttcctgaaagtcaacttgaagttgaaataatggggtgatacaccgtgaaacaactcaatgactactcagcccagtggtgttagataaatatttaaagttaagtatctcgtgtagaaagtctaagttaatcataaaatcaaggtgagtcaaaacatatctacgccttagttatttatttcataatttatctattatagagatcaagagtttcataggcacctgttaaaaaagataggaggccccaggtggagtcactcatgctaaagttccacgttaccaatcgagacgtaagttgtttacgtgtaagatctgaccttcccagaagccaagagagaaatgatggccacatttccaagcaaacctttcaaaacaaaacccaggagatttcacagtaactgacccaccaaaagggcccagtcaacctgagcaacataatagggaagtcccctctgcttaaacccacaccatactgaaggtaaccaatgtgctttttgcactctgctgtctccttgttcctactaaagctgccttactgaagacaattgttctgagatacctggtggagctccatactattttctagactggatgttgcccagttcatgaatcattaataaaagccaatttgatctttgaaactaaatgtgttggccgggcgcagtggctcacgcctgtaattccagcactttgggaggccgaggcgggtggatcacgaggtcaggagatcaagaccatcctggctaacatggtgaaaccccgtctctactaaaaatacaaaaaattagctgggcgtggtggcgggcacctgtagtcccagctactcgggaggctgaagcaggagaatggcgtgaacccaggaggcagaggttgcagtgagtcgagaccgcaccactgcactccagcctgggtgacagagtaagactctgtctcaaaaaaaaaaaaaaaaaaaaaaaaaaagaaagaaagaaagaaacgaaatttgttgaaattgtgttctttgccacacattttccattcacaggctgaacttctgatttccctgatccccctaactcctttcaacaacataggcttttagaaacttcaaaaaagacttttcctgccgagaatcgtttaatttatttacatacagcctgacatgctctagaacgaatttccgatggctctcacaaaagcataacatttcagaggtgaaagaaaacttgatgcccacataagtgcaactttcacctgaaatgtgaccttggattgcagagccatcatctgtgtgtatgacaagagaacacctcttctagctggcccacctccattcaaagatgacttgattctaaattttctttttccattgacccagcatcgatatctcaacctgcttgactttattgctgacttctgaaacctttcaagataactaaaaatctcttttgtataatggcccatttcgtatttcaaatatgaaatgcatctcagtatttaatttaagtgtattttaaatagagcaaccaaggaaatgattaaagaataccataactctagagtagaatatttaaagccagtaaaaatgatgtgttgaaagtatacttaataacatgcaaaaatgctcatgaaatgatagtcaataaaaaaagatataaatccatattggaactatgattacaaatgtgtgtgtgcatgtatgtgtgtgtgtgagtgtgtgtgtgtgaggtggagaaagagtgaagacagaggaaaagaatgaataagaaaattaagagaatttaaaaagcctgggagagaataaacgtgaataatgttatcagtggtggcaccatgaaccacttgtaaaatatatctttgtattttccagtatgagccttgaattcatgcctttacagttactgtgtgtatctctgcacttacacccaccctaaactctttacagttaatttcatcaaatacccagtattcctcagctgatgattttgagtcttttgtcctctactctaaacacactccagtttgtgcatgtgtctgtttctggaactgccaataactagacacagcgtcccaggtgtggtgtgaatagctcagatgcagtggattagggtctcctttgccctggacaaggtctttctttccatgcatttgaaatcgtcttccctctggtggcacgtcatctgtaatctcacgttcaccttcgaatcaactaacatagatgttcttttaaaacatgttttgctaagagcattctgataagtctttattcttagttctggccatcagaatgaccaattaactgaaatacttatttcaattatttggtctatctaatatatagtttaaaatacaaggagaattgtcaattttccaaaggatagtcatttgatattatgggttgaattgtgtccttcaaaaagctatactgaactggcgaatccagaacctgtgaatgtgactttatttggaaacagggtctttgcagatgtaagtaagttatgaggtcatattggattagggtaggctgtggcagtgggcatggctatgttccaataaaactttattttcagaaacaaacagtgggccaaatttggcccatgggatacagtttgctgatgactgctgaaactgtttgaggaagataatggttttactgggttcacaggtgagggaagtgaggttgaaagtttacaatcttgtagaaaaatcacacagtgaatacagggtagccctggagtttcaactgacaccacatctccagaagccgccgttgtaatcactcggctacactatcttagaggcaagaacaattctgcacttttgttaaaagtgtattcattggctgggtgtggtggctcatgcctataataccagcactttgggagggcgaggcaggcggttggcctgagctcaggagttcaagaccagcctaggcaacatggggaaaccctgtctgtactaaaaatacaaaaaattagccaggcatgatggagtgtgcctgtggtcccaattacacaggaggctgaaatgggaggatcacttgagcctgggaggcggaggttgcagtgagccaagattgtgccactgcactccagcctgggtgacagagtaagaccccgtctcattaaaaaataaataaataaatagcaagcttttccaatacctatattatcttggcaaaagaactagatcaacaagttcaaagcaaaacaaagacaggctaaattttattaaatcaaaaaaactgccataaattatatattttagaactatattatcttggcaaaagaaagatatcaacaagttcgaagcaaaacaaacacaggctaaattgtattaaatcaaaaaaactgccataaatgttctaaagaagttacatatgttagaagattcaggaaattaaaattcagagttattgaacattagtgtctcaaacaatctgtgtataggactggaaaaaataatgtacatgagagaacagaggaaacaaaaatcttagggaatcagtgaaagcttgatgtacatctcaaagtttctggtggttttcctagctgaaaaaacaattaaagggatttctttcaagtttctggggcacacaggagaaaccatgagggtgatgtcccacaacacaagcccttcttttgcaggatggtcccaccctctgcaaagctcctctccacactgcagacgggccttttacttgcccccaaaccatactcctgtattactcagtagcgttttgctgaatcttttattcccttaatacaaaagtactccaaacactctaggagcgtttgactgagtgttaaactgttctgctcagaagacatatagcattaagttgtccaaaatcagttgcaaatcactcagcatcactgtatgtattctctatttttttttttttttttttttttttgagatggagtctcgctctgtagcccaggctggaatgcagtggtgcaatcttggctcactgcaacctccgcctcccaggtcccagttcaagcaatactcctgcctcagcctcccgagtagatgggattacaggatcgcaccaccatgctcaggtaatttttttatttttagtagagactgggtttcaccatgttagccaggctggtctggaactcctgaccttgtgatctgcccacctcagcctcccaaagtgctgggattagaggtgtgagccaccaggcctggtcatctctttctattttttaaagtacctttcatttactggttcaggtagttttgatccataaagacaaaaatccacattactaacagaatttagagatctttagttgacaaaataaaataactttttcgtcacctaactacagcatgatgttgatgcctctcagatccttcaaattaataactcagactcaaaaggtattgctaccacttgggctttgtttgaattctaagtaaaaataatttatttcccagaatacagctttagttgagcatggcaaaatcacactgggccaatggattctcgcctcatttccataattatcataaatacacacaaaagcataaataaagaataaggaattaacttcacaaatatacttggaacaagacataaagctgcagagtgtcaccacatttaactctctgctgtaataagtgccacagacaaatagagttaaatgggttaattagtcaccagtggccattttaattgcagtattgaaaatcaggcacaaatgctagaagaattctcattacagggttacctgggctttcatgggagggttcgcttgggagagcggcatctctaaaacattgtggaactgattacatctcttcctcccctttacctttcataattagctgtacactattaagttaatgcacatttatctacaacaattcaattcagactgcaagagagaatctttctagtctataattacactccagcttaattagcataatttccactgcacatattttaataaagaagctgccattatgggttggcttcagaagtggaaactcttccagggagatacaaatgcttcctactctcgaactgccacaaatgcaaagagacgacctaaagctgactttcttttttgagacggagtccaactctgttgcccaggctggagtgcaatggcgcgatctcagctcactgcaacctccatctccagggttcaagcaattctcctgcctcagcctcccgagtagctgggactacaggcgcccgccaccacgcccggctaatttttgtatttttagtagagatgggttttcgccatgttggccagtctggcctcgaacttctgacctcaggtaatccacccacctcggcctcccaaagtgctggaattacaggcgtgagccaccgtgcccgacctgaagctgactttccatgagacagtactgttgggaagggcatgcttctgcaggaggggacctgatggattctccccacgtggagctaacggctaatcctcagtgatggctgatggctggtgatgggtgatttggcaattgggctacgtggtgatggggtttgacctcatcagtctgtaaatgtctcatctgagaggcttgaaaaacatttctacagtttattttggatctgcctctccaggggaaagccatttgagtgcctgcaatccagccaccactagatgtcaccagtcattaactgggacacagataaatgagccctttaagatatttttattaacttgaaagacctaagcaactggttgtcttttctgcaactcccttgtgtgggggcctgttaacaacgagggaaccaatctatttgcccagccctgaaatggcaaatgcccaccgtgtgatttaaaaggactgcacacactttgcaaatgttagaaacctgtcctgataataaccagaattgtctgatataaaggaaaatcttcagttctagtagctcattatattttgcacaaacatctggctattcaaataaagttcgcaaaaaagattttgccagtggcattaatgttcttactagatcccttagagagaagaatgagaggcattttgcctcctctgaatttcctgatgttgaacgtgaagtcatagtatgatgcacaagaagatgggctttgaaaaagagtaggaaatcatcgctgtcatccagaaaaactttaatgagaaaactagaaaggaggcagatggaacaaaccaatgattgttgcgaagtcccaaaaaactgtttcaaatccaaaagtggcaatggtagaaggtgtgattctaccaatggttgaagagaccttgaaagaagtaggggtttttagagatgctagacaccagcatcatttctggaaaatccaggtaggtgccatgaggcacggaacatgtgtcaaacatttccttttccacatggatatttaaaaatgtaaacatttttaaaaacctattttgagtgagtttaaatagtaatttcagtaaggtatcttctcagtcaccaaagattcgatttaaaaataatgcaacagcccaggcacggtagctcatgcctgcaatcccagcactttgggaggctgaggtgggcagatcacttgaggccaagagttcaagatcagcctagacaacatggtgaaacctcatctctactaaaaagtacaaaaaattagctgggcgtggtggcatgcacctgcagtctcagctactcagtgttgggggctgaggcacgagaattgcttgaacttgacctgagaggtggaggttgcagtgagccaagatcatgccactgcactccagcctgggtagcctgggtgatggagtaagactctgatacacacaaaagaaaaaataacataaaaataacatagcaaatatatatataaagtactatcacactataatggtgtaatggattaaaaaatgatgtaatgaagactcatttatgccatcacaatctgcatttttttaccacaacactaaccatttagagctcatgtgcctgcagacagttacttaaatttgtacttatgtcttcaaaattacgggtaattttttttcttttaaaacaagatgttcattgcagggagcaatgtgcacactgacccttttaaactctgccactgttgcaaaggttttcagtaggattctcatagcggtctgaagagatagggaatgttagttaacaaaactgaactgtcctcatttcaaccatgcataaatgctcactctgttccttttaccgaaacttttcctttagaaatacaacaacacagctaagagcatggcctctggaggctacctgccttggcttgagtccagcttctctgcttactgactgtgagactgtgggcaagctacattagctccccgggatttagtttgctcagctgtaaaatggaaaaataacagcagccagcttatagaagtgaagaggaatgaatgggggaaagcgaggcagtgcgctttgaacagcgcttaccccaagctagtgatactgaatcactcatctttatttgctccttagccttcaaaaatgtaagaaaacagctttataacactttggggcccttgatctgcaaaacttctctttgaaatctattctcgtttattataatagaaatgctagaaaatagtttcctctgatttattgatcttaccaaaatagatacagtctttaaaaacagcacactgtctcttcacttcagaaggatctagatttcaggctacatttgcattgtattcatacctaatattcaactggaccacagcacgtatttaactcattgtactgtaatggggttgaatgaactgacatagattgctatgtttaatataaagaaatcagtgcttctggctccacaaagaccacatgaataggaagttcacaatagatggttggcataaatgtcaatattcacaaaaaaggtgcctctctttgaaactgctgccagagttcctctccagacttgtactttggacccctgcagaatgatttttacaggagtaaaatccctcccccctcagaatatgcaggacatcatctgtatttacttcaatataacataaaccaaaaggcagacctggtcagaaagttagatgcttctctagaaaaattatgctagtgattgaaaacgaaaaaaacacggagccttgaattgcaggattatgtcaaccctggaaatattaatcacatgacaattatttttcaaaaatttacacatgtataaaacaacattcacaaacattgtatttcaccaattcttaacttcaaatgggaaacaaaactttgtggcaaacttcagttaaatttgtgtctaaatcctcaatgttgagtccacttcccatgaatactgaaatttactagaattagttccttgtagaagaacttccccaaagtggggctgtttttatttttatttcactcacaaaatgtgtgagcatgttaggatttttccctttacattatttcttaagttctaacacgtaacacacacacacatatataatatatgtatagttatatagttatatagtttatataaccagagacagacacattaagcaatgcatttatatgtaattaatatacattggctaataagtattggtgaaataccacacataacaactatgtaacttgtcaggaacatgattgtgtttctataagcctattaggatacattcaaaggaaaacaatgtggtaaaaaaaaaaaaaaaatccattcactgtaatatttagcctgtgggaattttcatgcttttgcagtgtcagatttctgtctgaattaatttttattcaacagggagacaatagattatgaaatgctcataaaaaatacaggatccctgcttcaacacatggtaccatgagaagcagcattagaaaggatcaagctcttttctccctaaatcagtgttcagcattatacttctaggctatgtctcttaatacttcctttggttggcattattggattactgcaacccaatctttagccttattattgcaagaaagcttaaaatagcagataaaaaaccttcaataaccagcagatagaaaaagctaaccaaataatagttagttcatgtgaatgccacgtggaaccaaacatgaaagtatttattgaaattagattgtatgaagaaacatactaattagcatcctttagcatttggcaataaaatacaaactaggaaaataaaaggaacatgttaatcattaatgtcactatgactttagttctattttaaaaaatgtttaaataatgagccacaatataaaataattacatgtcaagtcaattcacatacacccaacacacacctatgtatatgcataattaagtgaagaacaagttatcctcgcaaaggtagatgcatttgaataggtcctattcttttctagtctgttctgttctattccattacattattattctacaaacactgttcatgaccaataaacgtattttaccacccactaatggatcacaacctgtagttaaaaaatgactatcaaacatatgtgcatttataaattaatgtatgagaactagataatcatgcatactcatatcacataaagtattgcatatacaatattaacagtttggcaatttgggtaacacttagctttaaaagctaaaactaaaccaagggaaaaaagagctttctttcatgattttaattttatttaaattcctggtttattgggtatttcctttcttcccttcctccaaatatatggtccgcttttcaaagatgtgtgcatgtgatgaggatgatagcaatgttgagaatatcgccccctgccacctggacagtaatctcaattgtcagaatgggtcccactgccattatgacatacttcatattcagataaagagggaatgatgggcttagatgatacgctgcaaaggattatgttgtacctttaaatatctcatatcatctgcaaatttggctccaattaccaagtgggtcctcaccaaggactggctgaatgagaaatgagtgggaggttgaaatggggatgtctgggagcgggtgtgggggaaggtttcattctaagatatgcttcatctcacttaacataaggagaaaacaacttttactgggtaggatacaaattgtgcatcttaagctacaattcccaaactgttttgggaattgtacaaatgaaaatataaatgaagtataatataaatatagataagctgttttgggaataatacaaataaaaatataaaaatgttttataaaatgttataaaaatatttccttttacaagtataatttccatgtttctaaaaaaatacagtccattatttcttaaaataccaattcctgacaaataaacagagagtttagataatttttacaccaaaatttgtggattaattcagaaaacaattatagcaacgtgagattatttttgtgatagaattctgtcctttcttcatctgatcgctcaccatctactgtgaaacacaccactctatagccactcagattattttatatccatcaattatgatatattcattagtcttaaacagctagaggcatttgacaacattcttcctgtgtcagagtctaggaaattttttttgaatatattattttaggaaagataaatgtttctaaatcagtgtttgacatgtattttgaatcaagacccacaataaaaaccttagatccacccatgccacactcacaagtctgactctttcctaaaatgccaaacaaaacccaatttttccttactatggttattataatttattccatcctattcaatcccctaaatactggtgaaaacgctctgaactgattttacaactccatcgtaggtggtccccaggtggaaaacaaaattgtgctaatccaatcaggtcatggactcctgaactgcagtacaactatgccataaaaatatcatcatcaaattctcatttgcactacttagactcaaggggcaaagggcgactttactaaaatatattagggcaaagtatctacttttataattcagagaaagacattagaattttatccacgagtatataaaattaatgatatattagagtaggggtcaaaatctggcccatgggacaaatctggaccacctccttttattgtacaacctgtaagctaaaaggtttctacagttgcacatttataatctgtctgatgacagggaacactaactttgaagaccagctaggcattctcacaaaaaataatcccattcttactggcagacctgtattacaaaacattattaatattgatattatgaattgtttttgaatttcattaataatagttttgtgaaaatgtgttttctctcctgttatataattatctacatataatattttcaattttgcctcttggcccacgaagcctagaatatttgccatctggcccttcacagaacatttgctgacccaagtatttgagctgcatgaaaaataattgttataattattattatatgtacctgtcaaatcagagagtgatctggttctcaacctcaacacaccctgagtctcaagtggacacatggggaatacgcacatcaggtgtgtaactggctaagtgtatgagtcacgctgccttcagtgagccagatgcaaaaccgtccccttggttatagggagaagtgtctcgctgaagagcagtccctctcttcagtcaaggaaactcagatgccttcattaaaaataactttgcatttattttattaagtgccataagcttgaaggaaaattgggcttttcggtcactgaaatttcttttcacttaattccttccatatcatgggaccgtgtgcagctctgcagcgggagacattgtacttaataagcattgcagggagatgagctgttcccgtctccttgcaacagcaactgcattttgcataactgacacttatcgcccagataaatggtattattgggcaacctcatgtttattgcacttgggaaattcacatttgtttctaggttgacatgaagcagcgtaggttagctccctctgtgtatattttccactagaagaaaaaagttgtgcgccatcctgatacacagtaagttttcctaaaaagatgttttgctctttgagatattaagattttaaagtttagcactggaaaaacacaatttgaatgaatatatagatttcctggggcggccagggaggggacgggtatttatgccttcgcttttcatttttcccatgttttatttcgactgctcctgcttcatgctctccttgtctcctgctctcataaagacttctcttcagaacacgctgaactgaaaaccttaaacaacagtccacgccgccaacattcatcacttgttctcattctaactaggggctgagccaaggtactttctattggcgtaatccctgacagttgtactcatcctagaagtaatattttacaactttatgaaaatcttacttttcatgacatgtgttcatcaaagcctcatttcttaaagactttgggcttaagaatgcatagaggtttctatgactgctttgggtgctgatgaaatatctttggccatatgcctatttcagcaataactaataactttttcatatgaaaggaccatcttattaaatcctcatttcacatgaacacagaatggtaaacaacctgtctcagcaaaaatgtgagacaagcccaagatagaaaaaaaatgttcaatatcacattgaaaacacatttgggagagtaattagaaaataaaacaaataaaacaattttcacagaaagttgattttgctttcgttttttttttttttaaaaaggcaacaccaaaacacaaaacacttaaaaattttcctggagcaagatttaatctattggaaatagattataaaacaatcaagtctaacaattaattatcttctccgtgcataagatattatagtttatttttgcttgctaaccgctaatgaaaacaatgtttttaatctaagcaaaggtttattgttgttattgttgttgttggaacaaagaactgttttccaaggaaaaagagtgaggcaggtctagaactaccgatctacaagaaagttctaaaaatatattaaatatttctttgtcattaatgaacattctaaaaatctttctgttgcaagaaaaacagtaaatctgggacttaactggtacttggtcttcctagggtgtttcaccaatgttactaacataattacgggtatagagttggtaggaagctggaggagatgattcaaattctctccatagataaacttatgcaggttaatgcgtgggtgggaacaagtgtcctcaataggccttgcaaagtgccaggcaccattacaagcgatttatgtataaatcactttatttaattctcacacaatgctatggggtagcggctactaatgccagcactttacagatggggaaactgagtcacaaagacacaagtaagtggtccaaggtcacatagctaacaagcagcagaggcaggattcaaacccagagcatctggtgcctcctaatccctgctcagaatcaacaactggtaagcagtgatgtcatgactggaagccagctctcccagcttttgctccaactgtcctgatagcagccagtgaggtgagcactgagagagaaggatggaacagaagacatctgggttcaaattctgccccgtggattcccagctggcccactgatgtacacatctgcttcttagtctcttccacaataagaggggtaagatcctatccaccactctgagttgctctgttaatgaatgaggtccccattgcaagagcaattttaattaaggagatgcttagtaaacatcacttctctctcttacactacacatattctctcccttaaacctttctcagttccctgcttatttataaactcctacagccttatattcaagggaagcaagactttgaaacagctagaattaaagtttgacatgacttcaaattaatcaggattctattttgtgccaatccatgggggaaggtactgagtagaatgtgtttcttcaaaagacattttactaattgtgttttctagatgatttaatgccagccagagaaacatacaatttgtagattgctgaatacctgattttaattcccaagtcattcaatacttgcacatgatctaaaaaatacaattaaaacatggtcttagttgtttcttagaaattcaaaacaaccttatttctttatataattaagtgatgtgacttttccagaacacaaataatgatgtattgatttaaaacaaataaatcatacatctcaaattacaaaactatagtttttgtagacctcagtgaggacgtgacattcgagaaaatgtctccctggcttctgacatgagaggagacaggagcaggggatgtggcttgaagatggtggccacttagtaagctcaggatatacatatgtgtgcatcattgcaatacagatgataatcaaagccttgagtctggatgaaggagggaaatagatgaagatgggcagagaacagatgtgagcactgtgtctggggcatccccaaatcagccactcctccttgaagcactctcttctgaaaacccaactctcctggtttcctcctacttcccaggccccttcttgatctctttccacaattctccctcattgcttgatttctaagtgatggcagccctggggctcatcctggtcctcttctcttctttaccttcactcactcccatggtattcccatccagtctcacgactttaactagactagggtatagtgcatagtgggttgcaaagtggcccccaaaaagatacatccaagtgctaatacccagtatctgttaatgtgaccttatttgaaagcagtgcgtttgcaaatgtaattgagtttaaggatctcaagaggaaatcatcctggattcagggtgggcacaaaatccaatgactggtgtccttataagaagagaaaggagaaagagattcgtgacatgagcacacacagagaggaaggccacgtgaagatggaggtggagattggagtggtgaggccacaaaccaaggaaagccaggggccactggaaactaaaagaacccagaaaggattatcccctagagctttccaagggcgtgggcctgctgatttctcgattttagacctctggcctccagaactgtgaaagaatacatttctgttgttttaaaccacatatttagtagtaattggtcacagcaaagcccaaggaaactaatccactatatttttgaagagaaaaagaaacgcatctaatgaaaattctcccttactatgtagaacagcttgaaaatcattcccccttgcctttttttttctttcctagagcagtgagagaaaatatttttaaaataatcttcacagaatagaggatacaactcaatagaagttttggttcttaaatattatctaagaaaatgtaagcttttgaaactctcccttttactgagaacaacagaaattacagatttttcaaattttataattcacatcatcaatgaagatggaataattctttagaaaaaacattttgaactcacttgttaattaaaaaaataaaataactgcagaacagcttaagtcccagaaagaaacttcaatggccagtctttaagagctgcttttgaatagtatgggctgctctggtgctttaagctttttaaaaatatttatttatttatttatttatttatttatttatttatttatttatttttgagatggagtctctctcttacccaggctggagtgcagtggtacgatctgaactcactgcagcctcaacctccgaggttcaagagatcctcccacctcagcctcccgagcagctggaattacagatgtgtgccaccacacttggctaatttttgtatttttagtcgagtcaggatttcaccatgttggccaggctggtctcaaactgccgacctcaagtcatctgcccgcctcggcctcccaagtgctgggattacaggtgtgagccaccgcatccagcctgctttaggcttttatgctgtctgacttgggaaacaacaatacccaagtgcacttccctttccagacacccaaccaccccatagctccggtctctctctcagaaagccagcatatctacaacattgctgcaaagcctcttgtctccacttttctgtaccgcacagtagttacttcttttcttagggactttatcttggctccaacacctctgtcctgctccaacacattctctaaaaatcccaatatccctccaactaggatgttcttcttaatttcttataaactctgttctcctcgtccctccccaccagctatctccatcaagggtctcaagggacgcgccaatccaatgcttctctacagtcgccattctactcaacctctacccactacagataagctttccctcttgcatgtctggccttgcccttgaactatgtttatctctctcctgcctctgcttcctcactgggcttcttttacaggtcctatttccttgtctttcatttatttattcaacaaatattcatggagcacctcttatgtgccagacactggaaagcatgaagaacaattttgtcctccacagtgcttgcatgccacggaggaggaaaacaggagggaagacatcaaagcatgttgggcagctccaggtgctagaggggacaagcacaaaaatgacataggaaaagggggagtgggaaaagctagtggccaggaaagacctcagtgaggatgtgacatttgagaaaatgtctccctggcttctgacatgagaggagacagggggaggggatgtggcttgaagatggtggccacttagtaagctcaggatacacatatgtgtgcatcattgcaatacagatgataatcaaagccttgagtctggatgaaggagggaaatagatgaagatgggcagagaacagatgtgagcactgtgtctggggcatccccaaatcagccactcctccttgaagcactctcttctgggacccacctctcctggtttcctcctacttcccaggccccttctttgtctctttccacaattctccctcgttgcttgacttctaagtgatggcagccctggggctcatcctggtcgtcttctcttctttaccttcactaactcccccacggtgttcccatccagtctcacgactttaagtagactagcgtatagactggggtaataatataatttgctgtcaaaacctgatgcttctgggactgaaatggggtgatgtaaatatttacactgaggaaaaaggcatccatgggactgtcttgggcagatgagaatacatgattgctcggttctatagacaaatacctgttgattttataacaccaatccagaaccgtccctgtcttccagactgtgatgtccattcaaatacttaagagacatttgaaaccaaatatgaccaaaattatgacaccccctccaaaactgtccctctcaccatttccagcagctcaattaatggcaacccatccctgcctaaagcctatattcaacccatcaacactttctgtcatctttaccttgaaaatatgcctgtaatctgactacttctcattctcatccctgcacccctctggtgccccatcatctctgttccatattacttcaacagcctcccaattggtcttcctgcttctgatcttaccccctggagtatactttcaagagagcaggaatagccaatccacttcaaagctaaggaaattcatgttacccctcttaagaggttgaatccctctggtgccttgcattagattagacgattcatccattgctataaagaaatacctgagactgggtaatttataagaaaagaggtttaactggctcgtggttctgcaggctgtacaggaagcatggtggcatctgcttctggggaggcctcaggaagcttccaatcatggtggaaggtgaagtgggagcagacacatcacatggtgaaagcaggagcaagagagagagagcatggtatgggggtgggatgccacatagttttaaatgtccagatcttgcaagaactcactcactattgcgagcccagcaccaagaggatggtgctaaaccattcatgagaaatttacccccatgatccagtcacctcccaccaggccccatctctaatacaggggattacaaattcaacctgaaatttggttgagggcagatacacaaactatatcatgcctgttcaccttacttgcaataagagtcaaagcccataccccagccacactgaattttaaaagtctaaggtcttaaattgtgtaatttgtttttgctttccccaacccatctctataagcagcatttattgtaaagctcagaacatttaaaatccagcaacattttaactcaaatgaacagagacacaggacagaaagtgttaataccaacctactaaaagaagatcaaatattaatgtggtggaataataaaggaataataataatagtgttttagactgctctgctgccacacaaaataccagactgggtggatttaacaacagaaatgcattttctcatagttccggagggtggttaagtccacagtcaaggttccagcaggttttgatttctgatgagggctctcttcctgggttgcaggtggcaaccttcctgctgtgccctcacatgatggagagagatcaaactctatttcctcctcttttgcaaggacattagttctgcgatatcagagctccacctttgtgacttcatttaatcttaatcgcctcttcaaaggacctacctccaatacactcatagaggggagttagggcttcgacatatacattttttggaagggaaacacaattcagtccacagaaacagagggaagcatttacaggcatgtttctctcttacacacacacttggcaatccctgagcactttcagttttgtcctgtgggcctcttccttcccctagtttttccctgaaagttgcatgctactccagccctgaagactattatccagccctgtctcttcttcccacagacccctcctcagctgtgtgtccttcaactccctggatcaaggagcaaacagagtaaggagtgtgggtggtgtacgaaatgatggccctgggttgggagaaagcctcatttcagatcaaggtggggaagaaaaaagcgaaagaaaaaaagatcagacttcaccttctttgaatcagcatgtaacatgttcaccacacatgaaatcctccagacaaattaacgaccatgtagctagtgtattgcaaaaaatattatatcaaacattttatgttttcggccttttaatggcagacgtttgctccttgggtaaatggtttcttcacctttaggaaataattgcagaagcccagtaaatcccagagaggataaggtcactgagggaaaggaaaggctaagcatgtttacattattgactaaaatggcttgggggagctacgtttctggaaatgttcacgaactccatcaatttttctaaaatgttccttttggtgactaaagctgttacctcacgagaggtgttagtgctactgaaagcaaacagttataggaaatagaatttcatgaagcaacagcaaatagccacagaattccacgaagcaatggccaatggcaaaaacttgaaagagtatgcaaaataaagtcaacatttgtggactgaatctgttttcctatcatgtatattagtttgctagggctaccataacaaaatatcacagactaggtggcataaacaacatagatttgtttcctcacatttctggaagcttgagatcacagtgtcaacagattggtttatctgaggcctctccccttggcttgcagctgactgcctcctccccacccactcacatggtcgttcttctgtgtatgcgcacccttgacatctctttcatgtctaaatttcctcttcttataaggacaccaggcagattgggtgacggccaattttcactgcctcatcttaacttaatcacctctttaaatggcccatctctaattacagtcatattctgaggtactgggggttaaggctttaacatatgaattttagcataacacaggtcagcccataacatagtgctgaataaactatcccaaaacttagtagcttaaaacaacagtcatttattttgctcagaaatctaatttgggcagggctcagcagggacggcttatctctgttccaggcagtataacatgaagagactgaactggcattggagaatccactctcacggtggttcgctaccatggctggcaagtcagtgctggttggttgtcaacggggcattcagggacagggccatgggctgaaaacctcagaatatcagcacgatcagtcaatgctgttgggtattggaaaaaaagcaattcatgcttctcgtctgacatttctaagcttcctaccacagcactcaggagagtgactggcatgaagtaggtgctaaataattacgagtttttaagtgcccagagaagatgtactcaacagggagagttaagaggttccggacttgataccctctctctcctagcatgcagcatcagcaactgatttcaaacatgatgtcgggaagataatcacgtgttgttttgaaaatcactccaaggtggttctgataagctccaagcccccataaagatgaacgctacagcctcgatttacaaaaggccagcagctcctgctagaaatccaggagatcctcctctgatgcatacactgttagggaacgactgttttgtcttcctgtagatgctaggcaaccaacattacttagattatcctaggagggtatgatttacatatcttttttgaatcaattaattctgataaaaagtgggctttcatatgtaaacttaaatcttgcattgaatatttatagaacaataagccatgagtaagtgcaatgcttttaaattattcctttttatcttcaattgtttatacaggtttaacggcaacaatcttaactaacaacaagtaatgccctggctatttattgtaccatcgcatactgatatatctttgccagataatgtttactcaaaactcaggaaactcatgttaaaacttgcctcgttctagcactccctcttcctcagatctttttaagacaaaagatttacaaattaagacccttcagctgactcaagctcagcctgatttaatcctcaatagccagtcttacaaaattctcctaaaatgctttgacacccttaccaatgttatttgcttgcttttaccccagcccctatgctttaccatgtttactgaagaaattctgagtagtttttaaccagactgcttaatccatgagttaactctcaggaaaatcctgtggttttagtcagacaaaattaagatttttttcccatcctgtatgggaattgaaatcacttgcccatgcccagtgtacaagtaaagaccactgtttttggtattttctatggtataaggagtgtcatgataccaaagagatatgtcaacttcctcgctactgttaacatgggaggaaaaaaagaggagggaatcggctgggcgcagtggctcacacctgtaatctcagcactttgggaggccaaggcgggcagatcatgaagtcaggagtttgagaccagcctggccaacatagtgaaaccccgtctctactaaaaatacaaaaattagcggggtgtggtggcacctgcctgtagtcccagctacacgggaggctgaggtgggagaatcacttgaacctgggaggcggaggttgcagtaagccaagactatgccattgcactccagcctgggtgaaagagtgagactccgtctcaaaaaaaaaaaaaaaaaaaaaaaaaaaaaaaaagagagagacatgggaatctgtatatttggaattcaaaatgaagaagctaatttaaacaaatacatgttagattattcatacatttttagaaaataagtaaatcacacgttaaatttttcagaattgaggaaattcatgtaaaccttagaaaaagtaattccttaagttaaacagtagcagccatgcaatgcggaccttgtggttctgttcacgtcgtctgacgtgtattgtgtttttcccttgtccagtgtgtctctaatacagtcttcaacatgtgggctattagcaaccaccaccataaaactgtttctcaatactgagatggtccctttactgaggaaagcccagcacattcccactgctgcctggtgtgggcttcacgctcctctctattaggagaatgtggttctgagccgcatcaggtgttctggtcatgtgaattcttcagccacatggagagcgtgaggcaccatctgacagcactccagggttgtgcagggctgtcagtaccgggctcctgttgtggggaggtgaaggttatgcagggcctatctcattatttttttattttatttttttaagttccagggtacagatgcaggtttgttacatatgtaaatgtgtgccatggtggtttgcttcacctatcaacctatcacctaggtattaggctcaacatgcattagctctttatcctaatgctctcccagcctgccccctggacaggacccagtgtgtgttgttcccctccctgtgtccatgtgttctcattgttcagttcccacttagaggagagaacatgaggtgtttggttttctgttcctgtgttaatttgctgaggataatgacttccagcttcactcaagtccctgcaaaggacatgatcttgttcctttttatggctgcgtagtattctatggtgtatatgtaccacattttctttatccagtttatcattgatgggcatttgggttgattccatgtctttgctactgtgaatagtgctgcaatgaacatacatgtacatgtgtctttataacagaatgatttatattcttttgggtatgcacccaataataggattgcagggtcaaatcgatctcaccattaactttggcttctaagcatgtatgtgttccaggctggaactttgcctctctcactgtctggactgagaatggaggctgagtgatagcagaaaccagaaatctgcttcttttgtgtcacaggggtctggtggcctgacagagcccccctccttgacaaagctttagtcaggttcctataagccttcttctcaatgagagctcaatcttgactctgtccttgctaagaccagttttggcaagaatactgataatttagtttagagagaactcccacctttgatatctgattccccttaatgtctgatcaagttcctcatccttcacaatactccaggttatatctgctgccccagcaagaatcctgttagattagcaaagaaccatctccccttgaggccccctcttggtaatttttcatccactgaccccacccaccactgccttcctccttagctttaagtccccacttttccttgttgtattcagaatgaagcccagttctatagtgaaatctctcttcccctattgcaatagtttctgaataaaatctggttttgctgctttaactactgtccagctctggttctttcacaagccccagtctaaaagtgttcctgaaacagagcagaagatcaaagacaagggagaagagttctggaaaagactagaggataaacacaaaagtgtatgaatactagtgacaggtgctgatcaatatctactaccccttaaatttggagacccaaaagccagaatgagggggatttttcccacttccctccagaaaatagacagctggcccctctgcaacaacctcttatgactgcagtagaatgaaacgaaagaatggcaggtttgggtacagggagcctgagataccgctccttccttttgctccaattcttacctccgcttccctctcaaccagaatcctctttagctcctataagcccaggaggcctttcctgctacccataggaactaaggaggtggttgagagttaaaagccagggggtttatttccaggaactgagggagagtgcacacatatatgttaaatccaaagtgatttttaaatacattaacaatacacagtgtaatataagtgttaataagagagcataggtggatgcagatcaataatgatgccacagcataaatgtaggagtaatattacaaattagaggacaaagatactggaaaaataagtgcttttccagcaattgatatccacatgaaaaaaaaaacagatccctacctcacactacacacaagaagttgaagacatatttgggaacaaatgtgaaaggttaaacttaaatatttaaataagaaaataaaggagcatgatactatgaacttcatataaggaagacttttagacatataaagaacaaaatttaaatgctttaaaatttataagtaaaaaaaaagagacatgccaccagttggaagaatttataagaatctagataccatcaataatttataaatgcctcctatatagttaataatggttttcacttatgaacaaatcccactgaaatacttcacatgtcttaagttattaaaaactcagaaaagctcaacaaggtaggtgcttgtattagactcttaagcataaaaagactacagatattaaagataaaaattgcccaagatcacatgaatagccgatatgggacctgcacccaagtgccttagttctagcactctcactcgaagccaacagtaaaatggggacaggactgaggaaaaagcaagtcacagaccactaacaatgctgaacacgtgctaaacttcagggataactggggtaatgcagagggaaacaaccaacccatcaaactggcaaagatttaaaaggctaacaggagttggcacatacagggtgaaatagaaactgtcataaactgacagtgggagtataaaatgggcccaagcattttagacaacaaatggagagtaattcttaaatttgaagatacacgttcctctggtttagcaacgttcatgctctgaaaatactcttccacatttgcccaggacacatgcacaagaacagtccttgcttgctgtctaccaataagagcatggaaaccatgtaagcatccatcaatcagagaacagatgaatgcactgtagtctatccatgcaatggaacactaccaagtaggaaaagaggaatgaaatctacatatacacacccacatggataaatctcaataacaccgttgagaaaaaaagcatatttccggtatctctgtatctctgcaaatgtagtatgacgctgtgacaaataattttatgtgtcaatttgactaggccacagtacacagatacagtatttggtcaaacattattacagatgtttttgtgaaggtattctcttagatgagattaacatttaaatcagtcaactttaagtaaggcagataacccaaaatgcgcatgggcctcatccaatcagttgaagcccttaagagaaaaagactgcccaccttagaagtaaaggggattctggctgcagacttgaactctcccttgagtctccagccctgctgacctaccctgcagattttggacttgccaagcctccactattgcagaggccaattccttaaaataaatctctctctttttatatagacatatttttgttggttgtgtttctttggagaacactgagtaatacagatgccaaaggtgccaatgtttaaaacacataaagcagttcatgggcaaacacatatatgaatggcatccttagaagtgttcaaggtagtgtcctgcttaattctcaatatgcaggaataacagtccatatacgacctttacagtactataaagggatgatttgaaaagttttattaacatgcaagaagtgcaggggacaggcttagacaattctgagagctgcatttagagtacatttcgtttttctagaaagtgaatatgcctccttttctagcataagaagataagttgattttcctcaattataatttgaatcactggaccagttccaaaaaactacacaaaaatgctacaccaaaataaaaactccgcatcagtcagttgatacaataaatgcgaattaccaattttcctcagctgtagtttttttatttttattttgtaacagcaaataatttattttcttatgtgtattataatttacaatgtgtttttctattatgaattaggggaaaatttctggaccatgtcagacatcattcaggtatgacacttatataattcaatgcattctaagttattaaactactgtaggcagatgcattgcggcaggttatttgtttttgcataaaacatgccaatattttaaggtgaggtggcatgggagacgcctgctatatatttaaagtcctatgagattaggattccaaaagtaacacaaacattaaatgacactgatgtactgacaatcatctacattcatgttcttctttttgtgcagaaactgcttctaaaatgttttctagtgtgccttcaagtattttttttttttaaatacgacttgggaaaaacaactgctaactaattttaacaccatgtcaattatgctaacaaaattctaattgaattacttgtaatgtaaatcagtctttctttgtgttgtgtgagcgcttgcatgggtgtaattattatacaggctgtcaggtatcagacactaactgtatcataaacctataccgtgggcttgcttgtccacagatcttttgatatatctagctctgtcttccatagctttggacaaactaatgggggaagcacaattttcaaggtaccacagaggtaaaccaatggattctcattatggaaatgcagcagtctagaaagaaggaagagactgagtgttcagaattgacttttttaaagaaataagagatcagtggatgggatttatgtcacaaggaattcaattagttattttatttcaggctgattatatgagatcctatgatgagaaaaaaaaagaaaaccaaaaaagaaaaaaaagaaaaccaaaaaggaaaaaaaaaaagaaaaccaaaagagattctgtactgcaagatataagaggaggcacctttaggggtgccaaggatgttgtaacttcaaatgctgtcaaatgtggaaaccccggcagagcacatgtggacatttcagcccctcagcatatagaatccccatgtggcctttaccactgacatgatcagtctcagctctgatgtggccatctccctgtaagccttttgcagcctgccatcccccccgcctgtgctcccaggccactatctgcacaccttagcacaggtctcatgagatcctcgtgctgttctctgtgtgcatgcctctgagtgcctcaagaagtgcctgttttctcttcccagtgtccagagcatctaacacagtgtgtgacacaatgcaggtgaccatggaaacaaaataattctgtcttgcaaactttcactcagatgctcttaagcactcctagtctgacctcaggctcagattccatatcccagtggaggaacagctaccgagtagcacaggggaaaacattctatgctttttaactagactgcgtatggcatcttctcttatcaaattggatttggccaaaagaacaacagctgagcactgggaaagttattcttagtatgctcacaaaagagcaactcctcgccttcaaaatagtcctctgcatcatgagtacagatgcactctcctgcagagccaactgctcagacatccctatggtatcagtcagacgcctttggatccaagtgacaacaacccaaaagattaaaccatcaaacagacaacaacagcaactgctctctgggcccaggggaccttaatcattgggcttctgtaacctctaaaagagaggctcagaatgagtctcagagatcctctttccacggttcccatctaagcttctcttttaatgtcacctctcatctcttctaaggccacctgtggctccagttcctcactattaaccaccagagataaatgcagatcattctttttggttccaagcccaaaagttccagggaagggctcccatgagctcggctggggcaaggtgctgaattctggagtagttactgtcaccagaaggtggggcactatggttggtgacctctggaaaaatcaccaggatcacgcagcatcagaaaatggttccctttgcaactacaaggatcgagtatagagcaacacattttccggaagacaaggaggtagcattctggacacataaactaaggaatgtttacttcatactcctaaagagtggagaatagcagcatttttacatggttttacaataacgatgtgtagcaatttccactcccctccctcaccattagcaaagacccactctcttgctacataagtctctaagtaatttaaaagcctttgcattctctcttgaactaggttataaaccctgtgagaacaaaacaggtttttaattatgcttataactacctatgaggtacctgacgggatgctcatcgcataagaagagctaaacctagcacacatatgattgtgtttctatttgtagctcacacaatgatagtgcattttgtacccactttcagttccaacaaaaaaagcctttgaccatttctacctctaccatgacttttcctcccttaaataccacttttatattgagaattacatttcatccataaatgagtgacctcatatgaataaacacccatcatttcatggaatctgctgaacaaatgatcctgaatgcaactataatttaccttcagagagagcttttaaaaagctataaaagaattatatgaaaaggtacgtttcatagagaacatctgttttacccatgatcggtccttttaaatgatctctgaagtcaacttggtgctttggtctaagtcttgtgctcagatccctctatcacattaaaagagatgaagcaaaatctgagtctttttaaaaaactctgatggttttaacataaagtaaccttcgttgtttatttaacttcatatagtcaagcaggacacactgagcccctaagaagggacacgtgctggcagctggctttgtgaagtttaattaaaccgttgattttagcagagtcctagggagttaacacgtcacctatattggagtcttcatagaggaaatcatgctactggggagagagggaaatcagatacatgaagagaagtgaagagaagtgatcatggattaaccatcttcaaggaattgcgggtctcctggttactgcttggtgctgtcctgccactcccacactcctgactgcggtccatatctaccctggggattcgtccacccattggtgctgtcaactaaaggcaacagcctaacctgggagccacttcttcccacaaatccattttccttcgaatgtctcttttcttttcttttttttcaataatattaaatatattttcccatcattctaggctagaaaacttgaagtaaatctgaatttccttctcactgtttaggttgagtctccaaatgccattggatttttctctgcagtttttctcctattcattggtcccaagtttgatcctgttccttcagttcacatgaagtaaatcattttcccagtttactgtgtcaatgtctgccacttccaattccttacacaattattctcagatgagtctccctcatacacacacttgcacatgacactctcctgctcaaagctctcagtggtttcctgttgctttttaggggcagggaactaaacttaaagaaaagaaactctggtcctttctctctggtaccgccctatctccccagattctcctgccacacttgccaaactagcctattcagttttctccaaacgtatctctagctttatgacttagctccccaaatctccccagtacctgataacatggaacagaaaatgcctgaaacctggtacaaaataggcaggcaataaatgtctgtggaattaatgaaaacatacagacaaaacatttatttcctgatgtcttgcaaaactgtatcatagccacatttctcttcagatttgcatttaccataaatttttgcttgctatacaaaccagctatacaaagtttccctaaatttaaaaaaaaaaattccacatcctgacctatccaccccatagaccctgctcctccttttgagtttctagctcaactcatggtagcactatgttcgaatctgcttgtgaaaactagagacctcagaataatcctcagttccaagttctcctgcttatgattgaagagttatctgcattgccatgtaataacgacaataaaacaacaataacaaaccttacatctattgaggatctactaaattatgagttgtgttgtatctttgcccaactaaaattcataaattgaagttctagtgcccaataccttagaatgtggccctttttggacacagggccgtagtagatgtatttagttaagatgaggtcatactggagtagggtgggcccccaatccaatattactggctggagtccttctaaaaggagggaatttgggcccagatattgatatggtttggctttgtgtccccaccaaaatcttgtctcaaattgtaatccccataatccccatgtgtggagggcgggatgtggtgggaggtaattggatcatgggggtggtttctcccgtgctgttctcatgatagtgagtgaattctcacaagatttgatggttttataagtgtttgacagttcctccttcacacactctctcttgcctgccgccatgtaagacgtactggcttccctttctgccatgattgtaagtttcctgaagcctccccagccatgcagaactgtgagtccattaaacctcttttctttataaattacccagtttggggcagttctttatagcagtgtgagaacagactaatacacacatactcagggagaataccatgtgaaggctgggtgatattgccacagcccaggaactgccataagccagcagaggcctggaagagaccctttcctagagctttcagagggaatctggccctgccaacaccttgatctcagacttccagcatccagagctgtgagacaatcaatttctattgtttaaatcctttggaagcccttagaaactcatacaccaagcatcagccaatgtgctaaaatccttcgcaaacttagagttatttaatgctcacaatgactctgaagtcatctagagttagagattcatataattattatgccattatacagctgtgcaaacaaaggctggcttagaagttaagcacctagttcaaggtcactcagataagctcagctatttatcaatagcagagcaaaccaaaacatctgtgattagaaagcccaagttcatacacactaaactccaggcctctcctgatacatttccaagcagggacaatgttatacaggtgaccctcatacaattccagggcataatactgtagaatttccacttaagatattcccttaaggtgctctttggaaatagaaacttgaacataattcatttcattttaggtgagattgtgttcacaaaaagatatccaaggggaacttatttttatctaatttatcagatgtgacatttaaaataaaataactcataaacaaagctaacatgctccactgcacatttttactgtttcttttataatgcaaacatggtattacccttgttaaaagaaattaaaattgtagcatcacacagtgcacaaataacaaaaattacattctaaaaacatttcgttcacagtttatatttattcttaatatgtgtagagcaactgaatgaaaaaagcattcaacagccccgacattcctttgctatttcaaacagtggacttatgtaaactaataaacacagaatacaaccaccttttgtttaagcattaaccacaggcaaaaaagactccaagaaatgtgcccacatttcttggagtcttttttgcctgtggttaatgcttaaatatatatgtatatatatttcctaaggcaaagttgtgagttgtgagttttactaaattatgcctgtgtattggaagcaataatagaaccagcccagcccagagctggtctagagcaacagttctcagagtctcaaagtttggttcaggaaccccaggactgccttccaggaacccacaagatgaggacattttgcgtaattatagtaagccatgatctgccctttcaattttcttgacatttgcactgaagctgcaggagcactggtgggtaaaactggtgcttgagcatgaatccagccagtgacatcaactcgtacatatagtttcactgtcacaatctcaaaaaaaaaaaaaaaacaaagccagttccaattaagaatgtccttgatgtcgcagtaaaaatgattaattttatgaaatcttgatcctcaaatgcatgcctttttagtatttgggtgataaaatggaatacacataaagcccatctgtttccaatggttctctcccagaaaaacactaatgtgctgagttgtgaaatgaactagccactttttcatgggacatggttattcagtcttgggtatttgcaagtgtttttcttgaaaagggaaaaagcaagctcctcgctttatggaaatcaactaaccatatttgttaccaataacaaatatgataaagttcaagctttcatgcaaatatagaatgttggaaaacttacatccaacactttaagcttgacagtttcaataaaatactggcaaactgaatccagcagcacatcaaaaagcttatccaccatgatcaagtcggcttcatccctgggatgcaaggctggttcaacatacgcaaatcaataaacgtaatccagcatataaacagaaccagtgacaaaaaccacatgattatctcaatagatgcagaaaaggcctttgacaaaattcaacaacccttcatgctaaaaactctcaataaagtaggtactgatggacgtatctcaaaataataagagctatctatgacaaacccgcagccaatatcatactgaatgggcaaaaactggaagcattccctttgaaaactggcacaagacaaggatgccctctctcaccactcctattcaacatagtgttggaagttctggccagggcaatcaggcaggagaaggaaataaagggtattcaagtaggaaaagacgaagtcaaattgtccctgtttgcagatgacatgactatatatctagaaaaccccactgtctccgcccaaaatctccttaagctgataggcaacttcagcaaagtctcaggatacaaaatcaatgtgcaaaaatcacaagcattcttatacaccaataaaagacaaacaaagagccaaatcatgagtgaactcccattcacaattgcttcaaagagaataaaatacctacgaatccaccttacaagggacgtgaaggacctcttcaaggagaactacaaaccactgctcgatgaaataaaagaggatacaaacaaatggaagaacattccgtgttcatgggtaggaagaatcaatatcgtgaaaatggccatactgcccaaggtaatttatagattcaatgccatccccatcaagctaccaatgactttcttcacagaattggaaaaaactactttaaagtttgtatggaaccaaaaaagagcccgcattgccaagtcaatcctaagctaaaagaacaaagctggaggcatcacgctacctgacttcaaaatatactacaaggctacagtaaccaaaacagcatggtactggtaccaaaacagagatatagacaaatggaacagaacagagccctcagaaatactgctgcatatctacaactatctgatctttgacaaacctgacaaaaacaagaaatggggaaaggattccctatttaataaactgtgctgggaaaactgcctagccatatgtagaaagctgaaactggatcccttccttacactttatacaaaaattaattcaagatgcattaaagacttacgtgttagacctaaagccataaaaaccctagaagaaaacctaggcaataccattcaggacataggcatgggcaaggacttcatgtctgaaacaccaaaagcaatggcaacaaaagccaaaattgacaaatgggaactaattaaactaaagagcttctgcacagcaaaagaaactaccatcagagtgaacaggcaacctacagaatgggagaaaatttttgcaatctactcatctgacaagtactaatatccagaatctacaatgaactcaaacaaatttacaagaaaaaaacaagcaaccccatcaacaagtggttgaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggtgatcattaaaaagtcaggaaacaacaggtgctggagaggatgtggagaaaaaggaacacttttacactgttggtgggactgtaaactagttcaaccattgtggaagtcagtgcggcaattcctcagtgatctagaactagaaataccatttgacccagccatcccattactgggtatatacccaaaagattataaaacatgctgctataaagacacatgcacacgtatgtttactgcggcactattcacaatagcaaagacttggaaccaacccaaatgtccaacaatgatagactggattaagaaaatgtggcacatatacaccatggaatactatgcagccataaaaaatgatgagttcatgtcctttgtagggacaaggatgaggctggaaaccatcattctcagcaaactatcgcaaggacaaaaaagcaaactctgcatgttctcactcataggtgggaattgaacaatgagaacacatggacacaggaaggggaacatcacacatgggggcctgttgtggcatggggggagtggggagggatagcattaggagatatacctaatgttaaatgacgagttaatgggcgcagcacaccaacatggcacgtgtatacatatgtaacaaacctgcacgttgtgcacatgtaccctaaaacttaaagtataataaaaaaaagaaagtttctcagtacttaaagactttctgatgtgatcattaataatattaatgaatatgactttaaaatacattgtataatgaactgtgtcaacatttagaagatctgcaagaaagtcagcccagtatgtgccaacatcacagatgttcataaaagacaaatttacaacattcaaggtccattcaaggatttgaagttacacagtacaaaaaagttcattgctatatttttaaattccatatttcaactaacctttaaggaactaaaacttgtagagttttggtatagtatcaaataataaccacaattgtctaaaaagctttgaaaatatttctcccttttccaactttgcatctgtgtgtagccagatcttcttgatatacttctaacaaaacgtattaccacagacagaatacagagacagatatgagaatgcagctgtcttccacagagctggtcattaaagacatttgcaaaattataaaataatgttattcttcttatattggaaaacatagtcattttaaataaaatatttacatcaatacataaatggtttatgatcataactctaaatgaatacttaaaggagatattaaattaagcatttaaacatttttaaattttaatattaaatacagtaaatattaagagatgtaactcatagtaaaaagctctttgagggcttccataatttttaagagtgtaagggaggtcaggaggcaaaaaaggtcaagaacctctatcttagagagtttggacaggaggagtggggtgactaagctatgaaccaacatattcacgagttcggattttatcctaggatgcaaaaatctattccacccaccattgtctaacaaatttccatatctttagttattttcacctcaaaaaagtgacaagacaaaatgaaaataccatcatcctaatgttaaagtaaaaattagcaccttcaatattgggctaatagagtacaacaggggtgagcacagccctgaaatgtcctatgtcctgtttctctgctttctcttaatgacatcacatttcaaagttagtaaattgtacataaggaaccatgccagtgtaactgcacctagacattaaaactttacgccctatgaaaacgatgacaatttttaagtgacaacaaaatcctcaggaaataaatggctgtcttttatttagttgtttcttttttcttttgagacagggtcttgctctgtcacccaggctggaggcacaatcacagctcactgcaacctcagactccagggttcaagtgttcctcccacctcagccccctgagtaactgggactacaggtatgcaccaccatgctgggccattttatgtattttttgtagagatggggacttgctatgttgctcaggctggtcttgaactcctggcctcaagtgatcctcccaccttggcctcccaaagttctggaattacaggtgtgagccactgctcccagccatcttttgttttataacaatgctaaagcttaggagtgaatgtattaatctgaagagtaaaattccttttctcccaaaccctttctattttgcttttaaaatgcctaaatcattggattttctctcatttagttatgtctctcattgagctagttctattacttctatgatcttggtttctgatgactgcatctacaaacatgtttcctaagaatttaaatggttcatgcactgcctgtatagaaatgcacagtcagtatagaaatgtggcgtgtagcacgggctatagctacaatcccagactccaccattcacagtcttgggatgctgagcaagttacatatgtcggtttgccccagtttccttagatacaaaatgggagtagtgatagtacctcagagggtttttgtaagaattaaaatgatttatacttggtaaacactttagaacaatgcgtaatgattggtggtgaattattattattataatatagctggtaaatatatttacttgggtcacctttttattccactgtatagaaacccttgtggtacaaacacataaatgctcactctggatatgagttacacagaagctatttggagaactattttattagataataaaatgatagtgacgcatatcagtcacctctttaggctaccttcccactcacctctcttcttaactttagtgaggatctgttttgttttcctagctgttctttggttttggactggcttttcttcacggtttggtctaaatttaccacttcgatgtcccacttgtggaggtttagctaccatttgtgtatctgtcataggcaagcatatgtcaaactctttggtatatactctctcaacaagctgagacctcgttactgccatcgccttttaccagaagaaacaaactcttagaagagtctcacccaaggttacaaagctcaaagtagcagagtcaagagaggagtggagctcttgactcccaatttcacatgcatcaaggaggcaggcttgcatgaggtacacccaaggagcagcagcctctcccgttcccacctctcacaggccctctgagggtgtttctattctatcgctcatcaccttgacagaaacctctggagaagctatggtcatctactagcaggatctgtgggtcgtctaaggtagaaacatgtagaatggccatgttattcctcccctccgtgaaactttcctgccaaggtgtgtctgatttttgctgagtgtgttcccaggctaaggatgctgagaacaagtgcaaaaccataacaggatgctgggagcctgggccagccacaaagaaggccttgacatttgcagatctgaagtcttggaccttcagactgctcggatccttaaataaccaggggctggtaagggagatctggcaaaggcaggtagcaccagtgtgcctcagtgctctgatatgccatgtagaaacacggccacttatgtgtgctaattgatgggcatgaaacatacatgtgaatacattacacatgatcctctcaaaagaaatgggcagctttcagggctattgtattcatttatatacatttaggtttgaagatcataagagcctctgggggtgcagggactccatttcaggagagacttctaagttgcccacatccatgacaccatcaatcctgtggttaaccctcagatcccttccatggggaacggataggatttcctgctcttaggaaaagagaccaggtttggtctccagcagaaacagctaggagagtggcctggagaagggaatgaggataagaaccaacccctcctccactgaaaaacagggtaggcagaggacacccaagggaacttcacagcctggaaggtccaagcaaaggaaactattctggtggccctctggtcctcaatgggcctggtcaccccagaaatgcctatcactcaggcctttgcaatccctcaagtcgggtccagcttccttgtcagggctccttgtcccccagatgttctgccatctccacctcctagtgtgaataacaggcctggggccccagtgactacagatccgaagtccttcccaccctccccacacacagttcccagatttagcaagtaatacaggacacccagttaaatttgcattttagacaaacaacttttttttttttttaagtgaaagtatgttccaggcaatatttggaacttatatacttatactaaaaatttacccgttgtttatctgaagttcaaatgtggctggacatcttgtattttatctggctaccttagaccctctccatgacgagctaagccactactcttttgagcacccccagcctccactcccatcccctcaagggtgccgccttttggaaacaggaagtagaaagggaagatgtcttcagaacacgggcctgcagcacaaccttctcctgggatcagagggcacaatctgacactgatggggaagatactgatggggaagaaaacaaaacagaatgaaacaagaactggtatctcagtgtgtggtctccccttctgctttcttttttgagacggagtctgggctgttgcatgggctgggctgggctgggctggagtgcagtggccctatctcggctcattgcaacctccacctctggggttcaagcaattctcctatgtcagcctcccaagtagctgggattacaggcacctgccaccatgcccagctaatttttttgtatttttagtagagatagggtttcactatgttggccaggctggtctcggactcctgacctcgtgagttgcccgcctctgcctcccaaagtgctgggattacagtcatgagccaccgcgcccggcccccatctgctttcttactctagggtccagcagacaggaaacatctggaatgccctcagctggagtcactgaaatgaactagggaaaaaacaaaggagattccaacgtgtgtgtgtgattccaacactatgtggcagggtgtgccatgaaggaactgtatcatgttttagacttaagacgaacaaccacacatagtgcgtttttggagaacttcatcaagctttacaatctttcttgttgtttctctccaatgacccccaaaatatcaaacattattttcttcccctgaagtttcattgttgagagagaagaaattacattttaaaattcgtattcttcactcagcattgcaatataaggacggtttgcaagcagacagggaatgggtgaaaacatattttgtgttttaatcttaagacatacatttttatactaaagtcacatactacatttcgatcacaagcacagaaattctgttcttttttgccccctcccaccctgggggaaaaatagattcaaatttttggagacttaattgccctaaactttcatctttatgatggaaatgacatttttcctggaagatggaacttggcccttcactgctccatgactttctcggactgagttgtgtccttgaggaagagggagtgggtaaactggaggagggtgggggtcctgagaaggaatgtgggcaactgggagttggatccttggcacaccatgagctggagctgagaggtaactgtcgaatcagaaacctgtaccaaatttgctttccttgacttgtgcttctggctttttcttcgtaattaattgatatctgccctctttgcttttgaatacaattcttcccctaaggttggctcttcccatcagtactgagaggaaggaaagaagggaagcgggcttgtgtttttcagagtaagtggtgctctctgggcagctgagaatgacagccactcccaatcaggaagaccgcggggacagggagagatccagggaatcagaggggatgttcctccagagtcttgcacacctggagacagctcttaccggggagtcctcttagctgaagtctcggagggatgtgtcatctttcaacataggaagttattctcctttatcccccagtctgttccttgtgctacttccttacaaggggccacagaagagagaaaaggggtgatgccaaaggaacgcaacaaacccggtaaatgccgcatgtgggattaagaattgagcacctcagtttaggtgtggtttagagaaaggcagtgaagagaaaaagatgccttccccaggtctccagtgatgcttcacctgctctccactgtcaggtaatggagaagaaaccatgctgaggagtcacaggacaatttcaagatgtgaccatggcttcccagctctgagaagctgcctctgactgatgatagcagctggcaggaaaatgatctcctgggcaaatagaggatgtaaataaatgttcagcatatgccactttggttatgaggcaatgcctggtaggtttcacaatgtagagggaagttaggaggaggaggaccatttcagataccctttctcctccaagaaacctcgcgtccttcctcctttttgcctactgccccagagttatcccagagtgttcagacccacaggcatagccagactttgagccctgggttaacttgctgtcttaatcagtcactcctcagcacatggtgcctcctatatgtaatgtaatgttccaagtatgtcttttctccttaagactgtgaacataatcaagccacgggttgcctcagaaacttcctttctcttccactcaacacttagtccagtacctggcatttggcagcttctcgaaaatacagctaaactgaattctagcttggtgtttgagatataaattcagtctctgatgagaaaaagacaatgctcttgaccttaggaaaaagttaattcctaattattcatttctgtcagtacaggttgctcatggaactcacaaggggcagcctaacacggtagttatgctatggtttctgcacgcagatggccttgttgaattcagacctcctcacactttctctatggccctgggtaagtcacccattggctttggcctcagtttcctccttctataaaacatagatgatactattactcctttcactgggttgctgaggccttagtgatgtaatggatgcaaactgctgaagcggatgcctggcacagacttcaccttcaatgaatgtaggccatcagtatttatctgctgaccataatgacctgatcactattccttcttcattcaggaagagctccaagacatagatttctcctggtgctttttgattccatgaggaggaagtatgtggtaatgggaaaccaacccagctgtttccactttgttcagtagccttgattagttactgagggtatcttgaatctcagtcttcattctaaaatgaagataacgttgatatggtttggctgtgtccccacccaaatctcatcttgaattgtagctcccataattcccacatgttgtgggagggacctggtgggagataactgaatcatgggggcggtttcccccatactgttctcatgatagtgaataagtctcaggagatctgatggttttataaggaaaaacccctttcgcttggttctcattctctctcttgcctgccgccatgtaagaggtggctttcaccttccaccgtgattgtgaggcctccccagccacgtggaactgtgagtccattaaatctctttttctttataaattacccagtcttgagtatgtctttatcagcagcatgaagggtatgtctttatcagcagcatgaaaacagactaatacaaatgctatctgacttattggttgttgaggattaatactgtattaaaatactttgtgaaatgttgcacaaaccgtttcattattttttatttggccttttgtatacataaatgcattacacacggacacaccacacacacacacacacacactctttctctctctcttttgtatacattaatgtattacacacaggcacaccacacacacttacacacacacacaaactctctctcccccatgcataacactacttcctccctcaatggtgctcagcaatgcatttcattcctagatgtatccaggtttttgcagacctgaaacttgtataataatttttggtccctctaaaaaatataaaactacaaatataaaatcaggttttgttttttattaaactgagatcagggacaaggaacagtggtgggagggattttgttccttgcaagaaaggggccaggggtttccactctcagtctagccacgtggcagcccacttggttataccacccttttcttccaaccaccttgtcctgacacaactgtgctctcggcagagagtctgtttcttcctggccactgtgctcagagttcagtcagcttcttttcctccttttccaacatgttttgtgcatccacctgttctctccatctgctgggaatctccacgtgtttcccactagtctaagctcaatgcggaaaagaaccgagtttaagaagcacgttatcccaagttccttgcagcatggagggtttatgtgcttccttgcttgcttgcttgcttgctgaatgaatgcatctcggcattgcatccactgagccaccaggcagcagtctgagaaatgcctgtggtcactgcgcttgcatctcccagtcaccactctcactgccttgctcccttcagaggtggtgtcttaccaggtgctaatgtagctcttactacacacaaaacattgttctgagcgcctttcaaatacaaactcctttcatcttaagcaccacccgacagggcaggtactattaccatctccgtttgacagatgaggaacctggcacaggaagcatttaagtggattccccaggatcgccccactgtcaggagcagagtcagaatgggcctcagcatcaggctcccaatcctggcttctaactgctgcgctctgcccttctctctccccacctccccactccagtgcctttggtcatgccactgcagctttcaggccaatactggattagcctcttagtgttcttgtccctgcagccatttccccaggcagcaattccatgtgccctcactgatgtaggtggctcttgtgtcatttgtcacatcctattgaattgtttatgcatcttgttcacactcacagcaccctccctctcacacgtcctccttataaaaatgtccctcagtgtctgctatgagccaggtgcagacttaagtgacagggctgctacgggaaataaaaaattaacaaggagcacctgcctcttaatgcacagtaacaaactatgttaagtgtcaggaaggaaaggttaaggatgccaggaaggcttttaataaataacctgacttagatgggcaggtggtgctgaggattcagaacgtgttcttctcgagcgcatctgagagatgagtagggttggccaagtgagaaacatgggagaatgtcctaggcagagggatggcccccgaggaaggccttgcagtggaaacaagtttggcccattaaaaggtattgcacggaggtctatacaaatggcttaccatatgcaagagaaacagtgatgggacatgagggtaggcactagacccatcccaggtcttaagagagtttttgaagactttatacttgttcttaaatgtaacaggaagacagtgaagaatgtgagcaggggagtagcactctgatttccataaatgaaggatttatattctctttgctgtgagaagaactgattagaagaaagcaagactgaaagtgcggagaagccagttaggaggctctgacaatagaagaggcaagagatgatgctggcttaggatgtgcgtgtggaggtgcaggctgaagataaacagattcatgatatattttggggggatgtttgaaaatacagttgttcttaagtatttgccatgtgaattaaagattggtctatttgcttcacttatcccttctttctttgcaacaaattaaaagttgcaagctgcttccatcaaggctgttagaacatcttttgggacaacttaggaaaacaggctccaggagctatcatggggtggatccgaggatgtctgcttttctatagccattttcagttgaaaagatactgaaatcatcttatcatccattcaactaagagtcaagttatttgtcattctgttgccttggaaacaaaaagacttttgctttcttgatctgctgttttttcaaaacttacaggttgaccttggggactgttatgcaaggcccaactatctttaaactttatggatgtgcttttatccacacatatgcataggaatgtctgatgctttgatctttcaccatgttgttgagtcaagatgccaaaatgcctcaaaggtttggcttgcactgcgtccaaatgaaaaggcagagagaatgaagtgtgatcttaaattcatacaattcagtgtgctgtccttagtgacaactccctcattctgcctcaaaacagaggactgacacctctgctcgcactgtgcttcctttttgtgtgtccctgcgggagcatgctcatggtctcagtgcagggttcctctccacaacctggggttgttaccaacatcctaggggtgcaggttgaagggacctctgtctttcagagtggccccctgaggtggccatgggcttagttaaatgaggctactttgctcaaagtgtgatcccaaagcctttttttttttctgaattaccttcagagtcatttatcagtctctaagaacaagttagttttactgctatagtaattctttccacatcccatacccagaaatgtttccatcccttctttctctgctcctgaatcagtgatcaagtgagggtagatcaggctatgcctgtgagataatatccaaaccacaaaggtagagtagtgtgtgtgtgtgtgtgtgtgtgtgtgtgtgtgtgtgtgtacacaagggaatcgtcacagggcgcaatacacaggggcactaggggaagcaacctggtaggaggaagccttctattctcagcaggagacagcaaggcaaggcctgctttggagacttcttgtaaaaatatgacaggggccaaggggctgaagaaagtttcgcttgctgaacaatgcctatattttaaaataacctctcactagtaataatttgtatcatattatctcagtatctaaagggatcatcttatgctcattttaactggggctcatgaaacaattttctataagaaaaacttggtttcataagaaaatattagtctaatgatgaaaaaagtatcaattatagaagattttcaagacaaacgaaacttattacttttaagggcaaacatgcattatattagactcatagtgctgcctgttaaaagtcctgctttagttactgcataattattgattgttatgggctgaatgttggtgtccctgctcaaattcattgttgaaatcctaattcctaaggggatggtgtgagaagatgaggactttgggaggtgattaggttatgagagtagaccactcatgaaggtagacagtgcccttataaaacagatccgagagagttagccattctctttccaccatgtgaggacacagcaaagactgctgtccctgagccagtacactggccctcaccacacaacgaacgtgctgctgtcttgctctcagacttcccagcctccagaactgtgaaaaataaatttatcttgtttgtaaggcacccagtttgtggcattttgttacagcagcccaactgggctgggacagtgttttaaattgtatgcctaagtatggtcagcctctgcttagattataattacttttttttttttttaaagcaagctatctattcaatttgcaaacaggctcttaatgtatcacatagtgatttagaaacaaggccagcaaactttctctgtaaataactggatagtaaatattttaggctttggaaacagtctctcacaactagccagctctgctgttacagtgctgcaaaagcagccatagaataacaaatagcatggcaataaaactttatttacaaaaaaaacaacaacaaccaaaaacacaggttgtgggccagatttgtccagcagtctgtagcttgccaatcctgatttggggaaagtagtgggttcacttcccctaacgttccactaatcacaaactcaaaattagtgatgaactacacaaaacttgaagtctattaattgtttaaatgtgttttggtttgattttttatttttaaacataaacttaccttcgttcagggcaaaagtaatcagaagcaatgaatactgatgcaaatccagacaacatttttaatggcttggacctttccattcagatgtaccacagtctatctgtattagtcctttctcatactgctataaagaactacctgagactgggtaatttataaaaaagaggtttactcagctcacagttccacagagtatacagaaagcatggctggggaggcctcggcagaaggcgaaggggaagcaggcacgtcttacatggtaggagcacgaggaagagggcaaaggggaacgtggcacacacttttaaacaaccaggtcttgtgaaaactcactcactgtcatgagaacagcaagggggaaatcaaacttcgtgatccaatcacctctcaccagtcctgtcttccaacattggggattcgaatttgacatgagatttgggcagggacacaaattgaaaccatatcatcagcacccgcacagagttctcaatggggcactgcctagtggagctgtgaaaagagggccactgtcctccagaccccagaatggtagatccactgatagcttgcactgtgcacctggaaaagtcacaggcactcaacgccagcccatgaaagcagctgagggggctgtaccctgcagagccacaggggcagagctccccaaggctttgggagcccaccccttgtatcagtgtggcctgcatgtgagacatggagtcaaaggagattattttggagttttaagatttaatgcctcccctgctgggttgtaaacttgaatggagcctgtagcccttttgtttagactgatttctcccttttgaaacaggtgtatttacccaacagctgtacctgcactggatcttggaagtaactaacttggttctgatttttcaggctcatccatggaaaggacttgcattgtctcagatgagactctggactgaggacttttgcgtaaatactgaaatgagttaagacttgggggactgttgagaagggatgattgtattttgctatgtgagaaggacatgagatttgggaggggtcggggcagaatgatatcgtttggatttgtgtcgttgctcaaaatcttgtgtcaaattgtaattcacagtgttggaggaggggcttgctgggaggtgattggatcatgggggcagatttcccccctgcttctctagtgataatcattgagttctcatgtgtggcaccttcccctttgccctcttccttcttttcctgccatgtaagatgtgcctgcttcccctctgccttctgccattattgtaagtttcctggggcctccccagccctgcttcctatacagcctgcagaactgtgagccaattaaacctctttgctttataagttactctatctcaggtagtttttttttgtttgtttgttttagcaatgacagaatggactaatatactatctacatatgtctttattatttaacaagtatttggtcccttccaatgggctaggtcctgggctaggcagtggctagggagaaataaataaaaacagcctctcacagagttcctgctcatggggtctgacagcttttagtgtgttgttcattacatcctcagtgctgtgcacaggcctggcacctagtaggtgttccaaaaaatccttgttgactgagagaactgccatatcctatttgacacaattaaagtgagcccttatcttcccctcaaacttagtttctccctctgccttcatcacttctatttataactctgttctctaaggtctaaaaccccaaagtcatcttttgcgacagctcacagatctatcccttcactccatcctacacgttaaaatcactgtaatcttcctgcaactcagctctgattctgtcaatcctcattcataacacctggggagttgtcctttaccttcaaaaacaaaggccatgctgtttctcaacatggaaacaccccgaggacccggatttaccgacctctcctctttctctgcctttccccagcggcatctcagtagatgcctctctcatgttcctcctccctgtgagacattcaccctcacacactccccaagcactctcacctcacacacacatacactctcacatacacactccccatacaccctcaccccacatgcactcacagtcccatgtgcccttaacccacacgtacttacactcatacactcactctccatgcaccctcacctcacacgcaatacactcacacacactccccatacaccctcaccccacatgcactcacactccctatgcaccctcaacccacacatacacacactctcacactctctccatgcaccctcaccccacacacacaatacactcacacacacactcttaccccacaggcactcacgctccccatgcaccctcaacccacacatacatacactctcacactctctccatgcaccctcacctcacatgcacatacactgtcacactctctccatgaacccttacctcacaggcacactctcacacactccccatacaccctcaccccacatgccctcacacttcccatgcaccctcaacccacacatacataaactctcacactcactccatgcaccctcacctcacatgcacatacactctcatacccactcaccctcaccccacatgccctcacactccccatacaccctcaacccacatgtacatatactctaacattctctccatgcaccctcacctcacatgcacatacactctcatacccactcaccctcaccccacattccctcacactccccatacaccctcaacccacatgtacatatgctctcacactctctccatgcaccctcatcccacacatacactcacacacacactctcaccccacaggcactcacactccccatgcaccctcaacccacacatacatactctcacacactccctccccatgcaccctcaccccacatgcactcacactcccgatataccctcaactcatgtacatatgctctcacacactcactctccatgcaccctcaccacacactccccatgcaccctcacctcacatgcccatatgctcacacactcactctccatgcaccctcacctcacacacacacacacacacacactccccatacaccctcagcccacactcacacacactccccatacaccctcaccccacacactcccccttcccactcacacactccccatacacacgcccacacacactccacatacatcctcgccccccacacacactcacacacactccctatatacacctcccacacacacccacacactacccatatatgcaccccacacacacactcaccatacaccttcaccccacacacacactcacacacacttgccatacacccttaccccatacattcataaacactccccatacacacaccccacacgcacacacacaaactccccatacatcctctcccccaccacacacacactccccatacaccgtcatcccccacactccccatactcaccccacatacacactcacacactccccatacagcctcaccccacactcacacacactcctcatacatcctctccccctacccccccaacacacatactccctgtattagtctgttttcatgctgctgataaagacatacccaagactgggaagaaaaaggggtttaatcggacttacagttccacatggctggggaggcctcagaatcatggcgggaggcgaaaggcagttcttacatggcagcggcaagagaaaatgaagaagcaaaagcagaaacccctgataagcccattagatctcatgagacttattcactatcacgagaataggatgggaaagaccggcccccatgattcaattaccttcccctgggtccctctcacaacatgtgggaattctgggagatacaattcaagctgagatttgggtggggacacagccaaaccatatcactccccatacaccaccatcccacatgcacactcacacacactccccatataccctcaccctcacctcccacagccttaaacattcacacccaccccgtgctctcacagaaacatgctcttacacagtctttcacacacactcaaagccagccatacgtccctggacaacttgtccttttcacatatctgtatattttctaaatgagattttgcttgtggcattttacccttccagaatacttttatctccatttcaaaacaccattaaaatcaattcaaactgcacttcctccgtggagaattaggggcctggagaatgcctgtggtttgcagctcctttggccctgagcacatccattggagcaggtcagaatctgaacattactcctctttggtgcagaaaggtgactttgtttttctctctaaactcctgtttgttccagagcttctgtgtgtttggactgacactttccctcaaccccttcagaacccagtgacattccagttagagttgacttgtacagataggtctgcttttcaactccgtcacaagaagagttgttgttcagatttcttcctgtccctcctcctcctccctgagcaggatttggggcagcagcaggaaacagggctaggatcttacaggcctgtgcaggctccccagcctcagtacggctgctcagggtgctcagggacaaggtttttccaaggctcagtgacaagctttgcactttctctgacttccagtcccgagatcctcttccaagtccccgacactctgggcccttcttcagagacctgtgggaacaactggaattcctgcctgtgaggtgcagtggaagggaagtggaggcattcctgagccccatttcacctgctgcctttctcctcaaccgtgttggtgttggtgacctggcaggatgggtcttcccggaatcctgggcatagagcagccatgtattagtatgttctcacactgcacttcctccgtggagaattaggggcctggagaatcctgtggtttgcagctgaaatagctgcaactgggtaattgcaaactgggtaatttgcaaccggtaattgcaaagaaatagctgaaactgggtaatttataaagaaaagaggtttaattggcttatggttccgcaggctgtacaggaagcatggctaagaggcctcaggaaacttacactcatggcagaacgttaaggggaagcaggaacgtcttacatggcaggagcaagaggaagagcgagcaaatggggaagtgccacacacgattaaacaaccagatctcgtgagaactcactcactatcactagaacagcaagggggaaatccacccccaagatccaatcatctcccaccaagcccctcctccaacattgggaattacaatttgacatgagatttaggtggggacacagagtcaaaccatatcaagccaccagcccctttctgggacctctgatagcttggtacctatccaacctggctcaatcttaggaggtagggtctgcggataccttcctagggtctcacacagcagctcaactgtggactagtcccctatgaatttcctgactttctgattcctgcttgatcatttctcgttctttcctaaagtctggaaatgtgctctgtgttatatctggattcctgtctgctcccaagtcagactcaaagctatgttttggggaccctaaaagtcttcttcccctagagacagggtctcactctgtcacccaggctggagtgcagcggcatgatcagagctcactgcagcctctacctccagggatcaggcaatcctatccccctgcctcagtctcctaagtagctgggaccacaagcatgcacaccacgatgcctagctaatttattattattactactatttgtagagatgggggtctctctttattgcccaggctggtcttgaactcctaggctcaagggatccttctgcctcagcctccaagattgctgggattactggcataggccactgcacctggcccagactggctttttaaaatcaaagaatcttgcattcctaccaaaatttggctaaccatttaaaaatttctgtttgaacctcaaagctgagcaatgagctctgactcctggctcccactacccctgaagaaatgaatgtcttagctgcaatggggacatgatttggggaggtatggggtagccaggggtggctggtagggtggccagggaaaatagagagtgcccagttattgttgaatttcagctaaataatgcataaagtttttttagaataagtatgttccaaatattgcaagaaacatactatactaaaaacttttaattgtttatttaaaattcaattataactgggtatcaagtcttttaatttgctatcaaaaataatcattaattataaattcccagtttttttaaattaagctatgctagcaatgagaactttaaagaaaaacaggaaaccctagtagcagagggttcaccaggaatgaaatccatcagtttagagttttcaaaactatgatcctctccatactaccttgtactagaaagagtggagcagttaaaggggtaatttaatatggcaactgatgtaatgctgagcacagtttttgccatcattttattagtttaaaggtgatacagtcttagagagagtgaagatctcaaattcttttatactccacatctgaacaatattgaaataatgtataaacaattctgtactgttgattccattgttttgtcccatttctctaacttttgccagtaaaaactgacttcacagcactttttattttagagttttatttgttcacacaacctagtacaataactgggaaattgtaaatgatgtcatttaatttaaggtaaattaacatataaatatatgtggatagatgtttatgttaaacacaaaactgagggatcaatttggtttttgtagctgggtaatgaaaatatacaacttttcaacttttcctgttaataattctgagagctaattaactttgtagaacatgttagacttttgttatgaaaaactccatttttcagtgtttcatttcagtgccatagtcatgggtctgcaggctttaccctacctatggaagtggatggctacaattctttatcttctttggttggtcctacatagtaagcttgataaagagtttgacttttatgaaaatataaataacattgttttggaatactctgatgtcttatcaccagtagatagaaatcaatttcatataataccctgagcagtgactaaaaaggacaacttttggccattaccaacctggattaaaatgcctgttgagaccaagaggaaaagagcatttatcctgttaattatgatttctttcacaatacattttattaacaaggtttctaaatgttaatctgattccagacctaaataaaaggctacagctaagaaaaaacaaaaacaaaaaatctaaactatcactggagcttataattagggtaaatcaggactaacacacaccatttattgaacaattactagccgccaggtatattctaaacactttgttatttatttgtttgttttttgagacagagtctccctctgttccccaggctggagtgtagtggtgtgatcttggctcactgcaacctctgcctcccaggttcaaacaattctcgtgcctcagcctcccgagtagctgggactataggcgcctgccaccacacctggctaatctaagcactttagatgtatcatctcttttaatcttttgggggctccgtgaggtaggtactcttatccactattttttattattattattattattattattattattattattatactttaagttttagggtacatgtgcacaatgtgcaggtttgttacatatgtatacatgtgccatgttggtgtgctgcacccattaactcgtcatttagcattaggtatatcttccaatgctatccctcccccttccccccaccccacaacagtccccggagtgtgatgttccccttcctgtgtccatgtgttcccattgttcaattcccgcctatgagtgagaacatgcagtgtttggttttttgtccttgcgatgtttactaagaatgatgatttccagtttcatccatgtccctacaaaggacatgaactcatcattttttatggctgcatagtattccatggtgtatatgtgccacattttcttaatccagtctatcgttgttggacatttgggttggttccaagtctttgctattgtgaatagtgccagaatctacaatgaactcaaacaaatttacaagaaaaaaacaaacaaccccatcaaaaagtgggccaaggatatgaacagacacttctcaaaagaagacatttatgcagccaaaaaacacttgaaaaaatgctcatcatcactggccatcagagaaatgcaaatcaaaaccacaatgaggtaccatctcacaccagttagaatggcgatcattaatatccactattattttatccgcatcttacaggttaagaaactgaggctcaatgagatttgttaccgagcccagggtcacacagctagttagtggaaaactaggatttgaactcagtcttaccctagataccatcattttaactgccatacaccatatactatgtcctctcctcactgataacagcattttggtggctatggcagcatagttagctgaacaaataatactttaatgcccagaaaacacactgaggtcagtgcattcttgcatgatttctaaatatcacttcttcccattttgctttttctctataataaactcccaattatccactgttttgaatgctgaatatcttataaacctttaggtgtcccactatggtactttgtccactgaaagtatatttcttgtgttaattataagtacttttcaatgatttttatattttgattggttcctttgagtaaagagagtatctttcagggaaagtattttccagttacaaacatgattatttctttaattcaaatactatttttttttataattgatataggtaatgcagtctttgaaagccttgatccttaacctgaggttcgtaggtccacagacaggattctctcatgctcaagtaaccctaaaattaaatgcagaattctacaagtatggatctatgcaaagatggaaatgtgaagatgcccagagcttccatcagatgtctgaaagggtgcagggcttcaaatgtagcaccacatggatcacggtactaaaatagtatctggatttttatgcttctttgtagtggagcccctgccatgctgagcagagttccagagttaggtgttgaaccatgtccttgccctcctgccaatgagcatgtgtggcatgctcagaggtgctcagggaaccctcagtccctctggtgaagtacaggactgagctgcattctactgactttggtagactcaaggaatctgaattctttctttatgaacccaaaagaaactccagtacacggaaccaccaccttccctctgtccatcactccctcattctctggctctccccaccaggctagacccaaagtcccctgctatcatcccttcttcctgtccctccatggtgttcaccaggcaacctcagaggaggcctgactcactgcctcctttgtcccaggtcctgaacgtgaccaaagacaaacatcaagccatgctgaaggttgtcctctgaatttacaaccactcccttcaagtgggcactcagccctgtgtggcaggcagttccacctccctctccagtccatgccccctcccacgtacaggatgggcaccccaatcctaaccctcaatccttagctcttaggcccctcctcatgctcaagcaagaacctgatttcttttctcagtgagaaaacaaaaagtcaccctctcctcaccagatccttcaacccaactggatttgttctcatctactgtgcctttgcttttgtgaaaatgtagacaaatcgtcccctttccctttgacaccactaaatccattccttttcccataggtaagatccttccttacaacgatgccctctttcttccgccccaccaagttttatccttcttcggtggcattcccacctgcataaaaacatgctgtaaaagctcttatctgaaatagaacaaagcaaacagtcacaacacatgcaaccactctaggtgctgccccatttttctctctctaacccacccctagaaaaaacatatagaaatgtctataataataataatatatatattaataatgagagaacatacttatataatgtcaggcactgttttaagcatgctgtatatttaactcaaattactctacacagcaattgttaacagagggctgttattatcctcattttactcttgagcaaactgagccacaaactcacttctatggctttccctgaccacctcatgtaaagtggcacacctctcattcccaatctccttaccttgcctcattttctgtagaaccttctatctacttaagattgtgtttatttgttgcatgtctctttcttctgactactagataagcttcaacagaacagaaactgtgcctgttttccaatacctggaacagagccaagcccatggtttatactcaataagtatttgttgaataaagaaggttaaagacctacacaataattttgtgtaaaattagagagttttaagaatatgtaaaataaatatttataaattaaaatgtctattcaacggatatcctatttaaaatcatcctgtgaagtcatttgcaaagtttttgtgtgtgacaaaccacagaagtctatagtgtctttatttatttattcgtttatttttatttatttatttttgagacagagtctcactctgtcgcccaggctagagtgcaatggcacaatctcagatcaccacaacttctgcctcttctgttcaagcgatcctcctgccttagcctcccaagcagctgggattacaggctcctgccaccacacctggctaatttttaaatttttagtagagacagggtttcaccatgttggccacgctggtctcgaactcctgaccttaggtgatccaccagcctcggcctcccaaagtgctgggattacaggcgtgagccactgtgcatggcctgaagaagtctacagttatctgtattttttcatgtatttgtttttttggattttcttcagctgatgatcagaatattttagcctgtcatattttagtgtgaaatgcataacgtgtttcctgtttccatgaagttgtcaggcccgctttggcaggctcacaaatggacactgcatatacacaggcactgagctgaactctgagaacactaatcacatttgaaatggaaacgacacccagcggttctgaccattctgcacggagtttacattccagttcattagtcataggcactgctcaattgcattcaactggcatagttcacttacaacacaggtaaatatcaaaaggaaattaaatcgatgctcaaatacaatattttgtgtaactctcttttttctttagtttctgtaaatgtggttggcaggttttgacaggaaaaaagttgttcttcataaacattaatatatttcactttcactcacataagtaaagttgcttcagttttttttctccactaggtttcttgtttatctaaacactggtgtcctcagacaaaccagctactatgtcatggtttaaaaaatcctctgtgggtgagaaaatagtacagcataccaaacacccaatcagctgaagaactgaaaaggaaaaagtattgtattagtccattttcatgctgctgataaagacatacccgagactaggaaatttacaagagaaagagattaattggacttacagttccacatggctgggtgggggcctcacaaccatggtggaaggcaaggaagagcaagtcacatcttacgtggatggcaagaggcaaagagggagcttgtgcgtagaaactcccattttaaaaaccatcagatcccattcactatcatgagaacagcatgggaaagacccgcccccatgattcaatcatctcccaccggatccctcccacaacacgtgggaggtatgtgagctataagatgagatttaggtggggacacaaagccaaacatatcaagtatcttaaagcaaatttctaaaataggccctggttaatcttagaaaattaggaaagtgacaccaattcctacgattaaagaaacagaatttaacatagctttacacaatctattttttgaatttgataaacatcaagatgtttttaaaatgttatgcaataaataatattttctaagttgaaaatgtatgcatatgaccttttttctcaaataaatgcagagctaaataacacattctaaagaccagttttatcatctttctactgttcgtaacataaaactgaaatggtaatggatctaccaccaagcaaaagagaattaaaacagtttaagtgatcgggaaaattgacataaaaatggataatgttttatacaacagtgagtttctacatatgtgtgttgcaacattaaaaaggaatttgattttccatttttgtcacttgcagatattgtgttgataataagattattacgtcaaatcaacattatactgtgttctccaccatgcatgctgggccctgctctgggatcacctccatgatttgcttggttgatggtggtaactggacaaggttggaaggtttaaacagtagccaccaagccagggacaaatagctgtgacttactgccaaccttacaaccttctccatcatgcctgcacatattgctatttaagaaagccctgtaatagctgcaaaagtcatccttatcaacccaaggcatcttgagaatgatgtattaaaaatgtgaagtagggattgtgagaagttcataaaagatggaaagtaatacagctgcaagagaaagatgggaaacttgtgagggacagtccctgtttcagagactggagaaataaataaccccccaatgcacatatgcaccacacacacacatgcatgcacacacatcacacacacacaaacacactaacgtaatgaacatggttcttggtgattctttcctagagattttcagcatgaagcttggcttatagtactgtcctcccatgtctgattctaaagcagaggtgagcttcctaaagcttaaccctatctccccactccttatggccatgattccaagcacaatgaatacatctggttatgttacctcccaggtccaagcccccagaaaaatggaaagccctggggagctctgttggaaactgggcctgccacacaacgcctctggtggtgtcctgttctatccctccctccacacgactgcaactcccatgatcagtaacttttgcttctctatacgcatcatactctttcttttgcagaaacccatcatgaacctcacttaagtagcctattcttcaattgcctcatgcagcttgctgtagaaagcctctctcttcctgcccatgctaactgctcctgctcagcctcccatgatatcagtgcccagcattttcacttcatgtgttgcagtactgaaactgcaggtctgtcattttcccgcagaggtcccaaagtttcttgaagatgcagacgtatcttactcatcttggtaattttaatgttaccacagtgcttgccacagagaatctctgttgacataatgaaagcatagttgcataataatattatgcaataagcatttatgaattgcctccaaaaaagactggtgatataaatgcactatcccacacaagagttccactgaagtgtcatttcactctatatataaaagcaacaaagctacactgggttgattcatttttcaatattttatgaaattgttctataatatatattttgagtggcttcttggatacatttgttatgtaagctttttttcattttgacagctataggataaaaagtgccctattacaagtgagatactataaaatgtgcacagtatagaacaaaatatatttgtcaaagtcaaaataaatttttacaaaagtatgggcattctccttcggcaggtaacaaagcacatgcatgtatttttttaaataaatacatttaaagagattgtatgtatacttgctctgtgtacggagatacctgctctaaaggggaggctacagggcaatttgttgaaagaaacagatgtaaatttagagatcagaggcaaaaagtaacatggtctttagttctgtgggcagatgtggttatctgacaaattatgtctgtgacatggcttatttcatgaatatgtgaggcacaagtttaccacacatttgtttgtttgtttgtttgtctgagtcaggatcttgctgtcttgccccggcttgagtactatggcacagtcacatctcactgcagccttgaactcctggggttaagtgattctcctatctcagcttcccgagcagccaggactacagtgtgcaccaccactgcccagcaaattaaaaaacaaaaacatttagagattgggggggggggtctcactatattgcccaggctggtcttgaactcccagcctcaaataatcttcctgccttagcctcctgagtagctgagaatacaggcatgaaacactgcatccagggtatttctgacttttttcccacatactctggctcttaaattcaaagcatcccaaaagtcaatgagtcacatgatctatgatgatgaactaagttgggacacagtgaggagcaggcaactgagcaagtcattggggtcttatccttccctccaagcaacaccattctgaaagggaggacttgaagatgatgctagtgtttttagcttaggaaacagacagccatgacagggtacaggatcctgggagcagaacagattcaggggtctctgttgatgggatataatgagttctcttttagacatgttgggtttgagatgtctgaaacaaatattaagttgaggcaattgcaattatggtttttgccattgaaagcaatggcaagactgcaattacatttgcaccaacctaatatctactaggtgtaaatatgacactctggagagaggcctggcattggggacataaagctgagcaggtgagcaataggtaattaagcagatgccatcagaaaattctgagtagcaaagagtgaggtcctagccaggaacaggattccccagcgaggaatggggaatcacccttgctttaaggaagctgaggtgcttggtgtcagggtggggcccaggctgatggaagcacgtcaccatctggtcattagcaggagggaactcgatggacactcaatccagaaaaggcagaagcctaggtcctaggtgacaggtggaacagtgtgaggttgatgttcagtccttggatcgctaagctactctgtcttaggtattttctgactatggtctggcttgactccaaacatgcagaggttgaacctcatggtgagggcagcagggacccagagtaggccctggttacccttttctcatgtttatatgccaagcagcaaaacgagccaaaacaattagaaataataatgcccacaccattttacaggtaatcttccccatcagattgaagcctgctgaaatgtccactccctgtacacagaacattttctaagtcacagctttgcatatcattctctaaatgttaccacttgaaacagcagagaaaactttaaagggtgcattttagtaagccatcatatactcgttttttgttgaaagttaccaaagaaactttccctatcaattccaacgaccatctaaagaaagtatgccttcacttgtattcacaatctgggaagtatttgagactatttcccttggcttctctttgtctaataataacgatgaaactgaatggtgtctatcctaacaaggtcgggggcacatcaggttattggcagagcagaattctggctttctggaaaagatgaaatgcctgtcttctcagccgagggcagcctgccacctccaccacagtgtgccattgaacgtggagagggtaacaggatgggaaagtgtatagttggcccattgtttaaaagcaactccagacatccttatttgctgtgtattaattgaaagaaaccatttgtttggtggctaagtttgcttctgaaatttactaagaactgagtgctgatttctcagaaaactgaaggccaagtttaatttttccagctttcaacttaatgcattatcctttttttttttttgtctaaagagtgaaagccttaaatggaaatcaaagtctgtagtgcaagaatgaaccctctttgcctgaactggtgtttaaggagagctgaaactcttcatttcctttcttgtttctgagaaactggttcaaaggtcaagcctaatggaatgtttcagaagttttattttcctttgcaggcttacgaaaggcttggagctgacccagtaaaattgagattatgaagcattcagttgttaaaggaatttccatggtttttccctttaaaataaatcctatatagatcaaaagacagtgccttgatatttcattaaaccaacacacatatatatataacatatatatatcccttttttcctctggccataaagctgtaactgttaatttttcttttggattgagttatcatcatgtgggcatcattagtacacaactgatcaagacatatataattataatatacaattattaaagcatacaaattgtgatatgcaattatgaatcttaaacattattttattgaaaaatacatctcttaatgagtggagacagggttttaaaaattaatttatgtatccatgaatgaatgctatttattgctagactaagacaggtccatatcaatctctaaacctaagataaaattctaagccctccaaccgactgaactgacctcctcttggtcaaggggaccctacaggagccttgaaaattgaattcctggcctcattataccccctccctagctaaccaccattaggctttctttcccaagggctaaatagaaaccagtactttgcaaagactcactccaccactctatcaaccagccacccgatgctgcccttcccttttgtgcttttgacaaagcaactggccagcattccttcaacataggagaccactggccatggagtggttctcgccagtctatgaggactgcacccaaatggcttttgtgtcctgtttcacattctgatgttcagagcctaactgtagtacatttaaatgttgagtctccaccacaaagtgaacatgggatgtgtgctgcatatatgttagcctattacacacacatgcgccacctcttcgtgaattttcatagcttcaactgaaacctgctgaatatgtacaccaagccaccctcccagcatcaattcctgttccttttacccctcccttgaagtgcttgctttttggtttcaacaggatgctctgcttctggcctgcaggttgtggtaccctctttcacaaataaagccttccttaccaagtgtatagatgtgtgacttctttggtcaacgaatctatttctatctttggtttttatagatgcaagagttgagaaggtttgtccatagtaatatgtagtgaggttcctggggagtcagaggctggcctttatttgagaagagggtgggattactgtgagagggacatggaaaagagagtcagggaagggccagtagacattggccaagtgagtgtcttgaaactgattggcaggacccctcacccctgggacacaccatctcagcctgaaagccactgatctacaatgtaaagggtacaattcctatctctaaccctgtgaaaccatcctgaacagagtttgcagtactgctgccttctaggtgtacatttctctcttctccctcacgaggcctgtaatgagctgtgtgcctccacatcctcatccctttgctccctgacagctcaaccccaggtaagggtgccaaactgcatgacaatgtgtaacaaatgggaaggcctttttcaatgaggcagaaggaaaagagctgggcaacaccgaccttcagatcagggcatctttaacattgatgtcaatgaatcacaactggggggtcttgctaatgcagattcagatcagtaggtgggtgggggcacagctgggattctgcatttcgaacagtgaactctaagtttcaaggtgatgcagaggcatctcctgggacgcatgctcgctgtagagaatggtcttacatctgtctgtgcattggtgacttctgatgattgtcctcctaattggtaaggagcacacacaaggcaccatccgattccttgatgacaaccacacagcatgaagtgcctatgtccagggtccacgttgaggcatctcaagctagagggtatgctacaggctgaagttaaccagagaagacagccgggatgtggctactgcattgggtcaggtggaggtcaagggccagtgggaaaggacaaagaagggtgagtcaagcaagggaaagaataaagctttcagcaagtataagtgattctgggatgaacagtccagatccccaaaggcaaagtgggacaaaggctcagtgggagaaaaaagagaacttagggggatttggcacgggctggaaaaggggtaagcattgtttgaaacctatgaaaggcaagttgaaacttttgactttttaaagggaatagttcctgtgagaaaaatctaaaaggtaaattgtcttcacaaactctattacaaccttctaaaaagtgagtgtaaattttgttgatcacattgtcaactatattaaacacctggattctcaaatccagacttctgatcaaataaacgaaaactctaagactgttaaggtcaagtgatcctggggccttattatgccactgatgttataattacaagcagatttacaaggtcaaacaggagtaacatcataacgtcatagcttggtttctaacttctgcaataaactaaatgtggttgttaagagatgtttctgatgataaaattggtgattcagacattaatgcgtgcagaaatcacccagggatcttgataaaatgcagattctgatgtagtaaatgtgaggcagggtctgggattctgcatttctaaccagcacccaggtcttagaaccttatttcagatagcaaggatccagaaaaggtgttaacaagtttaagttttggtcagtctagtgtttgtaattttttaagtacaataatatattttatggaaaaattcaagatgtggtaggctagatttcatttctgtgattttaaaaccaaaggaataaaatggaaatgacagtgattcttattctgtagaaaccatttcattcccataagtgagtacgttcactttatcaaagcgctagtgatttattacattaggttgatttatacatatgtttaatgacttatatggaaaactagaaaaatgactcttttttccaaatctcattttctacatcttacacaaacctttcaaatttagagcagataaatgtatatgtgttgaactgcatgttaaattttaaacactacacaaaattctttttttttttttttttcctcaagacagtatctcattctgttgcccaagctggagtgcagtggtgccatcacggctcactgctgccttgacctccccaggttcaggtgatcctcctacctcggcctctggagtagctgggactacaggtgcttgtcaccagacctttttttttgttgttgttttttgtattttttgtagagatggggtttgtcatgttgcccaggctggtctcaaaattcctgggctcaagcaatctgcccttcttggcctaccaaagtgctaggattttacaggcatgagccattgcgtccaatccaaaattcatcttcagaaaagatacatctatatgagcagaatgaatggccacttaatatgcctccttctgggctttctctcaggggctaccatactcccaacagcccctctttgaagatctacacgtgcagattattgcgaagtcccacttcagctgaatgctatgggaattcccactgacccacagacagctctgccaagagcaggtgagctgtgtccagtgtgtttcatactggacacccactcatggctccagactgagcctcttgtattagtttactgggcctgccctgcaaaatatcccagatttggtgcttaaacaggaatttattttctcccagttctggaggctggaagtccaagatccaagtcctggcagcttacatgtttcctgaggcctctttccttggcttgtagatgaacaaattcccactgtcctcatgaggtctttctgtataaccacatctctgacacctcttcctcttcttataaggacaccagtcctattgaattggggctcaccctaatggcctcattttaagttaatcatccttctttaaaattttttgagacagagtcttgctctgtcacccaggctggagtatagtggtgcaatcttggctcactgcaacctctacctcctgggttcaagcgattctcctgcctcagcctctgagtagctgggactacaggcatgcgccaccacacgcggctaatatttatatttttagtagagatggcgtttcatcatggtggccaggctggtctcaaactcctgacctcaagtgatccccatccctcggcctcccaaagtgctgggattataggtggaagccaccatgcctggccaaagttaatcatctctttaaagccttatctccaaatacagtcacattctgaggtactggggggttgggatttcaacatatacatttggggacagaattcagcccataacacctctcttaagccagtctgaattcagagtgctacagttacccacactggagagatgcagatctctgcagaagtcctgtgcaatagcagcccaggaagtcagagattggagaccaggagagaagaaggtggtcagagggaagcgtcagggtggcagggtcatgagtgcagaggcagagacccacactgccaggctctgcaaaggggctcagcaaatgcccgattctcagcgccatccccaaggctcctgccatggtcccaaagcagctttggtatccagcaccgtgatctgtttttcaatgagactcgtctggctaaggttgctgaaacagcttcctgtctctttcatacccctctggaaacttacaacaagctcctattgactgagataaccagagcttatttcattccttgtagtctgtaagtgattactgcagtgaatgagctaatgtagcatgttacatacaggaacttcagcagacagtatgggcctgaatgatacacacatcacatgtggatgtacataaaggtcctgttgtacgttgcctgtgttgccttgatttttattaaagcaatagtgtaggataatcagacagaaacttgtttcctttttaaacatgaaaatctggctgggcacggtggctcacacctgtaatcccagcactttgggaggctgaggcgggcggatcacgaggtcaggagatcgagaccttcctggctaacatggtgaaaccccgtctctactaaaaatacaaaaaaaaaaaaaaaaaaattagccgggcgtggtggcgggcacctgtagtctcagctactcaggaggctgaagcaggagaatggcatgaacctgggaggtggagcttgcagtgagccgagatcacgccactgcactccagcctgggtgacagagagagactccgtctcaaaaaaaaaaaaaaaaaaaaaaaaaagaaaggaaaacttatggttacagagttcaggctgggtgtggtggctcatgcctgtaaccccaggattgcagaagggcgaggcgggtggtggatcacttgaggtcaggagttccagtccagcctgaccaacatgatgaacccccaccccctgtctctactaaaaatgcaaaatttagctgggcatgctcacttgaactgaggaggcagaggttgcagtaggccaagatagcaccactgaactcccacctgggcaacagagcaaaactctgtatcaaaaaaaaaaaaaaaaaatagaaagagttcagctaacttatacagagcaagtccagcctgtgtgtgtctgtgtgtgagcctaagtgtatggacactgtttagcaaacatacgcagtgtttgagttcctagaggcccattttacaatattagcaatattgtctgttactttcaagctgatttatagtaaatttaagtctgttaatacttcagtcatcttcaaaacaaagaacagcaaatacatagcaaggcaccctacagaaacgtttccgtttatctaaaaaatcccatgctttgtattttcttctttaatgtcgaaagcacttttactgcagcatagatgttaattgccacttatcttaatgagttcttttctaatataactgagcctggcttgaaatatagcagacttctttgtcaagaagagatagggacaagagtactgttggttcctggaagaaagggtatgcttattttttatctgctttctttgtgttggttgaaagccttctgatttagcatttttgaggtatgagttactgctttcctcctcagtatgaggggaaattaacccctgtagaagtcaggaaacagaactttggttctaaaggcaaaaggcacagtaggaactcctgaggttgttaaaatattaatagaattatgtggtagctcatataatcagttactaagggtaatttttaataaaattttggcaggtcgctttcatttaaatgtgatctatttttaagtttatgtaattttaaacatgattattttttatttatttcctagttaacattcctacctcatcttccctatggaaaagttttcagggtccagaacatacctgactatttgtacttagaacatatttgttgagtgaatgaatgaatgaaaatatctaaaaccccaaggcgagatttcccaaatagcatacacaactatttttattttatagaataatattatgtcatttaatttaaaagctactttagtggggaggagggatgggcagagattggtcaatgagtacaaaattacagataagaggaataggttctggtgttctattgcacactggggtggctacagttaacaatattatatggtatatttcaaaataactagaagattttgaatattttcactacaaagaaatcataagtgcttgaggtgataggtaagctaagtaccctgatttaagaataatgtaggccgggcatggtggctcatgcctgtaatcccagcactttgggaggctgaggtgggcggatcacctgaggtcgggagttcgagagcagcctgaccaacatggagaaaccccgtccctactaaaaatacaaaattagctgggtgtggtggcgggtacctgtaatcccagctacttgggaggctgaggcaggagaatcgcttgaacctgggaggcggaggtttcggtgagtggagatcgcgccattgcactccaccctgggcaacaagagctaaactccgtctcaaaaaaaaaaaaaaaaaggtgggctttcgagcttcctacatggtagtgggaggcactgttttgaaaggatcaggatccatgaggcctgggtgctgcctccctggggattcatctcctgctcgtccatgcagccttggtttctgtctataggaggcagtgcctggccagcctgtagttgtctccttccttctatttatgatggtaaaatatacataacataaaatttacaattttaactatttttaagtgtacagttccatggcattaagtacattcatactgttatacagccatcatcactaaccatctccaaaacttcttcatcatccaaattgaaattctatacccattacacacttctcatttccccttcccacatccccaggaaaccactattctacttttggtctcttagatttgactattctaggtacttcatgtaattggagcatacagtgatataattaaactgtgtccccacacaaatctcatcttgaattgtagctcccataattcccacgtgtcatgggagggacgtggtgggagataattgaattccctatactgctcttgtggtagtgaataagtctcatgagatctgatggttttataaggggaaacccctttcgttcattctgtcttacctgccgccacgtaggacatgcctttcacgttctgtcacgattgtgaggcctccccagccacgtggaactgagtccattaaacttgtttgtctttataaatcacccagtcctgggtatgcctttatcagcagtgtgaaaatggactaatacatattcatccttttctatctactttattttacttagcatgatgtcttcatgattcatccctcttgtagtatgtatcagaatttcctcccttcttacagctgaataaaactccatcatatgtatactgtatactacattttgcaatggacatttagattgtttcaaccttttgacttttttcttttctattcttttcttttttttgtttttttgaggcagggtctcactctgttgcccaggctggagtgcagtggtgcaatcacaactcattgctgcctcgacttcctgggctcaaatgatcctcctgccttagtcttcacagtagataggaccacaggcatgtgccaccacacccagctaatttttgtattattctgtagagacagggttttgccatattgcccaggttgctcttttttatttcgataagcaaaggtaaagggaattccccagatgatattagagggaaagatggatagttttgtgagatgatcagtcagatcagacataacaaatcatcatcccacaaacttaaaggctggaaacaacaatcttcacttatgacacctcacaggttcataggaacaccagatagggaagagtagggatgaccttctctgcttcaccacgtctgggagctgacctggaagatccaaaggctctactgaccctggcggatttgcttgaaagggtttgctcacttggcaggcaggttgactcctcaccatgggctgtttggacgtccttaggacgtcagcctggctcccttaccttcagaagccacacactgccacccctatggcatcctactggtcatacgggccagctctgcttcatttcgggcgggaagacagaaaggtgtgaaccccaggagaccggggtcattgcggccatcctaccacacactttattactttaattctatgctggatgctaggtattgggagatttttcagaaattattaagatttaaatattattgctactttgaaaaacttgaaaatattgaggagatattataattctagtcactcattcatttagcaaacacattcaaaatggtaaacataggtaaggtaaagaagataaatggccaggatttctttttcacactcactgggacacaaattttgaatgttttcactgcaaagaaatcatacacgtttgaggtgatggataagctaagtaacctaatttaataatgatgtactatatatgtatagaaacatcacactgtaacccataaatatatacaactattctatggcacgtgagtatcttaaggtaattttacattactcgttcagaaaaataaaggctccatcattgtgggtttctaagtcagtgttccaaccacctgtctgtaaaccaactttcatttttttcataaggcctcttttattcagttgaaaagactacatcccaggctgatttcatatctgtctttccagtatattaggaagtgctggaggaaatcctttgtcaagtgaaagactggacgccctctgccggcatctcacctatcccttcatatgtaactaacttgtgtctgaattccgaaaatgttgggaaccactgggctgcatttcaaagatgggggagccaccctagggtctcactgtagcatccttcaagagcagatagatagggtagatggaggccctcactttgggggtttcttgcaaatgtctcagttaacaaacacattccaaactccttcatgtggagcttcatctctaaagaggcccccaaactaaggaccctccggtatggaattttaaacaataaacacattcaaagaacaaagcatatattgaagtgtccctagaatactgaaaaggtacaataatgaaaaagtgaggatacttctgtcatcttactcttcaatgcactttagtacataaagcactgtgtgtgtcagagtatagcctgctgaatttcccactggtatcttcttctctttcttacctttcctcctttcctcctccttcttgtcttcttagtagaattaagtgcctgctaaagcacacttggttcagcaacccagttatagtcgctgaacatgttcttcagtagattcagtaatttaagttactaggattgtcaaacttgaaatgcaccatgagcaatgggatttctgtttaaaatatattttttactataaaatgctaatcttctccttatcaaggtcagtatctccaaattaatgagcactattagctgcaaaacatctcaagaagcaatggaaattaattttcattagttaaacactgacagtcaactacaacctgctttgtaagacaataaatattttgaatgctccatttttgtcctcaaatgttcaaagtcagatggtgaaggaaaatgacttaggacatcaagccaaatatcaaaactggtttgcacatgaaataaccaaaggagatttcagaattccacttgtggtagaataaataaggactttgaggatggattaattgagatatgctaaaaataaaacacgtttcccatagtagtacacattgaagaataagggaaggaagctcttttaggaactgaggcaggagaatagggtctggcggcggggaacctaaggccaattcacactgacttcctaggactaaatcaaaagaaaaacctcaacttttcacacctaagtaacaaaaggaccagagcctactccctttgcaaattcccactcccttttctgtgtgccagatggaaaattgaaaatacctctgattggttgctttccacaaccaatcagactgattgtgggccaagtctttgtttgcacagaggtgtaactttggaaattcactttagcctctgattggttgctttctacaaccaatcagacatttgcataggatgtaacctttgtaacttcagcctctgattggttgctttccacaaccaatcagaggctgaagtggagtgacaaaggttacaatcagatttttggccactatttcatttgcattgggtgtacaccaagtggctgatgggaaacctctagagggtatttaaccccagaaaattctggaactgggctcttgagcccctatgctcagccctgctctcaccctgtggagttatactttcattttcaaaaatctctgcttttgttgcttcattctttccttgctttgtgagttttgtccaattctttgttcaacatgccaataacctggacgctctccactggttaacagaactggccaaggtctctgaaaggcatagtgtactttgaacagaacatgagttcgaaaggttgaacgtgggtatgtggatgcctattaaatacataaacacacaaccagaatgggcttttcaaaaattttatagctactatgacttatccatacttctataaggaaaacaagtcttgtgtctaagtctgtgaatttatacttttagttttcaacaccctatcaacactgataaatagagaagacagaaaatcaacactttgttactgtgtgccctttgtagcattaacaaacatgtgcttatgcaaggtttgtatatcttatctttggataaatgcatgcagagccaataaacagatggattacatgtatatataaatacatgtgtttatacacatgtgtacacatactacatagatacatatacacacattatttatcatctgtatgccacatagacaaattatgtgtgtatatgtatgtatacaaatagtatatctacatataatttatgtgtacatacaaatgctcatatcacacaaatacactcataatctatatggcacaaacacacacacacacacacataactttctttaataaaagtctaaggctgtcaagattatccctagaggaagacagtccctgaggaatgattgacccagtgagccaattttgtcacctgaatttttttggtttccctctctctggtgagggttccacaacgtgggaaccaactttgggtagcaggggtgctgtcctccatgttcacaatcttgttcaagactagacccacaaaatcttcctttgataccttttgaagcacagaaccttctttgcattccttcgaaaccacttcccagaactctaaaagatatcaagcaggaaataaatgggaagcacacggattttaaatacaatctgtgcatccaactggagtgtttagatttcacaacttcctctctggaattacaagccactctaattctccatgagattccagggaaagaggctcccttgtttttggttctcagctgacttccaagaggtgccatttttaatattcactctccttttgtgctcttaaacattctgaccatttttttcaaatgcagatgaagagagagatttacttcccccacctaccaaggacctttcttctcatttgcagtctttgatatctgtttcatcacaaaatggtacaaggaacaattccacctgcaagaccccattctccttccagtatgagaatatctaaatcccatagataacacatgcatatcacacatacatcatatacaatatcatcagtaaaatgacagagattaaccacgaaagaggaagtaatacaaattactgataaagctataaacttaaagcataatgacaacattgcggataattatttgagaattcagtagattactcctttaaagcactacctgcttttttttaatgtgttatcactgtacttagcattattggggaccttaaaattcattaagttctgacttctactgatccaagatacccttgatactggacattatcatcagatttagtgtctccaataagcttattttgtaaaaatttcatgctactttaattattgcatggtacttctcagttgctttaaattagaggaaagataatatatctgttcctggaacaggggatatagtggacttcaggtagaaaggttaaaaaagaaagttctggaaagatggaataagcaaatatgatggatccacttgtaattcatcagagacacaagctaagtgacccaggacatcttagttcctggctttttaatggagaccaaatataagaaacacaaccacaggtagggagtgaacaaggtgtgtagcaggggtgttagggagggtgaactacactgagaaggaggcgaacatgtgaaagtcgctttagctgctatatgttggctctagctagcttggatttggctttttgcccccaagtgatgtagggaagcccagaatgcctggagcccactttagagaactggaacatgggtctcacagacctctctgcagtcctcgaggccctggctaggagtggggaccccatgggttgtcagctcttgggccaagtatgagatccacactcaccttctgaacttggggtacagtctgttttactgatagcacatggatttggaagagaagaggctcgttccctagaggaaggtctgtatacgagagcacaaaacggatttccaccatcgcaaaggatggggtatttgctaacgaggaattaagtaactagtactttgggtaggactatgcatcaggcatgattgcctgtctctcattactcttgaccacatgatatcatggaggcccctatgccagaacctgccttagtataaattaggtgggtatatttaggtagcattagaaatgagttgttattttggaatgcaattgtttattataagtactgaaaaaaatcaatattatcacagacaaatactgtgtgtgaacattactttcttttaaactgataaaagaactcttgaaaaggaagttttataaaacaaaaaggtctttttgccttggagtcttctctcccttcttcctatcttccctcttggctatgagggctgagtacacagttccttcatttttttttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgaactcctgacctcgtgatccacccgcctcggcctcccaaagtgctgggattacaggcgtgagccaccgcgcccggcccagttccttcattttttaatgagctttcattaaacagcctcattttttaaacagcctcattttttaatgagctttcaaagttgtgtgagagggaaagggacatctacaaatgaccatcatgctatggggaaataaggcagatgtgacaaaagcagtaccgcgggaggaggtgagggctggtacatggtgaggaacagatggtattgccacaggaaaaactgaatttgaagggaaatggtcctgctgacaccttgatttcagacttccagcctccagaactgtgagatgataagtttctcctggtttatgccacccactttgtggtaatctattatggcagccactatggtctgaatgtttgtgaccccctagatttgtaggctgaaacctaatcacaaatgtgatgcattaggaggtggagatgttgggaggtgactaggttatgggggtatagctctcattgatgggattagtgcccttttaaaagagaccccactttgtgaggacacagagagaaggcaccatctctgcagaaagagccctcactagacacacagtctgttggcaccttgatcttggacttcccagactctggaagtgtaagaaataaattcttttcatatcaagctacccagagatatttttcttatggtagccctaatgggctaagacagcagccctaagaaattaatacactatggttataatttataagttaaacaaatccacatattggaagtgcaagctttcaagttaccactttgtcctgatttgggtgggtggacagggcattcagagacagctgccctctgtagcccaatatcccaactgagccaggcctgagtgttcccactggctaccctcctccatttccagacctcttttctttttaactgtcctctttacctggaaagctttatctcagttcttcctgtggcaataccatctgttcctcaccatgtaccagccctcacctcctcccgcggtaccgcttttgtcacatctgccttatttccccatagcatgatggtcatttgtagatgtccctttccctctcacacaactttgaaagctcattaaaaaatgaggctgttttcaggctcttagatctgcagcacccactctggaatcttccatggaaaagccatctagaagatagtaatgccttcagatggattcagagggagaggtcctgaggagtgagggctgcaggctccatcctggggccaggatgtacctggatacaacctcgctgaggacacatatgtctgattttcccatttcaaaggatgtggagcagtgtttataattatactggataacaaaattgggacccaaaaaagatttctatagtatcaaataatggaatcactctacaagaagtgaatgtaaagttcttcatttatgttaaaaagaaaattccagataagatcagtgattcatagttttgcagaagttgcctgtgaaaagacttggcattttgtttgattctacagctcaaataggtatgaatgtccattacaattagaaacacgagactgaaagtcagatttgggttctgtttccacctctctgagcctcagtttccccacatgtaaaataggtattataaaaagtcatgtgatagagattttgggatgattaaattagataacgaatataaaatattcaacactgagcatggaacttaataattaactttcatcatcattgttatcatcaacactgttataaacattgttgtcatcttactgtcaagaaaccctaaagtgaacccaggtttgcccaaagtaacacttactctctttctatacttgctggtgatgtgtgaagcataatttggagggacatcagccactgttgggcccagaagtgacagctcatggaacaatggcagctagcacaggggcaggagccttgggcctgggagtgaggtgcaggaactgtctcccaaggccactctttgaaaaagggataggtgtattctcaaacgatttcaaaggtcagaaacaagatcagtgaaggaacttacaaaagatgcagatttctgtatcaatataaactagtgcataaggcttggattactcaaagaaaaataaaatggttcaagagatggtgaggggcctgttgctcaaggcattcaagcaggggctgaatggcaaggttttgggattgctattagctcaactgataaacgacctccggcactcttcaaactccagaagtctttaagttgtgaatccagtatttctccccttggatatttcctcagttaaataaataattagtgagcatttgaagttaaaagcaaactacccagagattcatcacctgagagaattggaccctgaaaaatatgatatgtggtttactgcaaacatttcagccatgttatttgagttacatggtaacaagttacataatactgtttaaactttaatatttaaaaaatattcttcaagtcttcatctttttaaaagcatttttatgccaggcactgtagctcatgcttgcaactccaaccctatgggaggccaaggcaggaggatcacttgagtcagggagttcaagaccagcctgggcagcacagcaagaccccttctctaaaaaaaataataaaaacaatttaaccaggcttgtggccagcctgtagtcccacctacttgggaggctgaggtgggaggatcatttgagcctggaagtttgagcctgcaatgagctaggatcacaccactgcactccagcctgggtgacagggcaaaaccttgtctcaaaaaataaaagcatttttatagtatattttgtttcctgagctttcaattcactatatatgcatgcgcgtgggtgtgtgtgtgtgtgtccacatgtgcacatgcgtcgtgaacagttaaaaaaagaaaaagcagcatttggaaaacattctttaccaaggtttacctagtagtaaaatatttataagtaatattcattaatgagatttaacaataaagtgtccaacaataagataaatgttgttactatttcgaaacagcacacaaaatatagtggaaatgtatacataattccttaaaagtgcatattgtcatactcttagtcaaattttgcggtttgaaacggaacaaatccatggagtgagtttgatagagccgactgaaagtgcagctgctataatttgggcccagcatcagcattaaaaatgtgccattgtatgtattcctgttatgatgaataacaaaatagaagatagtgttctattgcaaatcacattcataaaaagtgagattctttaagcatgtttgaaaaactgctttcgagatagtgtacaccaaggattacaacatctcaaaaagggattaatcaaacacgattaaaagttgctattactgctacaatttacacattatgtcagtaatatatcttaaccatgacttttattatttgatagacaagacagttataatacccttagtatatctgggtatatcagtcttgctgtgtttttttccatttgtttcatcatcaaattttcaaaatgagaatgcttttgtgacttatcactaccaacatgactgacacttctttcatataatttaagagttatatttgactttcatgtttaaaaacaacagtatatagaactcaatagctggtgtagtacctacaaatatattagctatgataacaatccttaagagattcacattttatggaaaataacatacaattacaaataaaatcttcttagcaaatggggctgtaaagggaattttacaggtttaaaaatgatctcagtgactgctggctttacaaagaaaattggataagacatttctgtgggttttctgttggcatataggatgactagtcaaaagagaaaagaccaaagctttgccacaatccaaatgactgagccaaccatcaacaagaaaatcccaacccctcagaaccaatccttttgtatcctatgacttagagtcacagaaagtcaatatggcttctctggtttcaagtctaatgatgaagtggaactgccatgacttcaaattattatttcaaaatgcagtatttgcttaaacacttctcactgaataatactaaaactctctaacagagaagagatactggtctacaataagaaaaataaggtagatgccggaaatgaaaaatataacaaagaccacacatccaataagcaatcgatcagggatgccagaactacttagacaatttccttcattcttcccaactcctacacagatactggtactgccattcatcctctgaaaaaaaatcataaatatactctttctttttcctttttcttttttgtaaagaaataaaaatgttcgtgccaacatgtgctgcagtatggattcaatatgtgctaacaatgtagatgtaggtccgcacactcacctggcaccaatgcattttcaagaagtcatttaacattctgattctgcatttatttaaggcattaaatatgggatatcagtttctgctcacaaaggaggattacatcaaagatgtaagtaagcctactttgaagattgtaatgtgctataaacatatgtttataatgataaagaggcttacatagcctggtgtttggcagtaaataaaatgttaacaaattctcttaaatatatgtaaatatatttcaaaagcttgaaaacattgaaaagatttaaataataagccataacgccaaaataaataagtgtgagccctagaagttaaacatattagttctggtaatattcacctatgaggaatcaaattataatatttaagggaaaatgcaaaaatcttgtcttaaaagaattactatattttggacctgaagtttaaatttggcacgtctctccattaaataaaaacatgttgccgggcgcggtggctcacgcctgtaatcccagcactttgggaggccgaggcgggtggatcacgaggtcaggagatcgagaccacggtgaaaccccgtctctactaaaaatacaaaaaattagccgggcgcggtggcgggcgcctgtagtcccagctactcgggaggctgaggcaggagaatggtgtgaacccggaaggcggagcttgcagtgagcggagatcgcgccacagcactccagcctgggcgacaaaacgagactccgtctcaaaaaaaaaaaaaacatgttgagacattccttaattttaagaaaacccgacaagaaaggtattatattactacactttatgctccatacattttgcatgatgccagataatgaatcccttttataataaaccacaatagtccagttctggttctagatttgttttttcttttcttttcttttttttggggggtctgtgggtctgagctcaggatgaacttataattcatatagcactaatctgcatacaaatttgacgcatacaaaagcttagtggtcaatattctcttattcattctaacccttcttattggtgtttttcttttttggtttatagcaggcactcaataaatataagtgacataatccataacttgaaaaggtaagagctgtgtcaatatattgagagaagaaaaaaggctgtaaaaatgacagtaacataaaatggaaaggatacgccatttaataaaataaaatgcatttaatacacagtattaaatacagaagctatgctacagctagagaaatataatttggtttcttattaagctaaattcctaatatgaaaatttaaagtatttccatcagagataaaatgtttattgtcaatttaaacctcctatgttaaatataaacaatgtcaaatcacatatttttgtcttttagcatttcttaagggttcactattacgctatttctacacattttcagtagcatatcaagaaagattattttaaaatagggaatatgttgaggtattttctgatgaatacgcttgccatacatgccaagaatacttaaggatctggggcaggtttcaggaccaagactataaagagtgctgttgagactgaaaatctagataaccagtacactgaacatagtaaacaaaagaatgcttccgatttctggtagataacagtaagcacttattacaattcactttttcaatggtgttataccaaatacaatatttaacatggaccttccaagcaggtttgaattgtgctaaagtagctatctcaacgtaaaccataaaatgatcccattctgccttttatatttgcagaagtgatttctttttgcaaaaaaatctattccaacccctcaatacagtacacaggaacttgcgtgctccatcagtgaaaattccttgagatgaattttaagtacaagaccagagtcaagccacctgccctgccataaagaaatatcagcaatctgacatatcaacagtattcacagatgcagatatatatatttatgggactctatcagcataaatccaatggctatgaataaaacatcctttaactctacagggactcaaatccaactttacaagcagagcattgctaaaccccttgccactgatggaaaaaagaaagaaagaaagaaaaaacagcaacaacaaccacaaaaaaaaacctccataacaacaatttctctaatatattatgctcacatttttatcagtctttaaacaacttcatcctaatgtttattttcagacatagagaaatgaaggccatgtaaaatttctaaattttcaattttactatagcttggaaggtgtacccctttgcaatctgataaatagaaatacgcatgatgacaaagcatacttccactgagacaataaaatatgtaggccatgatatctgaagtcaaatgacatagcctccagtccccagtttcccctgtattaaagacggctgtttacatctcatcaagtagctaaacatcaagcacatatagatactctgatcaaaagatcatctctgtttttggtgatgaaccaccaaagatactagggatccattgcaagcacacacattccaagtcaaacaaaagaaaacccaagaaaagccaaccctttaatagtcagtgacataaatgcaacatgacgtgaaataaattacagtaccaggttacaaaacctctttagacatcatagggaaagaaaaaggtttttacccacctgggatctttctgaatgctatcaatggacggggacctggccaaggtgccttcaggcgggagagcagggccggatttgctgtatggagactcaacagagggacaatactgcagctgtcggtaggggtccgcgtaattggaggctgggccggcggcatagctggccctctggaaggtggccgcggcggcattctgtgggccgtgctggctgcctgtgcgctgcaaggggacggagtcgacaccaggggaagatggggctacgacaggaaagtagggacaaagtaaaaaattgaggacctgctcacagaaatggttaaccaggtctaggcaggggcaggggaagttacacacataaaaaatagggggttcaaaagaataaaaaaaattaatccatcatatttgaaccaatacattcaatgttatccagtcaaatgataattagcatgcctaagagacaaacctttcaggtatggggggaatgcatctgttgtgtgtatatcgcttacctacatccaacagaaggtgtgttcagctgcaatataaactttgtgcataagaagaaatatagagaatactttctaaggaggcatgggaagttaattcttcattttcaagttgagaagattcagaatgtgttccggtaatgttatattaactttattaaagatgtaaaatgaattcagtaatgtaattagtaatgtagttaattttcttgaatcaaagaaaataagaagaaatgagagggagtgtatgcatgggggtggaggtgagaagaggtggggttcacatctccataattagcaccagaacattcaatccatgactgctctagtttttgtaaagtaactcccgaaagatttttatatgcctctttttcaagtgaagctgtcacagaaacaaacacatttggtgaagggagaataaggccaaaaccaacccaactgcaaggcagacaaaataaggagctgacttagcttttctgaaagtatttgcatcttctcaatgtgtctaaattgttttgagaagattttacactagttactaaaatcagtttgactattttgaaactgaatttcaattttttgtttccctcttggattctttttagatcctttcatgtcattatttttatctggttctcaaaatatatttgacatctaaggtttggttgatagatacaatgaaaatagcatctttcatttcagtagaatatgaccagttattaactgctttagactgctagtcatgatcaacagcagacagcccacttgctttctggtgctgtagaacagacttcatatccaaaatacagccagtggctagataggaccatttatgacatgggtgctctatgggaattaggttctaattatcaattatacatctctgacttcctaaccatttcttagtgaacaatgatagagcttattttatcctcttttacattaggggacatataccaaatcagacacaaaggacattatgtcatgctgagaaaataattattaaaagaggtaaggaaattgtgtcgaaatgatgaaaatctgcaaagtgaatgggaggaatacactctaataccgaggattgacttaagagttcagggctcttctttcccagtgaactttcaagacttcatcttagaattacaaaaatttaggaaattaggttccgtgacatgacaaaaatgacaaaaatatttaagagaaactttataaacaaaaagtgcatatattcccagagggacaatattttgaaataacgaaggttgtcctgatgtgttaagtctcaaaataatcagattaggctaataaacattaactgcacaatcagaaaatccgctttatgtccttatgcaagtccttgaggatttatcgtttctccaaagtattaccagcatgtgtaattaaaatccacattttaaaatttatgcataatgtgccttatattatgctgaaaggggtttaaaacaggcaagtcataaacttgctcttggatgaacaaatgtacagaggtaaacaaaatttcattttctacaagttgtgataagctagccagaaaatcaagggcaaaaaaaaaaaaaaaaaaagaaaaaagaaaactaagtacatctggcatttttcatagatgtgcatttttttccattcagaaaactaagtatcaacatttaatcttgctgaaaatggttttcaggaaagaaatagttttctatgcaaaatcatttgctattaatgtattcaatacaatgattaaagtgtcagagatcaggaaataatattgaaatctaaagaagtctttttgttaagaaaacaacagagtaggtaaggagaacaatttgactacccacacaaaaaactctcaaaggaccatgaattaaaagaaaatataacaagaaagagtttaagaaaaactctgccaagcagcagacaataaattataaatcatgtaagagggactggttcaaaatgtgaaaatagggtgggaaattcaattaattaagcagaaacaggaaggcaacatcttggtatgtatgcaggaagaaaaggtagaaaaaagtttatgaatgttattgggttcctatttatatttcactttagaccctttcagggaaatgtcctggagctcttttagagcttggtttctaaaggtggagaactggttcctgtcctggccttttggtcagttcttggcactggacagatttaccgagctctccaagctccagtttcagtgttattgaagagaaaaaatggcttcatgggatcattgtttaatttcaacccaggaaaagtgttaaataactcatatggagaaaatattaaacaaataaattattaatattattaccattaatgatgttgaaatcaaccgacagtaggaaaggggattgtacacttggcattggggagaaaggccctttcactgggtgtcagactatatagctccttttgagtgctgggctctgttgtaagtgctttatttgtataaattcatgttttctccaacagtcctataagagagtatacacatcattttcaccttacagacaggaaactgaggctcagagagattaagaaactagccggcagtcagctgatattaataaaaaaggaattgaagtcctcggagttggtttctagagttcatgctcatagacaccatggctaccagggcaggtttaaaacctcaaagctgtagattattgaattacctaatacggtcagaaaacttagaaaaacggtgaggcctgaaacgaaaggaaatgtctactaaaggtacagagaagagatgggttcactaaggaattaacaacctgaatattatattgaaaaatattacaaactcgtatgctaactaatttacactatttctcattacatttacactatttctctactaaaggtaacagataaaagatgggttcactaaggaattaacaacctgaacattatgttgaaaaatatattacaaaattgttatgttaactaatctacactatttctcattacatttacactgtttcactttgggaggctgaggtaggcagatcatgaggtcaggagttccagactagcctggtcaatgtggtgaaaccccatctctactaaagacacaaaacattagtcgggcgtggtggcacgtgcctgtaatcccagctactagtgaggctgagacaggagaattgcttgaacccgggaggcggaggttgcagtgagctgagatcgtgccattgcactccagcttgggtggcagagcaagactccatctcaaaagaaaaaaaaaatttacactgtttctactaaagatacagagaagaggtgggttccccctttaaataattaataacctgaacattatactgaaaaacatattacgagtcggtatgttaactaatttacacaatttctcaattaaattgaatttattgagacatgcaaaaaagtacaaaaattatgccaaataaacctaactttgttcattccttggaaaataaaaaatatatatataattatcttaattttattttaaactgttttacattttagtttaaccagtgatatcactactatgaaaagaggctgggatatgaaatctaagatgagaaacaactttcaaaaagattatatatttaaaaaaatcacaatcatgtgtagtttcagccttgtcaaatggtcttttagaactgtcattcccaaatccatgctttaaacttcttttaggtcataataaataaaacagctgatgaaaatttcaaaatataaaacctcaagccaaattggtgctgttatagtaaaataagttagaggctaatcaatgcaatgaaaataatgtaaaataccagtacaaatggacagaaaaacacactgtattaaaggacaggttatataatcatacagaagaaaatgtatgagaatctaatggatctcaaaccaaccattagtaatgtaacaatgtaataccttactttgtaaaagtatatatgtgaaaacaattactttaaatgaatgaaaatcattaaagatctaatatgtagagaatattaaataaatgagctattattattaccattaagaattttgaaatcaatcaatattagaaaatggaaaagtgcgtatggcattgagtaaaatgacataaagattcagggtccaagtctcccatctggccccaactatttagacattgatgtggcttatgcaatccttggctctccattagtatggataaattaatatcagtcacactattaaaagactttcctttaatacatttttttcccttaatttctggactgttgaacacttttccttatttgcgttttaaagctcagttgaccaaatcattctccttgtaggattactctatccaattgaacccactcagggcaaacactggagagggaaggtgcttcatcaactctgtaaacacactcctctctcgtctcacctgctctacaaacagccccttttcccctcaataagctcttagaattcaatgaactgtatcactggtctcttcgggagatataacaaatagccacttcagcagctgacgtgatacttcaatagatacctacgctttcatgaaattatctgttttctgcagagctgcacaaataagggcctagtttataaaggaaaaataaagagatgttttacgtttatgtgctgtatttgtttgaaaaaggggaagaggcatcctttttaataaagtgaaatattctgctttatgatagataattgcaagcattatttactgacaatggaaaaaaggagaacagaataaaatacaagaatctgggcacacagttacagaaacttggtggggggaaatacaaggtaatgttcaataaagaggaagaaaaaaagcactactttttggattatttgtctttaagtatatctgcatatacagataaatatgaaaacattaagcacatttacatgttatgtaaatacaaaataagcatataataaagtaattaaagaatgtccctctgaaagttcagaaaacaaaaatagatgaggtgacaatgggtccaagaaaatggcctacatacttggaattcaactcagtttctttagggatagggaaactctagcacccaatctggcatatatccaagagtgtcatcattaataactgaactataaacattttgcaattttctgtactcagcacaagttgatccatctaaattcaatggaaaaatactcaagggtaaatttgaacatacaaaatttaaaataattgcatacattactatctttgtggggagaggcatttaatgcatgattcttagtagtaatggaataattgtcattggtgttgaccttgttttccctgcttttattggaaaagaagacattgaaaacaccagaacaggccaaacatgcctatcacattggttctcaaactgaatgtgggatcatgtgtatgaatatatcatagatatatttgaaagcgaatatgatgtaaaaccctatccttaaatagctctcatagtttccttcttgttataaccttgaaaaaatttaaaaatgcaagctcttcatctggataaatggctaatacatgcagggtttaatacctaggtgatgggttgatgggtgcagcaaaccaccatggcacacatttatctacgtaacaaacctgcatgtcctgaacatgtatcctgaaacttaaacaacaacaaaaaaaattcaagatgagatataaggtactacggtcatgttgaaactttgaataacatttttgtgatggtggtgactatacttatcttaaccaatagcattgtaatgagcagatagatttctatgtaagtacaatttttaaaaatgcaagctcctcattaggtcttcatgatataaattagcaggaaaaaaacaacaaatgattaacacaaaggatcctgctcattcattggcaatagctactactatttctaagaatgttatggcgatatacagcataatggacttcagcaggtttctagaacttggtataaaaattaaaaatgtaaataagcgaattaataaaaaaggaaagaaaaataatcccatgtttaatcctacatatgtatgtatttatatctatttaaatgtacatttagcactgtgcattttagttgtcctctaatttatagtgtgtgtaactggagtcacgatgaatgatgaagaggatgatacacagtcttttttttttttttttttttaaccattccaagcacgttttcagccatcaatgggaaaggataaaaataaatgctacatgtatttggagcttcccattgtgccaactaccatattaggggcttcttcacatgatctcatttaatgctcacaacagcctacatggcaggtactactatcattaacatcatcctcattaggtcacagaagagcagtgacaggacggtgggcaggactgggactgaaatgtagcagtggactccagggtctgcgtgttttaccccctctcctccactgttcggcactagaggtgagggcaggcctggttaataaaacctacacattttgaagtgcaatatgtttggcagaaatgccagaaaaagactaaaatttaatgtgatatagagtgtcactgcttaaatccctattacctagataattggctccatcataatattcctagggctgggtgcagtggctcacgcctgtaattccagcactttgggaggccaaggtgggcggatcacgaggtcaggagttcgagaccagcctgggcaacatggagaaaccccgtctctactaaaaatacaaaaattagttgggtgtggtggcaggcacctgtaatcccagctacttgggaagctgaggtaggagaaccgtttgaacccaggaggcggaggttgcagtgatccgagattgtgccgtcgcattctggcctgggcgacaagagcaagactccatttcaaaaaaaaaaaaaacattgtattatcattttctttggcttcttcttcagaaagaaatgcagaagaatctccttcaattgaagacagaaagggattaggggaaggtcaatgaatagaattttccataaaaatggaaataggatggttgggtggagaatgctaatgtatccacagtggacttatttctttaccttgagtaagatgaggggaccgagcaaactcatcacaggacaagagagaggcaggccagaaggagaggctgcatggggcaacctgagcaggtttcctacctgccaatctctagagagccagatgagaagagatgcattattcatgtggtttcacacgaggctcaacaatgtggtgatagagctggttttgctcccaaacatgagctagtttggtgagaacagaattagctgtggaaaaaatcttctctgccatcttaagcactaaatgattttacatcaagtacttggcaatatgtggttatggcataaaaggtatattatattctttatgcatccaaatgtccactgctgaataagaggctcaaaaagaaactccaaggaagcttaagtgttcaaacaaaataccttagctggctaagggccttaaattagggatatagcttggaacctggtggatttaaaaccacaggtgctgtgaccctttttattttgtaaaaataagcatttccatgtcaagcgtattccatgctgatcttgatctattcatttgtctatacacttgcaacatttctgagaacatttccacgaacagtcatataaataaattttagaataaagaaaattattattagacctaaaggaagagatagactatagaacagtagggaacttcaacccccctttaagtgtggacaaattatccagacagaaatcaataaggaaacatcagacttaaactacgctccagaccaaagggacctaacagacatttatagaacattccatccaacagcttcagaatacacattcttctaaactgcacatgaaacattctccaggatagatcatatgtggccacaaacaagtcttaacaaatttaagaagacagagtcaacatcaagtatcttttctgacaaaaatgctattgaattagaaatcaacaagaaaaactttggaaactttacaaatacatggaaattaacatgctcctgaaccaatcaatcaacaatttaatgaaattaaacggcaaattaaaaatttccttgtgacaaatgaggatggaaacacatcctaccaaaacctatgggacacaacaaaagcagttataagaaggagtttatagcaataaacacctatatccaaaaagaagaaagatttctaataaacaacctaaaggtgtacttcaaggaactacaaaaacaaaaacaacctaaactcaaaattggtagaaagaagaaaacaataaaggtgtgtttattttttcaaaattctcaacaagatactagaaatgcaacagcacattaaaaagatcgttcactatgatcaaataggattcatcccagggatgcaagaattatttaatacatgtaaataaataaatgtgatatatcacattaacagaaccaaggataaaaaccatataatcatttcaatagattctgcaaataagttgataaaattcaacatccctgcatgataaaacaaaaaaaaactctcaacaaattaggtatagaaagtgtgtaccacaacacaataaatttaagccatacatgacaaacccacagctccacagctaatatcatactgaacaagggaaagctaatagcttttactctaaggtcaggaacaagacaaggatgcccactttcaccacttctattcaacatagtactggaagtcctagtcagagtgattaggcaagaaacaaaaacaaaaggcattgaaattggaaaggagaaagtcaaattgtctctgtttgcagatggcatgatcatataaatgggcagccctaaagactccacacacaaaacaaagcctgttagaattaataaatgaattcaataatactgcaggacaccaaatcaacacacaaaaatctgtagcatttctatacactatctgtacagaaatatactagctgaaaaatcaggaaaataattctatttataatattaatagctacaaaaattagatatgtagaaataaacttaaccgaggagataaaaggcctttacactgaaaactataaaacttcaattaaagaaatagaagaggacacaaataaatgaaaatacatctcatgctcatgggttataataattagtactgttaaaatggccacactacacaaagtgatctacagatttactacaatccctaccaaaataccaatgatattcttcacagaaatagaaaacctatactaaaattggtatgaaacaaacaaaaaaaggcccttaagagccaaagcaatcttgagcaaacagaacaaaactgaaggcatcacactatgtgacttcaaaatatatgacaaagctacagtaaccaaaacagcacagcactagcagaaaaacagacactagactaatggaagagaatagagagtccagaaataaattcatgcacctagagccaacttattttcaacaaaggtaccaagaacttacactggggaaaagatggtcttttcaacagataatgctgagaaaactgatatccacatgcagagaatgagactagactcctaattctcagcatatacaaaaatcgactcaaaatgggttaaagacttaaatgtaaaaccagaaactttgaaacaactagaagaaaacataggtaaaatgcttcacaatattgggctgggcaagaatttttaaaataagacctcaaatgcacaggtagcaaaaccaaaaatagacgaattaatactaatattaataggcaaactattaatagactgagaagacaatctatagaatgcgagaagatatttaaaaatgatacatctgacaagtggttaacatccagaatatataagaaactgcaacaactcaacagcaaaaaaaaaaaagttccgattttaaaatgtgcaaaagaccttacttgacatttctcaatacaagacatacaaatgaccaacaggtatataaaaaaaatgctaaacataactaatcatcagggaaatgtgaatcaaaaccacagtgagatactacctcactccagttagaatggctattgtcaaaaagaaaaagaaaagtgttggcaaggatgtggagaaaagggtgcacttatatactgctcatggtattataaactagttaagccattatggaaaacaatatgttggttcctcaaaaaattaaaaatagagttaccatgtgatccagcaatctcactcctaggtatatacccaaagaaaattaaatcagcatgttaaagagatacctgtacactcacatgtttattgtagcactatttacaataaccaagatagggaatcaacctatgtgtccaacaatgggtgaatggatagagaaaatgtaacacatatacaaaacagaatactattcagacatttaagaaaaatgaaatcctgccatttgtgataacatggatgagcctggaggtatcatgctaagtaaactaatccaggcacagaaagacaaataccacaggatctcactcaaacatggaatctaaaaaagaagctgatatcatagaagcagagagtagaatagtggttaccagagactagggaggggaggaggatgaacaggggagagaatggccaatgggtacaaagttacgatgagataggaaaagtgaattctggtgttctattgcatagtagggtgactatagttaacagtaaaatattgtatattacagaatagctagaagagaggcttttgaatgttctcaccacaaagacatgacaaacgcatgtggtgatggatacacacactgccctgactggatcattagtatacagcatacacatgtatcaaaacatccaattgtatcccatgaacatgtacatgtgtcattacaatgtgtcaactaaaaaattaaataagtaattttttaaaatttgagagctttttctattataattttaagtgatagagcatgtctggtgttgagggcagaatctgctaatgtgtaattatggttccatagtgctgtatcttcgggtaatgtcttaattattcttaagttccaacttttggtattatattatatgaagccccattcaatgtgccgttgaaatctcatacttggcttctattcttttcaacattgctacgcttaatgatgtaattccacgtatgaggtgacacatcttccagtaattggggtgcatcatccaggtcaaggccagctgtgtaattttcagtatgtgtatccctagttgacatgacattaataaacatggtttcatgatctatttgtacaaaagtatgacagttatgatatttttgaattttaccaataaactgttctcccatcaaacactctgtcttccttcaactaaacaattagacttcttatttatacctttttaagtgaatccacacaggtaagcatctgaaagttctctttggttctaagatgacatttatcgttgggttgatataaaatttctaactgggtaacaacaggcatttaactttttagcctaagaaaagtgaaaattttaactaataggttatagagaatcttatttgacttgctccaataggaagcacttgatttaaaaattttaagtaacagctcttaataagtaataaactgctgataattcacatctttgtgaactcaaataattttaattaaaatatttttgatactggactattatttatatcacaatgaataacagtaataagattttatgaatatgcaggtcctatgtaatccctctatcgcttcattaaacactggctattcttgcagaggattacgttttttttagagactattttctctacatgtgtaactatttcaccacattcttttttctttttatgttgcagtacttgtcatcttcatgaagatatttagcaagtttgctccttgcaacatatctatgataattctttctttattacaagctgacacatacatcacagaaagcttgttttcaacactcagtttgaatagcatttatccaaaagaaaatccatctgactatcatcacagcagacgttggccatttctactggtttataaaaatgtgtttaaggggttgtcagagtcaagtgtttgtgttggtcaaataactcctaaattgacagtcattcatacatttgagtttgaaataaaaattcatgttatttatttctgcttaatagactttaccacaagcaaattcatgaggcccacacattccttgtttcactgtactccttattttataagctctggttttgacaagcctcatctcacatgaaatgtatattttatctaaatagacaccttagttaaaattgtatctctttacattttcatcatgcaagaggtataaatgcccaaatattagggggatggtcatgtaaaagtaagtctgtcatttctgctgcagttcacacaattctgcctcctcatctagggaaaggacactggtggccttcctctctgttatactacccgcctccccctgttaatggtcctgcaagaaagatgtggctgtcatgtctggtgatgggtactctccgggagctctgttgaccagggaccactctgtggcacaaagtgaccctttcaccttttcctaggctgccagatctctggagccaccatgctggctctgtctccctcttggagtcctcgggcaggtgggcactgctgtactttctatctgcctccctgttcaaagcactttctatctgtctctctattcaaagcctggggccagggatgcaggcattgctgtccccagagcccatacccttctgctgggcctagtaggggacaaaggtctttggctcttatcttgcaatggctggcagacgtaggtctggggcaggaggatggagaacccctttagaccatgttctctaacacagccttgggtgatggcatgcctgttcagcttcatgaaatcctattgtcaatagtgaaatttgtttctgtcaccatccacaagcctggagtagaggagaggtgaggagtaggacttgggtaccctgctccttggacattacatagatgttcctatatgcatgctcaggaggtctctaacattatggctaggtagctttttgggttaggaaagcctggaggacctgtttgattacaaaaaggtagacagtagtgcgcatctgagttggtacccaagatttaaattagtcttcataataaagtaacaggcatggatggattacttatgacagctaagaagaaaagagagatgaagaaggaaggtctagaggagagataggaaaagatggtggtaggtggagtctaaggggaaaagctaattgagaaatcctctttggtgggaaagttaagagatctaacatatcttatcttcaatgtctgaagttttttttctggtcttctctgtgcagttatctccctgactatctctcagccctagaatggtctcttactcatgttagccttagtggtgttttgagtaaggaaagcccaggggtgaggtcagcatggggcagagcagggcagaaagagtagagtggccactagagccagagtcatgcccatgaacccgagctggtagagcgtacagctgtagcaccgaatgaggagtgatcacactcataccttcccttggtgtgattccatccaaatccacacctttccatgccccaacttgctacccacaaaagagaggaaggccactttagtagggacatgagcaggagagtgaagggcaactcaatccctcatttcaatgtcttcaggttttttttggaatatgcatgtagcctatatgatattaccttccaataccggttaatttttcagatgtttatgtctttctctgaaacaaaattgaacatgcttaaggacaaggagtagattttaagcctctttgaatccgccagtacatctagcacacagagtatcttaaacagatattatttaacaggatatagaagaccattaagctccacagatgaaaataaatgtctatctattttgtttttaaatgatgatttttaccaatgcagtcaacgaagcccaggatctagggtaagactgcctacgtatgaaagtttgtttatttatttatttatttagatggagtttcactcttgttgcccaggctggagtgcagtggcgcgatcctggctcagcgcaacctccatctcctggcttcaagtgattctcctgcctcagcatcccgagtagctgggattactggcgcctgccaccatgcccggctaatttttgtatttttagtagagacggggtttcgccatgttggccaagctggtctcaaactcctgacctcaagtgatctacccacctcggcctcccaaagtgctgggattacagatgggagctactgctccaggcctatttatttatttttaatagagatagggtctgactatgttgcccagtctggtcttgaattcctgggctcaagcgattctctcatctaggcctcccaaagtgttgaaatgataggtgtgagccaccatggccagcctgtgtgaaggtttaaagactggttccacacaacccgtgtgaccttcgcatattactcaacatctctgtgcctcggttttctgatccaaaaagcaagcaccgagcatcataacagcatctccttccaaggattgttctggtggttggtaaaatacccaaagcatttggcacactccctggaagaagttacaagctagatgcttccccaccaaaggggatttctcagttagcttctccttttaggctccacctaccaccatctttttctatctttcctccagccctttattcttcatcctacctttgtttatctggcctcacatgcttgtttcaatgacaccgtctaataattccctaactgttgaggcatgtctacttttcttcattcccaagtgttgaccccttgaagggaagcaactggtcttcgatctttctgccccacttctcttgcagtatcatctggaaatgccttatgaattgtactgaaagacctccacctggtggtctattcttaagggcagaaagataagaccagttgctcgggtgccctcagccactcatctgagctaagagccagagaccatgaacattttcaggctggtaggcctcataagaacctgtcctcttctttcaaggagttagggtgtctgctttaggcctgcaaacctcttagagttctgtatcagtggtctccagggtagcggtatgtacaacacagatgacccccacaaagatattgggaagcaaacttagaatgtttttttacggctactggataactatatttaatccttacttctttgtaatctccatttttatgggtgttattctagacagaatttaataatattatatatgatgtctttaatatctaaataaaaagacatatacacatattaaaggcattttctcatacatgcaggttgtgatacagtttctgtggctgtgaaaatgtgaagacatgaaattatatgaattaggtatagacacaggggtaaccttggtggatgcagggaagacagagtttgcggctttatgcttaggagctggagagaggtagtttctcctcctccacttgtggtcctaagaggtcatccaagcacttctggaaatttccatagtattacgtcaatcagcatgttttctcaaaattgccttaagttcaaaggtgcaggctgggttggggtcttggacatctgaatgtcacaatcatagcacatctctgccacatttattaccaggaaaagcccccagcaaatgggtttcacctttgaagcagttagaaggttactattgcctccctcataggcggtaggaaaaaaacacttgttcattctggatagctctccattgaccgcttggagcaggagacgacaaatttttcctgtcaagggccagatagtaaatattcttggttttgccaagagtctctgtcacgggcactccactctgcccctgcagggcccaagccaccatggatgatacataaatgaatgggtatggctgcatctcagtaacgttatttatggatactgaagtttgaatttcatataattttcacatattacagaacattaatcatcttttgatttttccccccaatcatttaaaaatgcagtcatcattcttagctcatgggcactactaaagtagattggtgagctacaaatggcccatgggccattgtttgctgatgcagactcagaaaaaacactatcacactagagttttctttttttaagtatggatatcttccctgtgtttaatgtgatatagatgaattaaagtttttttttcttatgtagctaatttttcattaaattcctggaagtttattaataaaggataattctaagaacatgtgaatatggaatagagaatcaacataatctcttttgtcagtttttattcaaattagatattgaatgtcactgtggttatcttcttcttttataagatgtgcataaaaataaaattaccttacttaaaaacatgcaaacattaaatgctaaagtagcccaactccaagcaggagtggatctaacaggctgaaggtgaaaaaaattctgacagaagaacaaataggcattctttatcatcaaaaccaagatatgtattattaatattgggtggcatttatgatgtcaaaaataaaataaagagtattttgtgcctttctccctatgattcagtgaaatactgaaatgtaaatatcaataatcaactataaaagcagcttggcttgccttgatttcaaagcatgtaatttagcaccataaggcagtttaagaaaattgctatgctctacttagtggtcactagaaattccagtagtctgaggatgtagagatctgcgtgccaggttctgaagcagagagccagctctgccagcctcagtccctgccggagctcatatatatcattaggaaagaaggagagagctgtactgtctgcagaccagcaacacagtcattccagtttacttagcaatgtgcagcttgataataaatgcaattctcaacctgtttttaattatatcgattttggagttaagataagtgttctctagcaatctaattatgacatttgacagattatgttgcaaatggctccagatactggaaaacacttgcgttttgtcgtgtgatctgtggttgtattcaattgaaaatatatatttaatccaggagagctatataactgattgaaccatttgcaattgccaacatccaaccttcacacaataattttgtgattcaatctattagtgtatatgaaataaattgtctgcctttcaaaatatgctacatgtttagtaaatatgtttttgttccaagcttgccaaataggtagacaatatcatgaaaaaaacacttaccatcatcaagcatacgtctttcacgtcctacaaatgactacgtccttggggtacttagattcattacgtaagtgaataacgatgggcttaacattagtattgcttctttcaatttttctctttgacaaaatgagcttacaatcgccatttgcttcctttcattcagattataccaaggtagcctgaattaaagtcatattctgtttctaccattatcattacagacattgatagaagcaggtcacagtgcttgtggggatagtggacacagacacacacctttcatttgggagtgttattgaagctcccgcgcagagcccaccccctgtggacaggccacccagtggggtcctgattacacacctgtgctcgtgcggtaggtgccggtgtgtgctggcggcagagggtccccctggctctggctgagactcctcatagggggcttctgatagacgcggtcttcatagatgggatctatgtggtgttctggggactgcagggcccgcaactctgggcccaggtgcccatgctggctgctgtatgaggctcgggaaccagctgaaataaatcaacagagggacatcaaagctcaggcgacctccaaacagaacttgtttaatcaaagacatattcaaatttttttggacaaaattgttgaaattcccaggaaaccaaatgaatagcatgaaatggcagcaatatgtcaacctaatcagcctgtcggcatcacccagctgcctggctttgcgaccaaacatgatctcactctaaaaatgacaacgtttctgagataaacccacatggaacaagaccagtgaaatgttatttttctcaaaacctaatgaatgtagctaggttcttcactaaaggaatcaggtagatagtcagtcctaaaaatctgttattagcccatagcccttgcaccttaaattgtacaatagaaattattttaaatggcgagccacaatggcaaagccatcttgatgttgttcctaaaaagtgaactagaaattgttcccatcagcagtttttccctgggaaaaggataaagcaaaatgtttgaacttacaacagcctaaatccccgagagaagcagatattaaagaaagaggtttcaagttatattttcctttactctgaccctctaaattgaagcatttacatttagcctgcctctctctgaaaaagttaggaatgattgccactaactggtttaatgtataaattgcggctacacaccactttgctttgtagtatttataaatccttatttgtgtcacttcattgcatgatatgggaagaggtgttgatgtgaggcaatgctatggaccagagaatcacgagaaagtctctgaagaaaggaagcctctgtacatcaggaaataagactttagtgagggtgaagaggctggcttgacagacaggaaagaggacgttgattgagagccaatattttatctgacgtacagtcagaaccactggagcagaaacgtcacgaaaatcatttgcgttggggcaatgagatggccttggggcatcaaggagaggtggcatcttccatgttgaatacagaacacggacaagaaccaaaggagacaatggctgattttgggaatgagccttcagctacatcctacaactaatccccacatggcgtaatgggatttaactggcaactgtctttcagcagccctagttcagcctctctattccggactaacatatcagggtgctgggattccttgatcttggccatgtcgggacagctctccttccattttgccttcctcaaggaccacttcaaagccaaagtcttcaaatgctggatgttaggtctgttttgtcaggaacatataaactcaaaattgtaatattcttgtctagaatatttgagaaaaaaagccattgtaaagttttaaaattgccaatagaaaaatgttttactggtatatttaacgtgggctactttaaatttaagtacacagagaacagtattcctgaataattggagaagtggtgagaattctatgaattcagtgttaataaaaaccactgagtattttgaggaggagaaagggacagggcaggcaagttccttaccattctctttgctggtaattaaattctgatttagatagcgctccgatgaatgacagattcaaagtaactgttttgcataattaggttcatcgcatctgatctgtcaaatgccaacatcactctgaatattacctcaagcttaaattttccaggaatatatttaagtacagtatgctttgagttcctgttgtcaattcttattcctgaaggttttgaaaatattgctaaggatttaaaaatgtaaaaataaaaaaaaaaaacagtcatcacatccaaatgcagagataaataaaagttatccatcactggtacatttagaattgttactttatcactattcctttattctaagcctcaaaaaaacatccaatgatgaccaatgagaggatctgctgaacttttaagtggtaacatggtcttaggctatatgtaaaaatcctcttattacatgcatttatttggcattcagaaattttcattagtggcattaatcaaattgatgaccaagggtgctaggcaaggaagaagaatcttaaggtaaagtctacctatgtggatatcagtcttttgatgtgctgatattattacgaatataataatcaaattaactatctgaataggatactatacttttttacatattagagggctctgagtaaaactataagctcatagtgtttccctgtgtaaatgcttgtgcaaaatacagttgcatatgtaagccttatgcatagttctgaatcagataaggcattttaaaaagaacattatttacacttctttttatccactgtgatcaagttttgattgctcaagggtgggcacagttattggcaagagagacacagagaactatgggaaagaaaagggccaaggaaacaaaggttaaagatgtcactgctggaattcatgtgttcaaccgcccgtgttcaagaaagaacattttagatccatatgaacaaggcctattttatttggggcaatttcaagaaaaaattctcacacaatgttttctgggaatctgctacaaaatgtcattagatggtgtatatatttgctgattcaaattaaatgtccttttgtttagtagtaatttttttcatcattatggtctatttgaaagtgaatctcaagcgtcacactggactcaaaacgtcattcatgagaatttacatctttgccagggactggaactctgttattataataagaaaaaatgttggagaaaattcaactttgtctaaaatgttatagatgtcaaggccaaatgttcttgccaattatgctggtgcagaacaatcctgggaacctggccttgaccaagaccctgcaggatggcaaagtgcaatcaaaacatggatgagccaaagagaaaaggggaagtagatccacagaccagaccaactttcctgatggtttcccctgccatgacagacataatgtcatgcaatcataatccctgtgtctataaagcatttcatgaccaattaccgcaacaattcctacatcatccagcattaacgtctcaattttataatagggttttgctcttcctatttcttctcttcacagggcaaaactggggcctagagagctcaggcactggcaatttttcatatacaatgcgtttctgaaaatgagcttgaagactcacagctgaaacatgggtacttggcttacaggttaaggaagatttcatgatgcaggaggactaaagggtattggaatttccctagatatgttctgtgctgggtgctgctcctataggttcagagagccccccaaaactgggaagggctttcaagctgatctaggactaagcctgaggcatttgctgtataagaactaccacatatcctgtcatggaacctcagagccatctcttcttcaccacagctacaggtgacctgaatggatgcttaaacagctcagaacctacctgactactgaccacttggctgtggggttggtgttgggggagcgaggaaagggttcagtcctatggcagggagggaggtatagattctagggacccagagaggtgggcagaagggaccactggagaatgaagggacacaagacctcagacatcccctgcttctatgttgacacgtttaatccttggctctcatttccatgtacaactactatgaagaatcatgacaacatggctcagcctcaaattctacacatgaaaggtggcctcagggtgttgatgttcaatagtttgaggtaaacagaaatggtatctaaagtagtaattttcctgctgtttcttgtgtcacttttgcccacagaacttgaaataagaatatgtgaattctgtcccagatctgtctctaaccagttggataaacccaggaaacacaccaaactctttgatccccagtttcctcaagtgtagaaacagagataataatataaatggtattgttggagggtcagatgagagagactatgtgtgaaagtgctctgcaattgataaagccacatcaaaataggtgtcctcatgccaatgaatctttgaatcaataaattatgtcacctcatgcaaatatatcttttgatttgacaaaatagttgaatacctcttaccataaactatccaaatttcaaaaacaagttgaagatttcattttgaaataatctaaataacaaccatttttctgataattctgtgaagtattattgcaaaatgtgaatgttatagttttatcttttcttaaaaatgtgtgctttctaatggattattgcaaaaaatgtaggaatgaatgacgttcataaggaaagaaaacactgaaatgaccacaaaaaggtgacatcctttttagaaaggaatagggcataaattaaatctccaaattgaaaataacaaatacctgctaattcagtaggaagccagtgacagatctcagggggttcttgacacagaaaataattacaaggctgaaaagggctacatatggctcaccgccttgtgtcttgcctgttcctgttccacaccatgttttccttgagtcaacaaggctctgttttcatttggccaacaaaacaatgtatttattatttttggaacgatttgtaactaaatttctatgtactagattttacatctatcatttgtaggtactagttaatcctatggatctatatattcattcaacacattcaacaagtgcctgggaacctccaggagttgaggatgtcctagtgctcaaaacagacaaggtccctggctttgaaaataagttattacatgcaggaggatggaggtaaaggtgttgaagaaaaatgaggcagggcagtgagaaaagagataaagtgtcaggaggttgtggtgttgggatagggggatcaagaaagttctttctgagcacctgacattttagcagagagctgcagacagtaagagaatgagcctcactggagaaagagctgtatggttctcaggcggagggaaccagcagcagacacgaagggtccctccgggatttcagaatatacacagaagtgattttatgtgtactgaaaccacatcatctttaaaagaaataccagtaagtatatgaaatctttacgagttcatactacaattgattggacgaatgaaaggatttttttaactcaaaatttcaaaatcacggaaacacatttttattagaaggatttgcagcattcaatgggagatcacataaccttgggagaactgcatagctgaaaattcagctccaactacttgggttttttttttttttttacatttcaattttcattccttagaataggattaattctcaaatcttagtttattcctcaaagaatcatctagaaaacttgctgaaaatgctgacttctgaatacaacccccaagagattctgattaggtcagccaagtgggatgcatcaatgcacattttaatgggcacccccgagcctcctggttctaatgctgggatcacactgtgagccatcctgtcccaaataaaggagaaaaagaggagatgggcatatttattttcaaaaaataagcatctaatgtgttacaccttccatttatcatttgttgctttattcaaacaattccacttaatacaggttatgccaattattttactacattaataaaacaggtccatgctggattttttaaattggaatccattcatattattttatttatatactctataatctatgactctctaatttaatgcaaattcacctgcctttacaaagaaatatatttttccatgttttcattttgcagtatcaatatagtttataaggacatactgctatgtaactggtgtcttcaaatttagcatccagtttcaaatgcttatttgcaaagaaatggagggagaaaaagaagggtctaaatgacatagtattcacatagccagagtgagcaggcttaatgtgtttgtgaacagttctttcattattgagataaagtgctgttgtatggagaaaaaagtaaatttcttatgatatgaagaaaaatccaaaataaaattgaggtttttaaaaactgtaaggtcagttaatgcactgataattattaacgaaactacaactttgaagggcaaaagggaacttctatagagaagggtggggcctggactagatgccaatttttcccttgcaaatctacactgctgttgttcctttgtggacatcctgattttaggggtatgtcccatgatgataggtcagcatcgctaggcaacatggctttgcaggtagtcagcctgtactctatgatagttgatggctttgaaatagctattttctggactttgaacctcttaaaatgtttggcttgatacctgttatcatgaaactccaaggggaaaaggtgatatcagcatataaacactttgagatatacaaaaactaacataactttggttaacattatctcagaaatgtgtactaggtaaattgttgagaggtgcaaatattacatcttagatctgaagaatacctcatcataataaaacttatctcaaagaaggcacattaagaaaggtgtgcctcaaatgctacttcaggagtatccatgaggaactgggcacattcacatccttccttctgaactctgtttcctgagattgacttgttttattcttgatttttgcttttgacctaaatcaaaactccaaagtctccttcctaatcctatgttaattcaaaacttaaatttgctatttaaagggccccaaaatattttcctatgtattctgaatcaagcctatcaactgaatttcatttgcaaatgatcattactttgttgtaattaatttgacatcttatatcatgttgttataaatgcaaagatataaagacacatttctcatatagattgagtcgtatttcagacttacgtttggaaggaacattgttaattcatatgatttcaaagataaaattgcactgaaaccaaataattccagtgtaacaggccatctgataatataaaatgatcttattataaatctatttttggaaagaaaaaaatgccctcctatttcatcatatttcataaatgttagattttcttatactaacttagtacagctttgctgctttcactaataacttgaatactatgcagtctctggcagcgtacaaaacacagaatttgttcccataactttgctgatgaggttttccgatacaatttattgtcatgatgaaacctcatcacaccttttacaaaatgaatactgtaaactattgggactcaaatactttccagcaaaaataatttaaaagtcaaaatcactgcccaggacatcatggtaagtgtgtccatgtgatctcatccctagaaaagtatatgccccttgttcctgtactttctttttaaccacaagcatctattcccaaactgttaggaaaacaggcttcctttgttcagttctttttgtaacaggcaggcatctggaaaataatgatagtggtaacggagtataatgagtaatgtggggtcctgtgtcaagctttgcatttttacttgcagtggaaggttgttcttcctctctagtgaaatggatggagtgtaataccccacccctcatgcacggcttcaacttaacaaagaaccggtaggaacctatggctaaggtggtactggtaatagtaaaacatatgaagtacacagggatggtttgacacctgcaaccaatatctgttctgggtttcctatctcacaggaagtagaaagtagcaccaaatttactagccacgtattttggtgtttttcaaaatgccacaggcatatgaatgccttaattggaatgcaggttctggctcagtgggtttgaggaagggcctgaggttcttcatttttagcaagttctcaggcaatgctggcgctgctggtccacggaccaccctttgagaagccaggacatatttgtctagctatgaatacatatctggtctctaggagccccggagacagaccatcaatgccgtggtctctcctgcctcagtgctaggattacaggtgtgatccactgtgcccagcactcctgctttgttaggcaaacacaagtggcctcaataaaggcacagttcaagagtatagctagacactggcaatgcaggtgctcatcagcttgggctctgcaagcacaagctgtgctggccatgacaactgtgaccattctatcagctgctgcagagtgactgatcttagctacagttgtccgggccccacaccagggggacttcaaaggccttaatgagcaggatagctggggcaagagtcacttctagtggggaaagagcatctttctatctctagggtggactttttttaagacagggtctcactatgttgctcaagctggtctcaaactcctgagctcaagtgatcctcacacttcagtctctccagtagctgggactacaggggacccaccaccatgtctgggtcagggtggatattttagacatgggtgggctggaacatttttgctatgattatggtgtttcttgggtgattctggagaggcaagtatctaggttccctgcattgccacaatacccacataggtaaggatagctcagggcttctcaaccctgaaagaacatgcacagcatttgaatgggagactttttaaaagaggaatgatgctgtggctgcattccagaccaggacctcaggggaggggcccagggaatggaatagttcaaagattctccaggcttctccaagaagcatccaatctctggatggccaggggtcaaactaatagatttggggctagatgtaggatcttgaggagcatgtgtcaaggtttggtcctcagcagactctttaaggctgaagcttcagaatatccccagaaatatccattcctgaaagtgagggaaggaaagaacctcttcttagatgaggttttagtgtcagaaatttgcgggtacctttgaaagtagaggctgctttttgcccctggcatgctacacctaggggcatgtccctagcatgcctcctgctgggaagtccctgggaggtcacaggttgtggccaggcagagatggcaggacatttcctgcctctgccttttccctttccttctgcaggtctctgggctggatcaagccttatgtctgaggagggtggggtcagtgctgtgatgatcacgtgtgtcttgtgaactcttgctataaagaactactgtaaccatacccttcaagtgagagacagtcctgactgaagctagggaaaagacccctagaaagactctacccaggcaccctaaacccttctcagctgagaccaggtagaataagaaattatggagtgattgaaattttgaatttgtaatatctttgtacagaagaacaacataacttgacatcagacttgtaacaaaagtcttttgacatgagcatgtaaagaaatttaatctatgaaggttaatttttacctgggagaaggcttgtgtttaagatttgcttcaaactacctctcctccctgggagtagcttttggcagctactaggaggagtgggcccagagtcttcaccaccacaatcttctgtttgtcctgattaactacagatgcagggcgatctatgactcggtattttattcattagtgacttaccagagtttttaatgggcatattcacacagatactcttccttatcaaggagggggataaaattcaacaagtggcattttatttctcaacagctgtgtctcaataccccatcagtgcaatattccaacagtgcatctggagtctggcttccagacctcattattatggatcactacgaatatttccatggaaataatccagaacaaggtgctcccaatctactttttttttttttttttttttttttttttgttacatcaagatgcaaagcagacctgtgggctgaagcttcagagagcccagaagtctccattctgctttccagagtgctgactgctgtgggaactaagctaagtattcatttttgattatgtggcttctgcccatcaaaggggtacagatgaacttttcaaggtatgaacaggaataaggcttaacaagcaagaataggattaaacatgcagttgtctttgtaaatgggttcaaatattttgaaaaacatgtaaacgaagatgttttacatctcaacatcctaaacagaggcctttttcctcagattgcataagataggtaataggtaggctgcagaaattccctttaaaccattagacatttagcttctaaaatacaaactgaaaatgtattctccctatatcattttcttctacttctttgtatctttcaccaacactcagagtgacctctgtcataactccagaagaaaaagacaccctaactctcaacataatttagagggaggaaacgacaagtaaacagcttcacagattagtaattctctgtacttatattttacaacttctctatatcaacattttattaatttttattattttattcaacataatattcagcatatataaaacgagttggagaagagaggaattctgttatgtaataaacagttctaaggagaactaaaattttcctttgattcttttcctctcaaaagctttaatatgtgtgtatgtgcatgtatatgttaaagttcaattagttattgggttatgtatgtataatgatcatttgaatcgcagttgtattcattaaaacattaattttctagttgaatacaaaattgatgaaaccaatctatagccaaaattctctcacctcctttttcaaatgttgtcattatccagataatactgttaaacaaccaactggttttgtaccctagtgatgttagtgatgctttctagtacagaaagtcaatttgttttgactacatacaataaatactacatatctgaaaaaagctaccaagttgggggaaaggggactgtttttcgtcatgtgaataacaacaagcgaactgactactagggtctaaatgtttgtgctctcctcgccccccgattatgttgaaagctaacacccagtgtgatggtgttaggaggtggggcctctgggaggtgatgaggtcatgagggtggacatgtcatgagtgggattagtgcccttacacccgagagagcaaggtgaggacacagcaagaaggggccatcgatgagccgaaaagtggaccctcatgggacaatgaatctgccatcacctttattttggactttccagcctccagaactaggagaaataaatctctgttgtttgtaagttacacaatttatgatattttttatagcaacctaaacagactaagacactgactcagccatggaaaaagctgtggcattatctgcttctaaccacctgagcttaagacctgagtgatgaatgcctttgtgtgtgtgtgtgtgtgtgtgtgtgtgtgtgtgtatttcttattctaaagagaaataaatactgacttcccctttctacatcaattttctattttggtctctctttttcatgccactaactctttccaattcctcagtaatctttgataatttatcatatttgagaaagaaaaatccagtgacagcttctttccacagtgtcaagggcagtattttccactgtgcattctcgagttagaatttctggaggggaaggcagggcattcagactggcagtcttccttcagaatgagtggggggttgggggagcagtcccaacttcctcatcactccatacgcttgtactatctaatgtaaaccagcatctataacagaagtctagaagtttcttcaagagaacacctctcagagtaagcactggctacagggtcgccattttggtaggagagatgtttgtcagggggtgtcaacctagaactgtcttgaacactgactttcaatgaatccctctatcttcagcccatctctccccagccccaccccctcaagctcagctctgacccttgggcctgtccaggaattcacacaagacagccagtccacctccaaagtccagacagagctcattctcaaaagatagcactcctatattttaattgcttatcactctactttctagaaattcttaacttggcttgcttgtcggtgacactcagaccctggtctctgtgtttttgtctcctttttttttttttgagaaggaggctcattctgttgcccaggctggagtgcaatggcacgatcttggctcactgcaacctctgcctcctgggttcaagcaatgctcctgcctcagcctcctgagtagctgggattacaggcacgcgccgccacacctggctaattttttttttgtattttttagtagagacagggtttcaccatgttggtcaggctggtctcgaactcctgacctcatgatctgcctacctcagcttcccaaagtgctgggattacaggtgtgagccactgggcccagcctctgtgttttgtctcttttgtgacttcattccctattgtattcctgtacttttattttttgaggtgtccgggaaataggggaaacaaatgagtgggcagaggatgccatcttgaacaattatcttaggtagttttcatttttttagggcacattttctcagctaaagcacaactgaagtcatatcaatatcaataatattagaagagctttcacagaattctatataaagatgccactttcctaccaaagaacaaaaaaaggatctgtttacccgcatttgatttacaaggatgctatgaggtaggaaaagaatggtagatattaacttctgtgaaggaaacaaaaatgaaagacaccaggaagacattttgggccacctcgcaatcccaactcttagttccaggcttaggcactaacttgccatacgggagtgttaaaattgcactgttcccacttcagtttgacctggacatcagttggatagaaattggataggaaggtaagtagaatagaggtgctatatcaaatgaatttacaaaagaaatgtttgattaccatttctgttgagttctggacccgtaggcagatgaatgctattagactgggcttagcatgtataaaggatggaaggtttgctgaaccttcagcaaaggcagacctcatgtctgccttcctgggaggtggggaattccagagagatgagcttgcacgaagccactgagatatggattccctactataacatggggtcctggaattccagagggtaagtggctggctgaataactgctttgttggtggaagcaggaaatggctggtgtgtggaaatcagcctgtactccccaagtgtgttgaggtgtaggatgacacaatgcactatgcagaagagagacccatattacattgattctaaagacacctggggcaggcaatgggttcctaatgcttatgaggaaggggctggagcccagaggcatggccagcagggaaggcaatgagtcgctgtcgttgggagagtgcccagttaggtctagttcgaaagaacccctggaagctccagttgagagcaagtcagccttaaccacctttacaaggttaaagttgattgatatcacaggttgatcatattttaattagtaaatgtacactggaattttttaactttaagtgacagtgggaaaatctaaatatctagcactagagtgagcagaatgttcgtgagaactgcgcaatgcttgtccacagcacgggaagattagctttccaaaatgaattgaaaggagcagcaggagccagatatcatgttgcattttgaccccatcccaggagctgtggcctaaacaaactcgttcattaccccagtagacttcacatttcctttgaaaacctcactgcagagattgcgaagctttcatctaggactagactctttttttttctttctcatataaagtgtacctggaagccttaatcagtcagggaatgggtctgaaatctctaaacagtaaagattcagcatttatgtgcacgatccactctaaatactgaattttatgtccatttgactgggggacaagttagacaggccttgaccaaattcctctccatattaggtcaattttgatttaaatcattggttaagagtctccacttcattcatttcaattttacctcaaaataagcttctgatgtttgactcaacttcaatgcatgtctacaactcgtatttcttttcaaaacaggattaatttagctacaaatcccgaaagtgaaaggattatgttattctctttgtaaaagtgaacaaaaattggtactggtgaagttacaatcacacattcaataggatgtcgacagcttttttagatactattattactttctttaaaataatgagtcacttaaataagctgaaaatttatattgcatttctacatccttcgtgtttttctccactgacacaaaaatatactacctctaactatgcatcacgtacatttaagactacagagattctggggtcaaagcgacgtaggttcaaatcacatccctgtcatttctagatgagtagctttgggcaaggaggttatcatccataagcttcagtttttaaatctgtagaatgggggtaaaaatcatgtctgcctcatcaagttgctggagactacatgagatgtattaaaataatacatttaactcttaatttattaaaaaaaaactaaacaaactttgggtcaggaaaaaatataaaaagtaggttctgtcgctgactagcctttttctcaaccatttataagtgataatttttgtattgtcccatttcaaagcaaacgggaaagagttttaagaagcagtgaaggactacttcactggcttccaaagtgattctctgcccattttttctttgtaattccagcctccacacactgcccagaacaaagtttctaacaagcacatatgaccatgtcagttgtctgctggatggataaaacgctaagtccattacagtgggatgcagcagccttatctccctctgcgccttcatgtctcaccacccctaccactctgtctttgctcaagaaacactgagctgccagttgtcttcccctgcctccctgcaccccacacacaccctctcaactctgactttgttctggctaccgcttctttctagttgctcctttatagctttgttctgggaccacttcatcaaggaagcatgccaggtgcacactgaaccccactgtaagatgctccgctaggatgctcccatagtaactagcttctgtctgactctgcgcggggtttaaaactgcccattcctgtggctgttccgaaactaagtctcttgaaaccaggggttatgcctcattcatctgcatatgcccaacacagacactgacatgttctgggattcaataaacctgctgtgtctgaagcaaagatggatgtcttcttccttgcacacccaaggtagtgtggtaggtattactaaataatatgagttaacttctattgagccagaaaatgtgctagtactttacatatgctaccttatttatgtgcaaaagtatatgaatagatacaatggtgaccccttttatcagggaataattttaagccggtgagcaatgagcctaccagccttaaggagctcccccaaggcagagttggctttccactcaggtagctctatatgataaaaagcagatatgatttttttaaataaaagaaacgaaatttttaaacctatccagggatctttgggttctgatgacttaacatctgagaagttacactctgtaggttgaatctgaattgtagtgttttcccagagagtcagaactctgacgtttgtggtcagattttctaaggtttgtctatcaggaagatccaatgcaaactgtgaatgtgtgttgccttaccaagtgcccactatagtcgatgacccgaaaccctcagatagaacttctaatttctggaaatgtttatagcgaaacaagaaaaacttgaaaaactctaacctgcatatatcccactttctaatggctacatgcactttgattctgacagatatcacctatgcaaaaccaagatcttagcatttaccagaactactcccagaccacccggtccctctgcagcccactccctctcaattgatggtgactctattcttctggttgttgggtgggtggcatccttgagttctttttctcttaccttcatcacctagtgcatgagaaaatctcagtggctacaccttatatatacatcaagaactataatacccacttccataacgtccaatgcttccatcttaacccaaaccataatcacctcttgcttaaattactgcaatcagctcccaactgacattcttgcttttgcctttaatcctgatagtctattctccaaatggcagccgaagtaaccctgttacaaactagatcagaatgcagtactcctctgctcaaatccccaatggtgcccatgggtttagcaaaggcagcatcaagttctccacaagacttacaaggcctctcagacttggccttccactcccaccttgctgacctcaagtcatgtgtttgctcttgttctctctgattaacccccgtggtctccttgctactcagcaaacatatcagacacacccccatttataagcccttgaacttgctgttcctcctgcttagaaaaccttctgcccagatagtcacagggccagctcactcacctatgtcaggacagattcaaagttaccttctgtataagtactgtgtactaactaatggcatcactggaatctaaaaaacaaaatattggggaccaggtgtggtggctcacgcctgtaatcccagcactttgggaggccgaggcgggcagatcacgaggtcaggagatcaagaccatcctggctaacacggtgaaaccccgtctctactaaaaatacaaaaaattagccaggcgtggtggcgggcacctgtagccccagctgctcaggaggctaaggcaggagaatggcgtaaacctgggaggcggagctgatagtgagccaagatcacgccacggcactctagcctgggtgacagagagagactctgtctcaaaaaaacaaaaaaacaaaacaaaacaaaacaaaacaaaacaaaactattgggtactatgctcagtacctgggtgacaggatcaactgtaccccaaacctcagcatcatgcaatatacccagctaacaaacccagagaggtaccccctgaatctaaaataaaagttggaaattatatattaaaaagtctcttcctaattagagccttccctggccatctatcataagtattttgataattttctgtcttcctcatttgaaacaaggccaaggattttggctgatttcttatccctaggatctaaatcaatggcagtacataaaaggtgcttaaaagtaattattgaaggtggctaggtgcggtggctaaggcctgtaaacctagcattttgggaggccaaagcgagcagatcacttgaggtcaggaggttgagactggcctggcccacatggtgaaacccagtctctacaaaatatacaaaaattagccaggcgtgggggcaggtgactgtaatcccagctatcgggaggctgaggcgggagaatcacttgaatccaggagatggatgttgcagtgagccgagatcgcaccactgcactccagcctgggcaaccgacagagtgagactctgtgtgtgtgtgtgtgtgtgtgtgtgtgtgtgtgtgtgtgtgtgtgtgtgtagaatgatgaattagtgaaagtcactacatatcctgtatccacccttcctagtcatcagtgacaaatctctaaaatcacaaccccgaaattccaaaagctgttttgccatctcttgacctaactgctctttcaactagcaaaccaagtagctcccaacttcacaacgcctcgaatggtatcaagcacacgaaatcaggcatggaggtcttggagttgcaatattcctaatctctcagaagcatcgagtttgtcccttataccttccctgggccatagtttgcaacctaagcgcaatacaatctatttttacaatgtacttttactacctcttcttagatgcaatgatagaaggagctgttggctctattcagctccattcaccctcccctaacctctccacaggtatattcagccatgtggccacactctcgattgctactgaaatgatagactagaacatgcaaaagtctacacaaatcacccatgggagaaagaactggaagctaagactcctgatttctttcatgaggtaagtgtaagaaatgaaatggcctctagtaggacgcctggactccctgcgcctcagtctcctcttctctgtggtggtgcgcatggctgagaagggtgtcatggagtctcgtaagaactccacccatctcccccttcttgacatgatctggtaacttattttacaaaagcatttacatgaagtttcagtacatgttcactcgcccccttttctaagcagatcgctactcctgagtccctacagcatgaagatttaggtactcatactgggttggcactaataattgtctacctcaaaaattctatttgagagagaggcagtgagtgagagaatattttcatttcagtaaacgtagctagcataattttgtgggcagtggcaccctagcctgcatcctgttaggccaggccagtccacactggcaattactgtgctgaattaaagaagcccttggccacctgcctcatgcatgcaacaagctccttttttaaatcctatttatcttcacagtcatctatttgtgtcaagaaaggaagcatatgagcacagcatctgttactagagtgacacaattaccaaatccttctgtaagggaaaaaaaattcacaataaatccgggttagttgtcaggtgtttcagaagacaaaacattagtctttcaatcatggtgtcttgtttaagctgagcatatggtgctaacagcagagaggcaccagcgcagcctggtcgctgacgggcataacgaccacagaaatgtcacctcctctaaactgggagaggaaagcaggtttctctccccaagcccagcccctccctccctgtaataaagcaggtacaaatttaagggacttcatcattgctaactttgtcgcaaatgttaggacccaagtacatccaatgacaggtatgggagagtcctttagttttcccaataactaatttagcaaagatgtaaataaattcaagccaaaacaaaagggtaataattcaaggcaattcattattaattatttccccactactattgaaaactatgtaagctgaacgtctaatttgagaaaatcccttactttttccacaatgaaatgtagacaactaaaggtgaccctgtcaatactgcaactgttacttgttttgctttttttctggataccatcaacaggtctatgggatgctttcctaaatgtgtcttacttttatgagttagtctttaggctggggagagggcagagagagaagagaggagagaagagagtgatataggtgttagagattgagacaccacattactccggaaaagaagtcactgacaaactgtagggaagatactgacttgttccaggaaagccctggcgttctctgtctcctgcaactactacaacctggcagacagcgcgcccggcttcgcttctgctcaagccgggctgctgcttccgcgtccccgccacgcgcccaggtgagtcgcgccaggtggcagcgagcctttacctgccaggctgcccggcctctggagggtggccgtggcatacagctcctgcgagtgcttgctgtactgctcggacgcgtggaccaggcgcttggtgggcgacagggtggcgtacgtgccgatggtggagctcagctggtggatgggcgaggaggagatggtggactgcacggtggggggcgaggtcacgcggatcggggacaggccggccgaggacacgacgatgttgatgggcgagctggtgctgtaggacttggccaggcggctgggcgactgcttgggcgaggagccgcgcggcgcggcgtaggtggcgccctcgggggccgagccgccgcgctgcagcttggtgggcgaaccgccctggggcgcggccagcggggagcccccgcgcggcggcgcgggcagcgtggagctggagtagtagagcgcggcggcggcggcggcgggcggcgcgtcgggcaggtggaaggcgctgcccaggctgggcgcgaacggctcccgcggcggcggcggcggcggcggcgcgggctcgggccccgccaggtggccggcgcggctggtcgtgccctgtgcccgggagaggagagaacacgcgcacttagcgagggagaagcacacggcccacccggcccagcccggccccgagagcagaggcacaccggggatgccgcgggcgcccggcggctctgcgatcccagctgcgctcggggcagtacgcgaacctgcgccccgaactctcctggggcggatttcttgtcctgacactggcacaggccagctgactactggagggaagtcacgtttgacaaatgagacctgtgtttgcttacatgtagatgttatttcggaaatagcagaagcatcgcattagtcacataaagatttttaaagccccaccccgacagggcaatcatgatctccctggtcgcaatcacaatctgtttgttttaatgagaaattcgggcagtaaatctttttctgtcccccactccccacccttgccccaggtcatttcattagatacactttctacctctgagattggccgagttacatacttatctggagaacatcaagaataaacatacttcttacagtttattctgttgctattgtcgcgtggattcttctttttggacaatgaaaagttaaacggagggaaaaatactaagtcagaatgaattcgcttcgtcttttcagcattaaaaaaaaatctagaggaattagagcaattggaaatgagaatgctaaaaaagcctcccttttctagattttaatactgggctcccaatctttcagcatctttctctctctagctccctttaagagccccctgcagctgtgtcttcaaactgaaagccattcgcctctcatttatttacaagaacacaaaagacaacaagggctggggaggagctggagagacagttggaggggaaagcactttccttgaatcttgtccagagacaaatttgcattcgaatgaaaacactacattgtcaaccacttctgggcaggaggtctcagatcttccaggctttccccggggagcagagaggattttgagagcctgctggtgtgaaaagggagtaggattgtacacagagttggagagaagctgggaaggagggatttgaaatgagggatgagaggtgggtggggaggaggactccagagagatcgagggaagggaggaagagaagattgaacagatgctagccattaaaagtttcaattatgcctctctacccgttctggaatggcaattggcaaataatagactgggcactttcactgcacatacacaggcattccaaattttatctgggatgtcaagttcatatgcagatctgaaggagttaattgagcaacatcaaaattctctattaggagcagcctggcataggaggtaaacagtttggtgagagactttctctatgcagagtgtgtgtatgtgtatgcatatgtatttatgtacggtatatatattttaaatattctcacacacacatgcaatccataaagcaattattttaatgttaagagtgaaagtaaaatgtaagctccatgagtttgttcaatgttgtgtccccagcaactagaacagggcctgattcctagcagagactccaggaatatttgtggaatggttcctcaagttagtctcaaggctatgagggtcttatatgtggaggatgggtaacgaacactacagatgtgggtgtgcttactctgagccccagagaaatagtctagcttcatccagagtcattgagggggtggctttgatgcaattttgcttctctcccagtggcagctctgagcatgaaacatgtattaaatagattgggcttctcaaatctagttgtatattataatctccaagggtgcttttaaaaaaaatctcaatactcatgacttaccattgctatttaattcagcatccctgaaggtgagaccatatatcagttttttttggaagctcagcaggtgatttcactgtgcaaccaagcatgagtcccacgtcccgctagagcagtggttttcaaagggaggtccctgatggtcttttcagcattaaaaaaaaaaaaattctagaggaatcagagcaatcagaatcatacccccaccataaactgaacaaactctgggggaggggctgagggatctgggttttaaccagtactctgggtgattatggtgctggtcaaagtttgccaacactgctccagaagacacttggatttggagggtgcggagtgggccccagagtctgcatttctaacaatctcccagagcaggcaaatgctgttgctctgagaactaccactaagctgcagacatttttcttctgaagctctactggggttccctatcaactggggcctgagcaacactcagccatgcagaacacagctggcaagtgatggaaaagcatccgacaaaaatttctgaaaacccttcccacaggaacaaaatgagaagaaagaaccctttctctaaggtttcaggagcactctctgctccctgtttacaacaaaacaaaaactttttgttatgtcttggctatgtaacattaataaaacaaccttagagtacactaacgatgccattaccaaatagcataatttttaataaatactaactaaagcataccaatgtaaatgagaatattaagtcggtattcattctaatatttaaatattagaacatatatcctgtgaaaaccttaatgctttttacaaatactttatttttcttgtaatctgtcaaaacatctagtctcaggtgtactaagtgctgaatacgactgtctcctatgttttcttaaatgcaccccaaatctgtagaagtcttgacaactgccacatgagctgtagacattttgacaagctacggcaaccaatttgaaagtcttttagatattataggatcttggtaaaattgtgctaataattttggcatgaaaaaaggaaaagtataaacaataaaattttatatactgtttaacatagtaagtggtattgtccactgtgtactaaaatgcacttccaaaaaagcctcctgaatccatttgcataagaagccattatcaactagagcaccttctcaggagcaccagctacactggtgtgttaccagcaatgctttctacaacgtagagaatgttctcaatccgtactgctcaatatggcaccgctgaacacatgggctgattgacagcttgaaatgtggctaatcagctgaggaacttcagtacatacttaactttaattaagttaaacagccacatgtgactagtggccaccttcttggacagcacagttgtctaagctcctctgcagtttacaataaataaaccaggggtgctatactccatttcaatggcttatagagtaataaatgcctaagaactattctttggttaaacagagaaatttgttttgtagcatcatttgaataaaaacaaaatttgggggagcctcttttcacccttgtgcttatgttttctttcactaccgaatttgatttagtaactctttgtcagttaaggttacctgaggctgtcattcaagccagctgcacaatcataggacagtttattactacccatcgttgcattagagataatcgaaacacattccaacacatacagaattgtattcactttagtgtcacaagagttcaattctaccttaaaagtatgttagcactataaagctgcaaatctgattttaaagttagaattcaagtaaagtttcattttccttttttaaactaaagattactacatactgcttccctgcagatatttggaaatgtgtgtgtacatgcaaagacagttgaaataattttttattgatgtgtgactctgaaaataaaaataatgatataacaaatttagatatacttggaatagattgggccccatccttggtcacaccatctaggctgttggcagagacaattcttgactctgtcttcattctcagctctttggatcagtctcagcctcgagggcaactttatttgtctttcccactccttcaaaatgaggaacccatttacgagaaatggacaaggaagcagaatgttcacagataaacaaccccatcaaggagatgttctgattcaacagtttctgataggtagagtatggtgcacattaagtgtagttcagttcttgtttcccttatgggaaatttttcaagaaaaatatggaacattaactcatcaaagctattacaaattattttatctgtatacatatgtttcagatgggtcagatttaggatatattcagtgtcacaatttttacattacatggtgtgtgtgtgtgtacttagtggtatattgaggcctcttgtgtaattgtagatgcattgatatctattttatagaactgtttaaggggaggatgtatttacaaagtatagtagaaaaaatattgaaatgggaagttagggaatatgtacattattccaacagccattaatgaacagtactcaagtttgatgcattaatttactcactgactcaataaaccattaagaagagcctactacagtctgggaatccctactctgaaaatccaaaatctgaaatccaaaaatcccaaacattttgagcactgacatgaatgtcacagtagaaaattctacacctgacacctttgctttctgatggtataatgtacataaactttgtttcatgtacaacattatttaaaatgtcatataaacttaccttcaggctatgagttatgtatgaaatacaaatgaattttgtctttagactgggggggagtcccatcccaagaaatctcattatggatacgcaagtattctaaaatcgccccccgccaaaatctgaaatccaaaacacttctgatcccctgcatttcaaacaagggatgcttgacctgtctacaccatgtacaaatgaggagtttgtttttgaagagctctcaacaattcccttatatggagtattttactttgatgttattttggagatctatcgatggagtatttttgtttgtacagaatactatctggccacaattaagacactgttctttgggggagtaggagcccctaagaatatggcactcttaaaccagaaagtggcactcgttttagtgccaagcacatttgcttccagattctttcacgctgaatcttctatggagggagtaggaatggcagaggagtcataaggggacaattctcagaacttgaaaatttattcaatcctcattctttggggatctggcagtgcaaacaaaacaaaacaaatccccccaatgcttatatccagttaacaagagacctgacagcctgtaatctctaaggaatcttgacttctcatcatgagtaagccctgtcactaagcaaaagcacattttataaagcaggctcatgatttatgagcggtcctgtgaagatgcatttagacctgccaagttttcttaaattgccagcaagtcccccagttctgggacaggaggcctatttgcccaggatgctgggcagccgggccaacagtgtcaggaatggagaactggagccccgttttgtggcttccctgagtccagcttaacgggatcagcagtctgctcccccattcactgtattcatccctttctgttttcctgggattacaatcagactggcaaacctagttactaatgatgtcttccttttccagataatattggctggtggcacctaaggtcaccacagggagcagtgtacccatgcaagcacagggttatgacaggtgcagctggggagcacattcaaaggaaggcacaggccacagggccagggccacagaggagtcaaaatgtgaatgtggccacggactgggggaggaagacattggagctcatgtgtgaggaagatgtctcaatgcagagtggtttaagttgtgacaaggacatgagaaagtaaaagcaatgacaaaatgtactccttcagtgagttaagaaaggcaggatcaatcctgcataataaaaaacagggcatggcttaaagatgacatattcaaagaagtctgtttctactgagagcactctggtaaggtaactgagttatatcagctctgtgctgctgattaacagttttaagaaattgttgcactttcctagtttaagtttgtctagagctttgggcttgcacacaaagacagacaaggcgatttgatctcacaattttgaaacatgaagaaatcaccaactccaaaatgcttacagtcatatttagtactatatgaaatgttcctataatatagtgcaagtaaaacaaatctacatccccaaataagttgtgtgccttgaacttactccctgggatgtaatgaatttgcttgagcatgcacaccattgctcaaaaaatttggaaagttttcttttcaaatcgtcttccaaaggaatgccattctttaattccaaaggaagaaaactctggtactgcgagaaaagtttgattttgtcaataactaaataaaatcatccagggccttgtttgatgattctcttgaggggtgctggttttggtaaaagctaatatgtaacataaaagaagagatagcttctatgcacattttatacaccttccctgaagtcatcaccactgggatcattactgttggtgagaaaagaagggctgggtttacctggtggtgatgtcccactgacactgaaaggtggtgtccacaacaaactgaacttaagtaacggaaaacccaaggtacttggaagaaattcctttcctcagatgggaacatccaaatcaaaaggaccataaaagcaactatatccctggaaataataacagaaaccaccctcgctgctttctctctgcccaatggtcccaaaattatggaggagggggagagaaagaacaagagagaaagtgagagagagaaattttgcaaactattttgtctctgccactgcagttagaaggaggcggcaatggattcattttccccaggtctctaagtcacaagtgcaaacatggtgacgtagatttttgcatccttgagtactgatttttcctacccttttacctccctttaaagaaaactgattaggatcattatcagtaaatgttctgaaaagtatttcatatggccatttctgtggtctaccagtggaaagaaaatagagaagaaagaaataaagcaatgatgtaagtatcttatagatttatcttgaagaatacgtaaggagagatttcttgatggcaactctttcttaaaacctacatgagcacccgcaaaaatatactacacagaactttatttcagcaagaggctcatttaatataactgcaatagcccaaatatttgctcagaagagaaaatgttacagcaaaacacatatacaccctctctgccatgagaaacgtttccattattgaagccaaactaaatttgcttatcctggaaagagaaaatggagagaaaagattttaaagcaaagcaaggaatagggattcacaacagagagtcatcctaaaactatcttaaaaacaaatattctgccactttcctgcaaatacgggccaaggaaaatatgtgaaacaatatgaattctcttctaaatgttgcatagtgtatacatttatgttaaaaatctctctgcaatttttgtgttttccaaatttattggtgacttttctctgcaggttttacctaacaacaacttatttcataattaagcaaatgggagtgaagtcatactagctgtctttaccaccctttttattcaacactcaagacataggtgtttacagggaacttgctcttccttcaacttccccttcccctcagccttcacatccacccgcatgagtgtgcaccaataagcaatgttccaaacacaatgaacacacttccttctgaaagaagtgagcagatggtgtacttatgattatgatatagcattaatgaggacttttaagacatagaagtcagcacaacattaaatagataagccagatcaaaaagaaatggaaattttgtttctcaaaaagtgtattgcttttctagaacacttaccactgttcagttttattttagagaactatcatacaattcttaatttctcttacagcaagcaggccatttccctaagattgcggttgtgcacactgttcaattctactggagaatatgcaaagattttgaaatctttaggcttgtgtactcctttgccagtgctctgtctacagatgtatatttttatatttcttgcatagtttttttgtttgagggacaaaatgcttggtgaaactattttttattcggacatggggtgaaaccaacatgtttagagttggtttttggctcctctttgccagaagttttatatttagcatttcatataatccaatggaaactttatgtgagtggaaaaagccaacttctttatcttctagcccacccacaaaccagcacagaataattataaaacatcagtctggttttggcagaacctgatggatatctggtgaaccctgggtcaattatgagggatatgaaggtaagtcttgcatcgttctcgctcttgcagcagggcaatctaataggaagaaacagacttaaatgcaactaactataggatatcacttattatatgacagagtaatgtttttaacacataaggtagatcatgtcgttcctctgcttgaaattctctactggctcctcacttcactcccagtaaaaaaaggaatcctaccaatgactgagtggtttcccatcacctcacaactcctgcagtccactgtagccactctggcatccttgctgctctgtcagcatgccaggctgccccatccaggggccacagcatttgctgtgcagagggagccatatagcttccttcctcttctccatgtctttgcccaaaagtctcctcgaggtccctatcatgctgcactcccccatgcactttggatcttgcttaccctggtctgtatccatttccttcccatagaaaccatcactttctaatgtactgtgcaatttacttatttgctgtgttgattttctgagtctccatccctgatgctagaatagaagttccttgaggactgggatcatgtctactttctttacttctccatcccaagcacatgggctcatggcatcaattggcacatgataaacatcttgaatgcatcaaagaataacctagacacacaaaggtgaaggttgacctggaagaagaaggggtctgtggaggggtgacctacacaacttatttagaggctggggcaggagcttgcagcatagctgagcagagtgctggcagtggggaaaggatatctgtaaatcagttcaggtcactttctagaatggccttggggtctgatgggaagggtagtctactctctctcctctggaccagctccatgaactcatcctaagtctcagaagaatgattttaaagagtaatgtcagagaacaaatattttatggcaatttgggtggcttacagtttgagttttgggctgataagttggggcaatgtgggttacacacatatcatcagggcctgttgtagatcctggtgatgatcactgaataagcatttattacgctgaatagagatttttaaatactgaaattagaatctttgagcatttataatactcctttgaaattacatttaaatttacgaaccagataaaaaattattgctttactttagaactacatagttttttagaaaaaaaatagaatatttttgttttgattgattattgaccatactcacttggtctgacatctgttagccatcgtttgaattatattaggccttgtggcaatttattattacaggatattgtaaaaattaacctcggcttgaaggagtaagatttcacacggatcagaattttgaaaagaaaagtatcacaccactcaaatagagggatctgaacaatagtgtcattattggaatggaatgtggcctcccttctctcaagggtataacactaaaagcagagtgaaaatgctggcttatttgttgaacgtttctctgacattacattgaagtcacaggcgctacagaatattcaataagcatccctttcatacttcagcacacagctaaagtaaattataataccaatatctaccactgagttaaataaatgagaattcagatattccacaatggtttcccttctgttagtagagtgaattagaacatttcaactcctggtttgattattcatacttgtgcatcctacccactgccaggtaagtgagtctaccagtaacctttgcctcaaacttaagttatatctttgaacatttacatttatcgatgtcttcaaactataactctgatgacttcagatacagagctttgatatctttataacttagtaaccctttctgattaaactttaaagcaactttgaatgtgggtagagggacaggccctttatctcaatggaatgttttatcagttcctcttacccatattcctatcattcagcattgtgagaaggtaagacttacaaagccactgatgaacaaggatgttgcttgaagaaggtaatgacattttaaaaattgtttctggcacagtaatttaatgttagtagtggaaatccaaaaaacttccagctcctgcttcaataatgtgaatgtcacataaatgaacacatagtggtgcctgcaccaggctgttaaccctctttgcctctcacctctgcattcattttttggggccatgtggcctgccaggtgctcctgatacaaacatgaaaaaagtcctgacctcaagtagctttcagtttagttagaggaatgcctggatggataacatcaataaattggtgaaagagatgggctcgggggttacagagccagtggtgcatagtgagcatttcagaggaagggttcctggaagagatagtgcccaataaatgcaaaagggctgaaactaactttgtcagctgcaaacgtggtgtggggcttgcagttcttcattccagaagcaaaaacacagaggttagaaggacttatgttgctgaaaataagcttaaaacaagacagccttccaataaattaactctggcgtgatgatcaaaattatactctggtgggtacctcaaaattataaaaactaaaatattagcatcccttctctcctctcttctaaataacaacatttacatctttcttgaaaaaaaaaaatttccagattggtagctgcttctttttaccaagagttggttttaactgcagctaatgtatttgtgcagtgaaactgtaagatcaagcacctgccttaaagaaacaatggagggcaaatttcaaaatcagacttcacaaaatgcagctatgcctaaactcatcacaatcattttccaaacagttctgtttacctgattacacatttatagtatgtttctttatattgatatcaaaaaccacaaagcaatcccatgcttttttttaggagacacaatactcagtattttttccgagtacactcacaaattcagaatgtatatcatacttatatcacatatagacatagagggagtaactagatggacactgacatagtcacacagggaaacatatataagacaggtatagcgtgaacaatacatagatatttctaaagaaaatgtctgtaatttagcattactccataattgtattttattatttattttcttcattcacagcaccaaagggcattttccctcaagttgagggacacacctacaaaaaaggcaggctggatctccacaatctccacatccactgcatgcccattccccacctgtccccttggagtccactgacaccatacagcactgggtacctacctggctgaagctctggcccgtagctcgggcttgtgtgcctcgggccgggagctgtgaaggggtggtttcccccagggccagggtctggttgctatggtagctggccggatactggaaagacccttcaggtttggaattgagctgaagtgcactctgggagagcaggctgggccctgcattgaaagtcatttagagcagtcagtgacagtctcagtgaagcagaaatgacatgtattatttattgagagtagcctagaattatctcatgcacatgattccagccatccatgcttaaaattctgagaactaaaatgaccatataatttgactccagctctcagatgagattttttattttttattttttttttggtggtggtttaaaagttctcaaaggagtagatttttcaaatgatctcatcctgacctacatagagacatttcttatgagacaaattagttaatcaagtagttattttgggatcagacaatatcagaaacatttgaaataatgtaaaactctacttttcggtacctgttaattttgctaatataattatatctcctacttaatgatggagatgctaaaacactcgaaaccttccaatcactgacaaattctactgtataaatagtgatataatacctcagtgcctgaagggtagacagtgtttaaaatattaatagctctttgtacgatgtggaattcaccgtcgcctcacataatccctgatgactggttacctttaccatcccagcagtgcacagtaggagaacaaagagaacatacggtgttcaaattcatgccacgcatgtagctgatattacaaggggtgaagaatcagtttctggtcttacttaattatacgttgcatatgaaattgtgttttgttttcttatattctttttagatgagatccttgcaaacattttcccattttctttttaagcaaattttctttgatcaaatttaatactctctttagggatcaaataaatatggaggagagtaaatgtacttgttattttccattgtgtgtgtttgagaggggctggggtaagaagagcgtgtcagtggcaaaaacttggcaatacaagttttctcctgcctctttgtaccatagtacaaagtcatatattcgatggagtgtaataatacacatatagactatagcataaccattaaatcattcttgatccccctctttggctgttttagacaataatatcacttctgataagtatgagcaaatttcaagttccttatttttttctttttaagaatggaacatgactttatatttcgaatgagacatgatgtggatcacctttcataaaaataatgcatcctcttttaaataacattggttcacaaattctttggcacttaaagccttcccaatccctctgattttctgatggaactttgaaacaacatcaagatattttttcatcagtatttgaaacaacatgaagataatttttcatcaacattttatattgaataatatgccaattaactagtacagttattttggaatctatgcggtttctggaaaaaaaaaaggtaagcaaggaaataaaagtgttttcatccagccacaacttcatcatgaagggtgtaacaaaagtacaaatgcaatcccttcacttttaatttaagaaacccagtcctgagaaaacagtatgtaccagatggtaacatttccaatagcctggaaaaaaaatcatttattctgtcctaatggcattataggactcaatcactgaatataaggaagtctctgaggggagatgcatttagaatttgattctgggtgccaggaacgtattgtccctatcactgctatggaagctgccaggcccagcagagtcaaagaacagtgtctgaggtccaagtgacaggcaggctgagatatgggagagcctctggaggtggggcaagtggagactaaccataaagcggaggagaaggaggtgggcactgggaagacagtgacaactgtggctaagggctttaccctttgtccctccgaaggtcacattttaatggtgggagtgagctatggtggaaaagcaaaggccttttcagctgggtggtcaccattctacctgacaaaggagggctgcctgctgcagctttcttggttctttcttttttgtacagtctacctgggcataatggcttgtactggccagcctctcctccccccttgagatagtaatgcatcctaagggcaaagaaggttaaagcagatacaacgacagtgcacagacctttggaaatatcaatagaatgaagtaaataaacacataaacaaaatacttaatttcatggaagaagtttagcattatcttagacagttgcatgtcctcattatttgtctttcaaagagaatgcaggaattgctctgaagaactgttttgagtatgtagttagcaagttaaataactttgtatattctgaatagactcatacaattatctccagaaacttacaaatgctgtctgtacagtatcttctaatgacaatgtaaagtcccttttcaaaagaatttaaattaaaaatgtggtttacttgctcccagaatatatatgatagaataatgaaatctcttcatcttttatagaatcagttgtgtatttgatcagtactcaatgaaaagtaaccaggattttctatctcattactctattcatacatctcaagcactgaaaactagatgtactctgacaaaagtaattgcaacaatgagcaatgtatcagaatattacaacactgacatatcacctggcaaggacagaacagtcaagacaatagccaaaaccatgtatgcattttagaatgtttttccattgctcactaggttttaaatcagtgtcatttactcattctaattttagagagcacagacatatgaaacacgttaaaattttaggacaattcttaactactttataatgaaagtacaatttaaatgtaactaactttcaattagctttattaatattactgtgcaatgaggtagaaaatacaaatttgccaaggatttaaaaagcatttatagttttgggctttaaattatgttttttttttcctctggaacttttgactttttaatcaagccttgcttgggctagaggtaaaacgaggctgtggtcctgaacctatggaatctatgacctgaaggatgtgggtgatatggaaagaaatggtagacgaagagaaagaagctggaccctaacatttcacccagggaaacaggctattgtctttaatgtaatgatttccagtagacatctgaactgtgagcaacagcggatcatcatgtccttcttggccacagagagcagaagccatggtctcatttgccttcaagacgctgacctgaggggtcacagtgacttctttgaccatctggcccttctccatgatagaatagtcctcagaactgagcccaagggttttcccaaaatgaatcacccctgtgagccaggaagaaaaggtgaaaccatttcctcatacattgatgatgcttaagacagttttctttgttctgaaacaaaacctactatccttaactggatagagagaagaaattccaagggaactacaaagttgattccattaatcctaagaagatacatgaagcaaggatcttgagtgtaacaccaatgtctcaatatgttttcacatgtatgaattggttagagactacacagcaacctgtgaaaaaaactgcatgatcttcatttttgtcctagaagtacaggcagaggcaaagaggttaaattggcagccagtgtcacagacatggtaacatgaagaggcttggatccttatcttctgtctccaagtccaaaagttgttgttgtttaatatcaaaacactgtttctttaagtcatatatacatgtcagcagtttaaggttgaaaaagtcctgtgtaaacagaaatccacttgtttgcaggagaaatcttcatgcctcagattttggtgcttctccagtgaactgctgcttacagattccaggtgctggctagaggaaactcgctgtccactattcgtgggacaaaatcaatctcagaagatgtagaggttgaaatgttaattttctgcataaaaattcagacccacttataggtcatatcaatacagacactatataacacagacacaatatggccagcttcttctgatcagattaactgagtattttagagtttccatgattatgtgcacttgttctgtttacctagttttaaagagactttatttggaattgctaatatttgcctgcgttagctgaacatctgccttagaatacagtagaccttcaattaaagaatatactttgtaataatacagaagaggccagaggtctacaatgtggcattcccgagttattctataagtcacaaccacactaatggagtatctgaacgtgtgttgaaaaaaatccaggactggacatccacagacctgggctctagcccatctccatacttatttgaccatagatgatgatgacaaagatgatgatgacagtgacagtaatgaccagttaaccttttttgagtacttaagaaattccaaggattgtcctgagcagtttccatctactaacccattcaattttaatgacatctaagcgaggaaggtacaaccattcccactaatgtcgggggaactgagggatccattaactgaaacctcacagttactcgtgggcctggggttaaacaaaaatagcagattggcttcagaatgtgtgttcttaagcacacttcatgattctgtcacaacaaattgtaatctttccaaatttgaacacctaaggagataatggatgtgcaagtgcttggaaaaattttaactgctatataaatatcagttattattatctgattatctaattgcatagccacatggtctgataataataaaaccttcacagggatattttggtcttgaaaaccttattgtaggactctcccacacattattcatgctttctttcaacaacctgcaagctttcatcttacaaacaaaacatacaaggcacagttcattaaaatggcctgcatgcaataaaacaacaacaacaacaaaactaatgtcagagcaaatagatgaggagctaaaatcttttggcacttagagacagttctccgtttcctcagcctgaaattcttttttccatcaacctcaaaactcattctcaaacttaaactgctgcttaaatgtcacctcccaatattttaatagaaaatattaagtaagaataaaggaaacagatggtagaacttacatacaaaagggttattggaccattacaaaatcaatgagaaaaattgttgattatttctaaaattaccaaactgatttaaatagattcaaagcactttgatcagacttaactctgcagaataaaaatattctgtttaaatttcactactaatgatttcatttgtagcagcagtttcacctttatgggttccagaagaacttgcccatttacaaattaacttagagtaagaggtagctactgatgataaagtggttgttttctcctgatcttcgttagtaacttataaagctcatttggaggagtttctctgaggaggtcccctaaaaatagtggctcagcgcatctaccattccaaaaatgagctgagagaaaaagcccaaggggcttgttatgcaagaaagcttcagagttgacgggcaggtgtgtttataaatatcatttctaagcctctgtctccagaatatctatttcgtctggtcagttgctttcaatgtgtaatgctttatgtgaaaattaaaacgttaatggtcccaggaatatagaagtacccatttagtttttaaactgatttagacttatccaatgtccttggcttaattagtacgcttttccaagtttgactactgtggatggatacataaaggattggtcaaatgtttgcactacacagtaagtcactcaactttttttcttttttttaaattttattttactttaagttctgggatacatgtgcagaatgtgcaggtgtgttacataggtatacatgtgccgtggttgtttgctgcacctatcaacctgtcatctaggttttaagccctgcatgcattagatatatgtcctgatgttctccctccccttccctctcatcctccatcgggccttgtatgtgatgttcccttccctgtgtccatgggttctcattgttcaactcccacttatgagtgagaacatgcagtgtttggttttctgctcctgtgttagtttgctgagaatgatggtttccagcttcatccatgtccctgcaaaggacatgaactcatccttttttatggctgcaaggtcactcaatttctttacaatggtgtaaaatggaagacatgagcaaactgacatttatcataaaaataactctcaaatgtataactttagtttggaatgtgtacccaaagaattttatcatgagtgagattgcacataatattgtaatcagagaagtgtacttttcatcgttcattccaattcccaactataccttacaaagttttgtctttaggttatttgccattaaaaattaatgtagcacaaggagaagaaaaacattatttcttcataaatagtttaaagaggatctgatatattcgtatttctcactatcaatacttgcaaaaataaataaaacattaatacaaattggttttgaagaaaataaaatttaaaagtgaaactcagaaaacactacaatttgtgaatgggaacatagcagtttaaagaaccagtctttgatttgtgacacatcacacatttgccccccgttgatctgcatggcttgctggtgcatttctttcaggtctctgattcaatgtcttctcacaatagaggatttcctggccttcgatcattctttattctagtggttctcaaaactcttggtctcttaaccctcaaaattatagaggactccaaagagctttattttatctgggtatatatgatgctagtcactcaaaatgtttccaacagaagaatatgcagcacacattcccagagctgtcagggacatgatgttgttacatgccatgtagtctctggaaatcttcaaaaacattcgtgtgagaaaaagaatgggaaagcaagtatctcttagtattattatgaaaaccttttggctttgaaagtccccatcaggggccacgaagaccccagaattcccaagtatattttgagaaaaggtgctctactctactgttgacctggctttgtccttctgcaaagccattatcgatctggccctccagtattgaaaaggttgattttggccttttctgactagaatgtaaatgccacaaggacagagaccctttgttcctgccattaataagtggttaatacatacatttaacaaaataaatgactggaacatccacctgtgcctacagtgatataacaaaaactcagtacattaagagttggttacatcagttactgttcaagtgcaagtgccttattgtttgatcagtatctgtcagtatctgtattcttttttttttttttttttttttttttttttttttagacaaagtctggctctattgccagagctggagtggagtgaggcaatcttggctcactgcaacctctgcttcccaggttcaagcgattctcctgcctcagcctctcaagtagctgggattacaggggtgccccaccatgcccggctaattttttgtagagatggggtttcaccatgttggtcaggctggtctcaaactactgacctcaagtgatctgcctgccttggcctcccaaagtgctgggattgcaggcatgagccactgtgcctggccaatattcatatgttttaacttttggggaaatccctcaatacatcttcataatgtgttactgagagagtcctctccttcctctgcctcgcggggaaaagtctgcttattctaaggctttctcactggggctggcagcgtctttgctttttctcatacctatggcagctctgaacctgtcctcactttcagcagctttcatctaatcttcatatttgtgttccgggaatctacaatgccttgacaatttcaagaccaggaaattcccaccaggttctacacacattgtgcttgatcccagaagatcctgataactcaagtgggaatgatgtctttaatgagaaatttgcattgttttctcatattaagtgtgtggttaaagagctcttcttacttgatgcctttgcctattccttaaattcttaggtttgcctctgagctggcgaccttgttagagaaggtataacatgcttctgaaacatctacatggtaggaggaaatctaagtgaaatctaagaaaaagaaattaggccggagcagtggctcatgcttgtaattccagctacttgggaggctgaggcaggagaatcacttgaacccaggagatagacgttgcagtgagatgagactgcactattgcactccagcctggcgacagagcaggactccgttaaaaaaaaaaagagagagaaattaaacaccagctgagaaacaggtagaaatactttctggaatggaggataattacagcttcctgaaggattttattatttcctgtgggccacctatgtgttttccctcagcttttgccctcaccttctatttttgctactgctaacctcccattaatttcatatacccgaggtagggggggaagtgagtgtaagtgaatttcaaaaggaatggtagcatcagccaactttagacatggacaccatgacaaacctctggaaagaacagtcttgtttgtattttaaaaacttggacctcccagcactttgggaggccaaggtgggcggatcactggaggtcaggagttcaacaccagcctgaccaacatggtgaaaccccgtctctactaaaaatacaaaaattagccaggcgtagtggggcacctgtaatcccagctacttgggaggctgaggcagcagaatcgcttgaacccaggaggcagaggttacagtgagctgagactgcaccattgcacaccagcctgggcaacaaaagcaaaattccatctcataagtaagtaaataaacaaaactggaccaaagagcatatgataaagtgatttcacagggaatgaacaattaggatagctcaactgactcagacacgctttcaggatgtggggtctctaaggccaggtgacagtccttgggcacatctgggataaggaaggttttctatcctgttgggtctattggaggacctggtttccactataatagaaagcaaaacaaagaaaacagccctttttccctgaccatgacttttattttttgagccaatttgattaatggatttatcattttgactactatgattttcatgaaaaatttactctcctaagacctcttctgcatcttttggtgtcatgcttaacacgaattatgaaaacattcacttcacaaggatgcctcccacctttattattattattgcatgagaacatatggaattaggttttatagcttttaaataacctgatctctcaaacgtctcttgtaaattaagtatattcacagtaatcaaaataaaataaaactgtaagtcaacagtgaataatatatttgcctctgttaaactatatatgattattctattttaattccacctgcttagaatggtaacatatacgattgattcctgaatatatttaaaaatatattcagatttgaaaacttataataatatgtacttttttttaaccataacactcagaatatattagctctgaagattttcttcctactgaataatggaattttctaaaatatgacagaatttcaattcattaatatgctacagaaaaaataattactattgcaaaatacaatatttaaacaaattaacaatctgtggttaaacatacgagttatttttttccaggttatcctttctatttcttattttgactgacaacatttttgtgaatcactggctaagatataatcacctttatttctgagtttgtatataaaaggatgcatagattaaagaaagtacttggtcctaggcagttcaagtcacattattcattatgtagaaagctaatggccccaagcttctgttggtaaattattttttattgttttgttttgttccactgaagcgacagcagtctctgaaacaattctcctagtgactcagtgactagtttgtttaacaatatttgttaaaattgaaattacacagccggtagtcacaaaaaagaggcagggtggcaaaggttgtgcacatggtttaccaagtgtttcagattgcactgttaaaaatacacaaagtgttggaaaacactggtaactgtatgacccaataaaatcagcatagcagagcagttactgcttgtcttgaggtcaaaaagatgcgtactgtgactcaaattttattttaatcagacctttgaaagacaaatagcaaaaagctttaaataaaacaaattaagaactatgcgatcatggggtgagactgctttccattttagaacttttccagactgagtttagacagtatttagccttgttttagtcccttttgagtgaggattaagagactggttctcaagggcagggtgccaggtccaatttagcattagctggttcatagctaatgaatccattgattgaataatcactgactggcagaatctgatgggcttttcctaattagatgaaatctgtcaatgtgccactgcatatctatttgctatgtttctatacgggagaggtaaatatggtatacggttgttccactatcgaggaggatgctgtgctgatagtgctgtacactcactctctgctagtcctctgcacagagaaggatgtctttcagtttggcttctggttgggtttggccaatgggaggcaggagaaggagattgggggagggaggaaaaagagattatgacattgattccccgcttgctgctagactctgctggggatagttccttgatttcccttagggtctaagggtggtaagggcatctgtcttccactgcctgaataccacaacatgcgctgtttgttcccttaatcttgcccacctcttcataaatagtcccttaattaaattctgttcagttaaactcttttgaatagaatctatatctcatctggaacctaactaatatatatacacagagcaatttagatttttattttatgatcctctgaacacttaaaattcgcaatattgatgcccaaaatgatagttatctacccaatatgttaaaattattttcctagtttttactcagttacttcagtttcaaggtgactctgaatatgttaagggcaaatggttcttaagaataataatattctttatgtgactgtggttcagaatccttccgcatacaacttttgaatggtacttttatcaattgtttcttttttgttttgtttcttttcctttcttcaaagcaggatgaaggagctttcaaaagaaataatcaactaaaatcctaggagtcttcaataagataattcagtacgtgacaatataaagtgactaatctttctgaaaaataaatatttggtggttaccaaatatatgtggaaagaccatactggagcatttaacttccctattataaaccatttgtaggtaatttttgaatacatattgcaggcaaactaaagtgaaagctaaaaaatttctttccattttccttgtgtgtaacagagtttctcaactaagaaagctcagtactattatttgacttacagaaaaaaatatcatctatttatcccctctatttatctcttctggcatttatttatctttgactattttactttatattactttatctctgcattactattatcgtatgcatcttactagtttcttgctatttatttacctcttttaagattttccccaaataagtacaacattctttattttgttttctatttttaatcatgaagttaagatatcctctgaatgtgttttttcccccatacttctgtttttactaaaaaatgttcctgttttatttgcttagtaaatgctatgcaattttctttattatttccatttgattcagtaaatatccagaagtatgtttcttagttttaatattagtacattttgcttacaattttattatttacttttagtgttggtagatttttatccaagaatatggccctccatacttcttaacttttataattgcctttatcttctagtagctggtcaatttttataaattttccttggacatatgtaacaaacatatactatcatgcaataaataaaacctttaaaagttatttaatacatggttatcttaatttgttatttcaacattttgtggctttcccttctagcattctgtctgattcatgagacgtgcattcaaatgttcacaataatatttttccttaatttcttttatttttagtaacatttgttttaatattcacatgctatgctgtttggtgcacacatgttcattagatttgagtatgagcttaacacatctttataagttaagacagctcactacataactcccatctttggccctgctaagtgattctgtattaaattccaatttatctcacattattcttccaatcccactctttgcattgattatatttgcaggcactactttgaccattcctttaatttcaacacttatttcattaaatgttatgaataactcataactactttctttgtttactgcaaatttgaacttttattcttttcagaggagaatttagaatgcagcattagattgatatacctatattttcccttctattttaatttgtttactttttatttaactcattaattattttctgtactttccatttattaaatgttactccttctcctaaactcgttatcaaatatattattatattaaaaaatgagatttccactatcatctccccgtttcccaacaaggcaaactattctgttgctgctcttattacttgctaataagatgaatgcatgtgtttcaaatattaattaaatgtgttctaactagagttgtccctacaagagaaatatatttaatgactatgagtaaaagaggtaacgattagacatttttcaatacaaaatacagagaacaaggataataccaaccaatctttctttacgaattgtattgagaggatgcatatgggtataaataaatctgtgtatacacagcaatgttatcctaacagtaatggtattacaaagattatagagaaaatgagctaatctgtaaaataaatggttttcaagatcagtttgctatcttatccttatgtcttccttttgcatgacgaagcttagtgggtattggaggaaattttattttttaaattaaggaataaaatgcttcactggtttttgatgtattaccaggataatacctattttaatgatgaaatttttagtcttttgtggaattttattaaaataagtaaaaagaattttatgatttatttaaaggaggtccatttcaactcctaatccacaaccattctggttgaaaaatacgtcattaaatggagagaaagtgatttttaaatgttctatggaattaatatagcaatgcaagatggttaaatacagaaatgtaagaatttattgcatagtaccttagcatagtactaaatagataatactaagagtacaccattttttttcctattttgtcatataattgctgctttttatgatttctaccaacagtgatctctatgagtaaagcactgataggtaatttttttttttttttaagacggagtctccttctgttgcccaggatggagtacagtggcgcaatctcggctcactgcaacctctgcctcctggattcaagtgattctcctgcctcagcctcttgaatagctgggactataggcacgcaccaccatgcctggctagtttttttgtagttttagtagagatggggtgtcaccatattggccaggctggtctcaaactcttgaccttgtgatctgcccatctcggtctcccaaagtgctgggattacaggcgtaaaccaccgcgcccggccagcattgatagttaattttaaggcagacattgtgttgactacaaaatatatgatgagttcataaaatgcagtagtctagatattgaaaaggatatcagagaacagtgagaatcaccagtatgtcagtaattagtgcgaaaactagatgccaactactgacttaaaagagtttatactctaatgtgaactgaggtgggataatgtgggaagggaacagatgggacggagtgaaatggataaaacaagtataaaaatatcctgaaatcctcatttgatatggctcataacagtaatgatattagaaataatgacataatactcctatatttcaactatcttcaagcataactgccacgtgacttactttcacctgtagaataatcctgtgggtcaagtattcctgattcctgtagtgacctaatacaggagtccaccagctcgagacctgttgtaagctcatcttcgatatctttttgaccatctgaaatgaaatattttaaagtgatgaacaaacacatggtatattattcttaaagatttaggttatcatttaatcatggaaaatatcctagtcaaatatattacctctatgaagttttcattagctattccattttaatttttggtcaaccaacattaaagccaaggtcagcaatttcatgtacccttgaagagcatagttactacagaattgaaagatttaactctcaataaattgtgaactatcataacaacttcatctaattttactatcgggatgttttcctattacttttctaagtctcattctaaagttcataagaaaagtcatcagtagagatatgtttagaagtgtaagtgttcatcaataagatagacattaccttgtgactgccactgaaactgctcttctgctgaactgtaaaaaagaaaatacagagatataatgcattgattagaaaagaaaaataaaaccctaaaatctaagacacaaaggcatattagggtagtaacagtggccccgttgcatttcctttcacttcttactatgaaaagggattccactttgatataattttaattttaatccatttgctgtatatcccttttgattcgcaagtattagcatgttttaaatggacattgtccagtaattttcagaagagctcattttttacaaagcccaacctgttagactcattctttacaatagcttctctatacatgcagttttactcaattttagttattttagaataggatcatgtagactttgtaaggtagcctaataaggaaataactatccctttttttattagagagatgaaataaatctttgcctccatttagccatatcatattaaaatttccctttagttgatttaagagtttaagtaatttaaaaattataacactttaccaccaactaaatacacatttccaaaaatctcaataatacatcttatgaaatgacccagacggaaagggttgtccatatacatatgccaaagatactgtatagagtggttctgtataggtaacagatttattttgaatgacttattaaatacaaaatacatagtttctaaatatgagcaattcttccattgtgtatgcaaacacttcctacaggccccttttttatatgtaaataatcggtgagaaatctacatgctaattcctgaaagacatcattttgagaatgattttgtacacttatttcatgatattttactctgttcaagcagcttctctgaatagttcattagtttcacaacagcacatggattgtagacctttagtctgtaccttagaggtgggttctgaatacatttacggagaaaaagggaattctgggtataaatcaatgttcagaaaggccatgactggcgtaaatgaaaacaagagtagtccattaagagacatgtgactgttatggggtatcttgcccctgagtcaatcaatattaggaaactggacaatggttttataataatgagagctgtagacaatattgatacaggaaatgataatatttcaaattcagtccaatgcaactatttcttgcacaaaaagatgtgacattatataatagtaacatataactacaaagtttagcccttaaaatagaaatgtaataaaaatgattttaaaaattataaaaaccttttaaaaattaacaggttcacttagtaagtggaatttaatataaagtagtcccatcttattattcaagaatcaccaattcaaaaatcagaaccatagttatcctggctattttaatcctctaagaagtctatggatcattacttttcaagaatgtgaatatcaaaatactactgtttaaagatcaatcccattggtcatttgcagaaactagactagaactcaggcatatgggttctgagtaattccaaatgcttacttgtgtcagaatcacctgtagcatttcttaagtatatgtattttggggccctactagagacctacaagatgaaaaagtctacggattaggctgggagcctgcattgcataacaagcttccatgatgatccttgcgtgcttctaactttgtaaaacactagatactattttcattaatcatccattattaatttagggctccccacaacttcattcttctatattttaaggctggacaaattctcaaggtggtataatattttaagtgtttacatgccatggatttatacacagatagaaaacacttccatattgatagtgggttgaacggagggccttcctctctcaaaagatatgtcctcatcaaaaccctaagacctgtgaatggtaacatatttgggaaaagtgcttttgcaggtgtaattaagttaataatcttcagatgaggtcatcctggatcatccaggtgggccctaaatccaattacacatgtgcttataagagatagaagagagacaaaaatggagaagggcaggccatgtgaaaatgggggcagagactggagtgatgcaggcacaagtcaaggaatgcgtgaagtcatcagaacctgaaagaggtagggaaggaaactcccctggagtatttgtagggaatgcagccctgctgacaccttgattttgaacttttggtctccaaaaccatgacagaataaatttctattgttttaagtcacccagttgtggtaatttgttatgacagcgccaggaaacagatacaacaaaaaagttctcgtgttatgtcctccaggatttgctattatctctatactcctacattccttcaccagtacagctatttactaagtgcttcctgaataccaaggcccagttaattcacaacaatcacaaatctcttctttatagatggggaataacagatttagtaatgttgaaaaacttggccaaacagctcctaaggatcccagcagggatttaaactgatgtgtgaactcctaaactcaaattcttttctttaaacctttatttccgggatccatgcgaaggtttgttacacaggtaaactcatgtcatgggggtttgttgtacagattatttcatcacccaggaattaagcccagaacccaagagttatcttttctgcttctccacctcctcccaccctccactctcaaatagaccccagtgtctgtggtttccttctttgtgtcataagttctcatcatttagctcccacttgtaagtgagaacatgcagtctttggttttctgtctctgcagtagtttgctaaggataatggcctccagccctatccatgttcctgcaaaggacatgatctcatcctttttcatggctgcatagtattccatggtgtatatgtaccacatcttctttaatcagcctatcattgatgggcatttaggttgattccatgtctttgctattgtaaatagtgctgcaatgaacatttgtgtgcatgtgtctttatggtacaataattcatattcctctgtaatgggattgtcgggttgaatagcagttctgcttttagctctttgaggaatcatcataccgctttctacaatggttgcacaaatttatattcccaccaacagtgtgtaagtgttcacttttctcctcaacctctccagcatctattattttttgactttttaataacagccattctttcaaaatcaagtcatggtggcgctaggcatggtgactcatgcctctaaccctggctcatgcttataatcccagtgatttgggaggctgaagcagggggatggtttgaggccaggaattccagactagcctgggcaacatagcaagacctcatctctacaaaatctttttaaaaattagcaaggtttgttggtgcgtgcctctatttctagctaattgggaggtcaacatgggaagattctttgagtccaggagtttgaggcttcagtgagctgagattgcgccactgtccctcatgcaccccagcctaggtaaaagagtaagaccactgcctctaaaacattaaaaaataatttttaaaaatttgtgcaaggaaacatgcttaggttaccacccattttaagtgatatgagtgagggtgtcaatgaaagtcattcccagtactcagtaaagtccagcactcctctccttgcaggcactttgaggaaaacactctgcttagctcccttgcacatagatggggtcacaaaagcgtatgagaggaagtgacaagtgccactttatggccaagcacagaagaataagcatgaggtcttcatgctttctctctctcttaagccctgtgttgagatgcatgcctgagtaactatgtggaatggagacttctgccaacccacagagaacacagagcaccagtgagaaacaaataattgttgtgttaaaactctgtaattagagggctgtctgatcctgaagaataaatgtcacactgaccaaaacaaaaaggtgaattcctaaggcatttcttgctcttgctcttcgatttctgcagcacagagttggaagaaaatgtccggggtaaccctagtacaaataaggtggtgccgattttatgtgcaggtgttgattttatgtttaggactacacgtcatgctattagatatttatttttctgttcatctctatcaaatgtgtttcaattttatgacacaacagaaaaaagaagaaactctttttattataatttaaaaaatataattggaagtgaatataaaactgtctttccaaagcacaggcaacttccttttgggcagacaaaaagcactaatcacttcaatggtttccctgatttctttggcacagttaaaatgcattaaaagtatgactgatcacagagaatggaagtcccaagagaaagctggtttggattttatttcctttaagtgcacactttaatctcttagctaggagattttatgcaattgcctattttatgtatttgattccttgttttaaaaattgctctaaggtagatgctttttaaaaagcaaacaaactatttatttattcaataaacatggattatgcctgggtcacagacacactcatatcaggtgtctaggaattacctgtggtaaattttctctcaattacataattcaatttaatataatagaaacgtcatttttgaaggtgttataacttaaatgcatgttcaacttcaggaaataaagtttgcttttactgctgaaatgctattttatgaaatagaaatcacctctaaagaaataaatgtaaaaaagactatagacataattttgatcagtccatatgtgtttgaatatacctaaatataagatccagaacctagtgactgtgagaaaaacatgtatttaggacaaagacaaccataaataacacttagcctttaaatacataaagacatcagtgatgctaggaaagaaattttgaaacaatatattgaaagcaaaaatcctaatagctaatatttatataggtctcatttggtagcagacaatagtctaactgatttgtagttaatcttcatattaaaacttttgagaaaggtaatattttcccattttagagataataaaaccaaggtaaaaagatgccacggaagttgctagaggtccctcagccagttagtagagaagccagggttatgaccttggttttctggttccagagtctacagaaatgtgtgaaccactattccagtcatacatttggctacatcaaaagtaaaaccttatgtgactaaaaaactcctaccagaaaccaagttgtaaaataagccacaacctgggagaaaatatttgcaaggcatataacttacaaaagcttactttccagaatatacaatgaactccaatgaattaataagatagagatttaaaatgaaatagaagagagctcatcagacatgcatagctggtgcacagcaaaaaaacaaaaaaaaatgtatggccactgaacacattaaaagtatttgaggaataaaaattaaacacaagataactcctcatacaccacaaactgtccaaaaatttgaaagcctgacaatattaagtgtgggggaagaaatggggaagtaattctcatacactgtaggtgggaaagtaaattagtgaaacacacaggtgacctgtgggatagtacctggtaattttgtacatgtaatacctaatcacccaggaattttgcttctatgtagagactccaggaaaacatttgcacctttgtccaggagacttgtacaagattgttcttgcctacattgttgtaatagcaagacaatggaaacagcctatgtgttccagtaatagaaaaataaacaaatataataatatgactacatatcatatatgaggggtcttcaaaaagtttatggaaaatgcatattatgaaaaatttatttgtggatttcaaatatttgttgcacccaaataagctgatattaacttgttataacatgtctgaacctgatctagtttgacgcactaacgagggtaagatatcggtttgaaaagagctcttttgggccgggcgtggtggctcactcctataatcccagcacttcaggaggctgaggtgggtggatcacctgaggttgggagttcgaggccagccttaccatcatggagaaaccccatctctactaaaaatacaaaagtagctgggcgtggtggcgcatgcctgtaatcccagctacttgggaggctgaggcaggagaattgcttgaatccaggaggcagaggttgcggtgagccaagatcaggtcattgcactccagcctgggcaacaagagtgaaactccgtctcaaaaacaaaacaaaacaaaacaaaaaaacaaaataaagaaaagagctcttgttagagcaatatgaattctgctaaaattgaagcaagaataaatatcaaatttacaggaagcttggttggaagaatggcaaaatcattgatgccttacaagaagtttatggtaataaagccaccagagaaatcagcagttacaaatggataactggttttaagaagggacgagatgatgacgaagatgaagcctgcagtggcagaccatccacatcaatttgtaaggagcagggtcgcacctggttactacttggatattgggagaaatagagtttattctttccttttatcttttaattccatttgtccacaaactttttgaaatcccctcatatgaacacttatggaataaatactatttggcaggtaaactaaattagccagatacatatgtagttcttaaaaacaaaatacagagaaaaaaatggaagttgtcaataagatatgtattgcaggatcccaattatgtgattttagaaacactgaataaacaatattgtttataaatatacacattaatacatatacatgcatctctctatatatatatatctatatagatgtctatctatatatagatatatagatagacatctatatagatatatatatagagagagagagaataaaaacatatgaactgaaaaggtatcaaattcaagatggtggtggtggctctacagggggtcagaagggtgaagaaaatgagtccaaggaaggataacttccctccctcttttatctccaatgttttatttatgaaatatgacaaaatgacctgaagttattatgacaaaatgttaacattattttaaaaatatctttgatacttggaagagaaaaaattccccatgattcctacacttagaaatatgcttagttaaatgtttagataaacctttgtgattgcagcctttataatattcttagcattgttagaatcactcccagtttaaactcaaatgatgccaaacaattctgaaatatataattacaaataatagtggcaacaactgtttagagatacactaacttctttttccatttcatatgtgagacaactgacagtgtcatttttacaatgtttcaagtttgatttagtttgaacatttcaagtaagcaaccaataatcttcaagttcagagggcatgaaataggaagcacactggtgtaaacccaaagacaacctttgagttccttcacaagtgatttccacctcatcattccaacatcatagccttagtaactatctccaggccatttctaataaaaatatatatatgaaagttcaaagcatttttcttaatgccaggaaaagacacaaagcaaaccattactagagatattccatctgttatgaacctgctcaaatatactcttattgtctttttcaattttttgatgcccaaagcatcagtctccacattgtatcatgtggtgtattattgctcacaatatctttcaaaatgaaataaaggtacagaactatgagtttttttgttagtctgcttttgagttaagcaatgtacctaaaacataagccagagaaactactgggaaataaattgcttcaaaactgacctctggccaggcgtggtggctcacacctgtaatcccacaagtttgggaggccgaggcgggcgatcacaagatcaggagtttgagatcagcctggccaacacagtgaaaccccatctctgctaaaaatacaaaaaattagctggatgtgttgtcaggcgcctgcaatcctagctacttgggaggctgaggcaggagaattgcttgaaccggggaggtggaggttgcagtgaaccgagatggcaccactgcattccagcccgggcgacagtgcaagacttcgtgtcaaaaaacaaaaacaaaaacaaaaaacctgacatttgattctaacctataggaacaaagacctttatattgatgatgtccatatgacctgaccttgtatttggacagcaaaacatttttagtacatagttttgcatgcagccctcccaagaatagccatgggttgcaaaataaaatgcccttagcctcaagtactgtgaaagtgtaacatatttagttaaaaatggtgaagagtgatcccccactgagctcggctttaggccgctgttgccctgttccattagcgcattatgtccagaatcactggtttgggttgccgaataactccactctccgcagaatgtttcgtggaactgacttccctttggtcggctgcctgtggtctctatacttgtctgtgatataatcccaaatgaatgtcctaatatctctgccatgcaattagaatgccgtttttcttgcttagatgatatatcttctttttgctttaactattgccatcaaaaatacaacttgacggctattatgaacatttttacaggctacaatggatatagctacagaatctcaaagcctggtatatcttgaggaagtaaggaactgcttcctcttttatgagattgttacccagtgtcatgcctacgtgacacaggtaaatttctaccccaccttaactctgcttacctttaggaaactagatccctgagaggtcagaagctcccacttctgaccaaactggctaagactagcgggaaccaatatagcagctcgtctgacctctgaagaacctctaacttcattataatctgatttccatgctaaatgatgctcccactagcaccatgacagttggcaatcaccatgacaacaactggaggaaaccataaaaggacaaaaggaaagtggtagctccagttctgagaagttccctgcccattcccagaaaagatatgaatattcttccccttgcttttcatgcccaaccccttcattcaagataccctacatctgtgactttccagctgtcacccctgtcacacacctgcttcttgatttcatggccactgaatacagcttgctctgcttgacgcttacttttggttttgcatattggcttcgaggcaccaaacagggaaacaccccactttgagggggaccggctttgctagtaacatcatgttgttcaaatggcttatatggcttattgactatggcttactctaatctatttcatcacttggagtacactgtggtccactgggggagggccaaaatggggccaatatggggaaatgggaacagtggacactaaaaaaatacccaggcatggcggtgtctgcatctaagcagccagacacaaccagtcctagagaaaatggtgacacagtcaccacaaactcttggtgagtgctcactgtggctctgcggataacaaagagaggggcagcaccagctgtctatgagtttgcagtcaggtaagggcacaagtaggtaaacacacagaactggggggctgctgcctaaggggatgtgatcaaggcacttctgccttacactctccaagtctctgtttcctcatttgtaaaatagagatatcactagaatttttcccatagtgattgtacaaaagttaagggtataaaacacgaaaaatccatagaacatttccaggaacataggatgcaggactgcccccgcactccagccgcccaacaaaagttaagctatcattaccacatagagaagaacagaggcctgagagagtgcagctaattcacagaactgaaagatgaacgcaggcccaccatatggcattcaacttgtctatacctggggaccaatacatattatcaaaaatataagttacaggctctgtagaatttatattgtctacctttttttcccccacgctaaaatggagaagaaacaaagcagtctgtgatttataaaaaaagatgatttgctttaaaaccgtaagtttttaaatcagtgttgctcaggatgtctttcctggcaactgccaccattcttgccatagtaaaagccataaagaccatttgctattttcaagaccacaggagaaaataaatcagaactaaattgccgctattaattttagtttgaggcaggggaaattcatattcttaagctaattttgttggcactggtgactgacaattgtccaagcaactgacactgcaatgtggtaacagctcccacaccacggcctggacacacgcgactcctgtgtttatcacagagtaccacaacactgtcacgtctgcgggccagccagctacagccaaaccagggagaattcacattaaattctgttttgttttaattccttcaaaataaatattctagtttctaacagccacaaagaattagccagaggctcagtcaccctaaatgttctgtctacatacaagccaagctgtcactgtgggaaagaaatgcattcatttttttcttcttcaaattcttttatagcttcaaagttcattgtacttatattacaagagacacattatgcataaaattcaatatcagaagcagcaacaaatggtgcattataaagtagaaaattctcacaccgtagctccttctatagtattcccggaagcttctcatgcatggggctaggtattatttttcaaatgctcataacagtacatgagaaatttacagtaaagtaacatttccaaataccaactatgttagaaaataatgtatcatagtatctttgccagtgggcattccataaattggaatgtagtaagttgaaattccagttggccaggggtactgttcaccagttgaccgataggtcttataatatacagtgttttgaagtactttccaaaccatcaaactgaatagtttgtgtagtttgtgtgcttggtgtatactgcggcattctatatgccacaatgatacttctgttttggtgacattataactcacagtcagatgttgattaacttgaacacttcattccctgatcctgagagtgaagagagagctcactgcatctctcaggtggattatccataactgatatttctgcaggagaagagtacctagtttgtttgccgatagaagtggcatgtatatcaaggttcccagacatttcaagtttcactcttttgcattcaatgtatttttgttcccagaattatccctgttgtcggaccatctcagttaaggcagctctttaattttggagacctctctgagaaaatggagggggtcaagcttatgttttcctggcttcctgtgattctatgtgtgatattatgtgcatgagtgtgtgaatgtgtgttgttgcatacatgtgtgaactcactcctctgttcctctaaaatacactgatgtgctcatagcttctctttcctctgcttttgcttcctacatatgtcatctactacaggtatatcaaaccctgaatattggatttgactgcatttgctatgattttattaatgtaagcaaagctaacacctcttagacatgtaatgaaaatacaaatgaataaccattgccgatttcacaataaagaaaaaattttttttttgctttttttgaggatcaacagaagatttgtaaaaaataagtttcaatcttagcgcctttatacagcagaaaccatgtaatattcatgtacaacaattttttgtggtgttatagatctttacttccttaagagcaatactggccttttgaccatctgagtcatctgaaaccatctgaaagtttcgttaaaaagtttaatgggtgcacaaatgttcattagagttctattcataattgtcaaaaactacaagtaacaaatgttctacaagtgaaaggttacacacactgatacatccataccaaggaagtgtatgtgaaacatgcaacaactctcaagggaattgcgctgagtgaaaaagaggagtaacgttcttgaaatacaaaattgtagaactggaaaacagatcagtagttgtcaggatttagggatggagaaggaggtgtgtggctaaaaaggggtagcacgggggagacttgcagttatggaatagttttaaatcttgattgtggcatggtttcatacagctactgacatgacaaaactgcatggaactaaacacgcatacacacacacatacacatacacacacatcagtgcatataaaactggggaaatctgttggttgtagcaatgttgattctggttgtgatattgtactacttaagcaagataagactattggaggggctaggcgaagttagaagagacgtgtgtgtgtgtgtgtatgtttggcatgtcataaaaatctatagttatttcaaaataaaaaagcaaaaaaaaattagaggaaagtggttttataccactgtgtctgcttttcccagactggttctttatgtggaatttgttacacaattatttccatgtaataattaaactagaattttttttaaaagattgggaatagtgaagtaacaagaaagaaaagaaggaaggaagatggaataaaggaagaaaagagaaaaaaagaaaccattgttgacttctgattatccctttgttcttcattcttcagccagagctcaggtgaccctgccctgggctcatctctgctttgttctgtgaatgaaagagttatccctggagcataatataccaatcatactgcccattgccaatcagagacaagaaattgtgctgctactgaaggaaaactcatccattatgtgtaagattccctgctcatcaggatcctgtattcacttccattgccatatgttctcagggaaaattaaaaatgatatttttgctttcaatattggagcagagtacaagtcttaatgcatactacgtgagttcaggagacctcacacaatatacttcactggctctctggaagcatatttactgaagttaggctgccacctggtagatgatttgcagggtagctactgcagtgccaatctgcttccagcccactatcctaatgcctggaaaggggtctccttgattgactacatgtctgttgccttccatatttattgtcatgaaaaaacattacacatgaaaaaattactttatttccagcatttagcatctgatacttgaaacgggaaagatggagcagcctccccaccttctccgggtacacagcagctgtatgtgtcctgaagttatcctttcaagaaagaatgaggatttgaatgagaggtctgatgaaacaaccgcactgccagtcgaatgtataaaatcattttaaaagccatgaattgaaattcctactaacgttcttaagctatttagagcatatctttaatcattcttgggattatttacaccaatctatccattttccactggaaatgtccctggaaacccactccccttaactgccttggttggggatttttatcatctcttgcctggtggtataaagagctctgtgcctgggtggtatgaataacttctcattgacaaagattctctccttgaccaaatgttggttgggctctcctgagatcttccatgatcttccttggagagtgcagttctagcaacaaccctgctacgtcagtttcgcccatcctccatatctgatcaggttcctccacctccatcagcctccaggtgatgtgggatcccctcggcctgcctttagcaaaaatcctattaggtcaggttagccagaatcctttttttcccctgatgtttcctctcagtaattttctatccattgacccccaccctcctccttggctataaattcccacttttccatgttgtatttgaagttgagcctaatctctctcctccactaccaaaccgcactgttgtagccccccttgaaaaacacaagtcatccttctcattctttatcaagtgctattgaataattttttattgataccatcacagcttccttactgctcatgagaaatgtgaaggaagtcacatcttatcaatagcctgagtctacacatatgtgctcagataacattatgagggctggcttcacgggcctgagacctgtgcagttgcacagagtcccacacttagaaggccccatgcttggcttaatgctctgctgttgccctcttaaaactctggacaactctatctttgagcttatgttttgcgagtgaaatctgacaggtcaatggagcatgtgcagagtgaaggagatacgcacaatccacattcctctgttccttgctgcctcgttcacatagagcatttgcaatgccctgatggactcatgatgtgttgtgggagttgagtgagactcaagtcagtacaaggtaaatgtgttacgtttatgactgagtaagcaggcgtgctggcagctccaaaagaccacactttcccttcaagccagaacttgctttgaatgaagaaggtaatgaccttctgaaaaacatgaagaattgaggagccctgtcatctcctttcttactcaggttagccaatcagttaagttgaaaatgataacttagaaggaaaggaaaagtcagggcaattcatggttccatttgctttaattcatttctaactcaccaataagagaatgttggtagaatatgtgcatatcaagaaatcaaagaaacacagtggaggcggttttgcacagtgtttctcctgctgcagtaagaacaaagcatagggaaatgcatgagctatgaaatatgaactgtattatttcagtgattctgcaaacaagttaaatgctcttatatttgcatttgaatctgcaatagcacaatacacagataaatagtaaaatctgtgctaacaacttaaaattttaagttttctttacttagaattatattaaatagtatgtaaaaaacaacactatgacgagttgagagcaagacagtggaagaaaggagaaaagccttagtatttttttagtacctttaaacgcattttcccatatgcttttttttttttttttttttgagacagagtctcactctgtcacccacgctgaagtgcagtggtgccatctcggctcactggaacctttgcctcccaggttcaagtgattttcctgccttagcctcctgagtagctgggactacaggcgtgcactgccatgcccggctaatttttttgtatttttattagagacgaggtttgaccatgttggctagactggtctcggactcctgacctcaagcaatccacctgcctcagcctctcaaagtgctaagattacaggtatgagccactatgcctggtccccatctgctttttgaacaacagatcctaaatctgcattttgcattgggcattgtgaaatatgtgaacatgactgacctcaaatgaccactgtgatgattcaataataaggtacatgaaggtcccaggcacacataggatatcaagaaatcctctcctgcctctcccagacttcattccaccccactgcccctctctccctcttcatgtctgcaatctttttgctcccatcaattatctccactgtcaaagaaatccacaaccttttattagcctgttttcatgctgctgataaagacatactcaagactgggaggaaaaagaggtttaattggactcacagttccacatggctggggaggcctcagaatcatggggggaggcgaaaggcacttcttacatggtgacagcaagagcaaatgaggaagaagcaaaagcagaaacccctgataaacccatcagatcttgtgagactcactcaccaccacgagaacagcatgaaaaagaccgcccccatgattcaattaccttcccctgggtccctcctataacacgtgggaattctgggagacacaattcaagttgagacttggtggggacacagccaaaccatatcaaccctaaagacaaagtctgactatcaacaatccccggttcaaaagccttcagtagttttttaattaatttccaaaatctgaccatcagcaatccctggttcaaaagccttcagtggttttttaataaatttccttctccctaatcatcacctgtaagatcaagccccaactccttggaaagcatgttccaactgtgaggatctccttgacctaacttgaggaccctgtctcagccacttgccttagatgaggccaactgagtgaggctctgtatcctctgagactccatagtagctttaccccttatcaaaacaggctaggattctttgtttttcagcatttgtctttctggactgggagcaccttgagaacagagactaaaccacattcttccttttttgttgcattgggaagctctgttcctggtactcataaaacaggtgttcacaaatggaggtcagcatagttagtaaagcgtaggatttcctcttaatattctaagcatgctctgcatttatttcgctgaatcttgtctttagaattgtctgtgacaaaaagcgactacaacacttttattcaactttcatcataaagcatcactggcagaagtgatcaatctaccgagtgaatattttgatttgtataacctcatttggaataagaacattcaagaatcagttcctgagctacagtcatgctcctttgtcctcatcctgtatattaatattaaatactttaagaacatatcatggcaaatccttttatgaaaacaatgaaaccttaacttatatttttatatctctaaatttacatatggccttccccacccctcccccttaaacatagcatataccttgatttaagagaaagctatagggaccaacttattcctctgtagggaaggggatgggggtggcgttcacatataaaaggaaaatccacccttttcaagtgccactgcatgtgacagcacttcagagtcatctttttacttttcagctgttaaactctgtccatcctataaacttgagcaaactaatttccttctccctaattaagcccattgccatatttcattcactcaagctttctattaaatgaaacattattttcacttataaatgttccatgatgtgttcctagtggcttctaattggggacaattataaaaagataaatcagaactcatcagcagcagctgtcatgagcatgtccccgttctgcctctggtgcccacgtgtttgtttaaggcgccggggcagagcaggacccggagtgagccctgatgaagcagctcgggaaattcgcaggctgccaggacattcttcatttttaatttgttgatttaatctggctagagaggaactgacaaaatcctcatcacctaatgtgcttaatggtctaaatgaaatgagttggtggtgttggtttagttcctcttggacccatttctaagtcatacaagccatcgatacattgctctaacaagcccttctctccgaaaatgcaccacagaagattagactttggcgttttgtatagattttccaaaagcatcagaaaaacgaagtgatgaaagagtgtctagcaagcgggttctcgcacccctcaaagcacaggtcattatcaacctaggggaaaactgcaactgagttttccttcattttcttttcctattcaggaagaagcaactagaaaaacaaatgtaatttttgtttctttttagctgtaattgctggagttaatcttcattttcactactagaaaataaaggggccaggtgcagtggctcatgcctgtaatcccagccttttgggaggccgaggtgggtggatcatgaggtcaggagtttgagaccagcctggccaatatggtgaaaactagtctctactaaaaatacaaaaattagccaggtgtggtgtcgcgtgcctgtagtcccagacacctgggaggctgggacaggagaattgcttgaaacccggagcggaagtttcagtgagctgagactgcgccactgcactccagcctgggcaacagggttagactccgtctcaaaaaaaaaaaaaaaaaaaaaaggagttttttttttcctttttaccattaagagttagtataaaaaacatagaaaggagtataatgttggaatgggacatgaaacaaaaaaaaaataattcttccaaagtcagggtagttcaaaaataatgatgtaggtgaggatgacttgattaaaaaaaaaaaaaaaaagagcttacagagaataaaaagcatgtttcctttcctttgtctcctttaatcttcaaaatgcaggaaagttcccaaaacatcaaatcctcttgaaatttagaattttaattaatgcactatcctgggaaatgactcaattttcccccacagtgattagagaaactggacttagaatgtcaatttagtaaacgtatgaaaacatgtgtttctgtatttggtcatcatctactgtttaattaacatactcatacacgtgtatacacattcacatcaccaccaccaacattattccttttgccttactttggaagttgggacagtattttgtgtcagggaatagagaacagaaatgccagtatttaaccctagggttagtatatggaaaatgcaatcttagtttatctggataatctgagctatgcataggggtcataccttatatctcttttttgtttttcttttcaaagattcaatcgagaacccatcaggctaaaatacgggttgtgtatttcaaagggattgagcagtttaatgtgtctgaatctttaaaggatatcataaagatttgaaagaaacaatgaatctatactgcctatggagaattagtcagtagaaatatcatcatataaaataaatcatatcgggcagctattctttactgaggttatatcatttagtagaggatttttatggactttcttctttttcctgaccctcttttggtggaaagcattctattgcttgcatgccctgagctggtattctacgacttaaggtgaaagtcacataacactcttagaggtgaactcagctaaaacaccattaagtccatagaggtcaggaaagcaacctggttggttaaacaggtctagttagttaacctagacacacttaggtcagcaatacatatgatggattaaagttagccacgtatccttgccatttcatccattaaaaagggatgtccatttttctccctcgccttgtctctggacttgccagtgatatgttgagacgtaaaatgcagctgaagtgatgctctgaagctttctagcatcttaaggcaaggcttaagagatcaacagctgtagattcccttcatatgaccgaatgcttcttcttggcagccagcctccatataaggactttggctactctgctgacaaccatgctgtggggaagcccgcgttagccaggtggagagaggggccacatagagaagcactgaggtgacagacgtgtgagtgaagccctccgaaaccttcctctgagccctgcccctacagtaaattgcctcagttattgccatatggagtaaaagaaccacccagacatgccctgcttgcattctagacccagaagctctgggcaagtaacttggtgttgttaaagcggctaaggtttgggctagtttggtaaagaatggtagataaccacaataacacgcacagcacggaagcactcctttgtcatcaacagtagcaaagtgacttgtaaattcgcatggtatattatatgtctgcattttattttgaagaaaagatacttgtagaaacacagggctaaacatttacctatctgcttcattgcttcctgggtaaattttctattttatttaattgttaaataaaatgctcaatggactagatgcactccatactatcattttctgaggttgaggcttttttttttttttttttttaagttaagggcttaaggactgttactttgagaaaaattgtagtttgaaatggaaatgatatacaaattataaattaatacctggcaacacagaaagtgttgcaagttagcataaattggccatatgaggacatgggctgaaaaaaaaaaaagagacccaaattgtatgaaatttaccagggaagacatctgggcagaaatgtggtttgagccagattttgaaagaaatgatgggataaaattagatggcagaatggagggaaatcccaggggagtgttggcatggccgatttctaacatgagataaagatgaaaggagaatcaaaatcaataacttatttaattcagtttcatattcctagcaaactactacagctaggtgtgcatgactctgcagaatataatccagcctgtgaaatatttcttttagttctgctgtggtggtgaagcgggaggggatgagggtgatgatttcaactaaacagtgatatttgagaatctttcagaaagacagagtatcttcaagaggataagccaaataaaatgataagcaaaagaaaaaaattataaggaaatgaggaggcactgctggggcacttcgttttggattcattactataactgtgtgtatgtgcattttttgcaacaacaagtatctgaatatcttacgtttctctaaaggggctgaaatctgtgatttaatggaattttataggggaaaaaatctgtaaaacagacacaaagtgggagtatatttactccacattaagtttttcacagaagtcattttaagaccaccaatctatgttaaaattatttactagccgggtgcagtggctcacgcctgtaatcccagcactttgggaggccaaggcaggcggatcacgaggtcagaagatcgagaccatcctggctaacatggtgaaacctcgtctttactaaaaatacaaaaaaaattagctgggtgtggtggcagaagcctgtagtcccagctacttgggaggctgaggcaggagaatggcgtgaacccgggagacagagcttgcagtgagcccagatcacgccactgcactccagcctgggcaacagagcaagactctgtctcacacacacaaaaaaaaattatttacttatttactataacataaacaagtgctctatatcattggtcattaaggagatgcacattaaagccaaaatgagatgctgatgcacctgatgcacatccacttgaatgactatttttaaaacaattgacactaccaaatgtcagcaaggctgttgtatcaggctattcttgcactgttaaaaggaaatacccgaggctgggtaatttattaaaaaaagagatttaattggctcatggttctgcaggatgtacaggaagcatggtggtgtctgcttctggggaggtctcaggaagcttccaatcatggcagaaggaaaaggaggagcaggtgcatcaatggtgagaacgggagcaaaagagtgagaaaggggtgtgggtaggtgccacacacttttaaacaagcagatcttctgtgaacgaagagtgagagctcactcactatcgcagagacagcaccaagccatgagggatctgtccccatgacacaaacacctctcaccagaccccacctcctgcattgggaattgcaattcaacatgagatttgggtaggaacaaatatccaaactatatcagttgtaaaggtaccaaattcaaataggtggttgtgtaaaactgcccaactactttggggaaaagtcggggagtttctttaataactaaacatatacatacccaatgtgccagtggtttcaaaccaagatatttccccaagaaacaaaaagcatatatttacaaaaagacttgtaaaagaatgtacttagtagttttattcataattgtcccaaattggaatgagcccagaaactaatcaataagagaatgaatcaacaatctgtagtatatttatacaatagaaagctactcagcaatgtacaggatggaactgccaatacatgcagcagcatggaggaatcccaaagcttcccgctcagtgaaagaagacttatacaaaataaaacatgccattgattccattcaatatggaattcttaaacgagcaaaactaatccatggtaggaaacaaaacaaaacaaaacagagcagtggttgcctttgagagaataaggtggggatttactggaaaggacagaaaccaacttcctgggaagacagcgtaatattctatatcttgacagaggtttaggttacacatctgcatgcatttgtcaaaatttgttgagtggtacccctaagactggtgcatttccttgtgtgtaaattgtacctcaaaggaaaaaatagggactgaaagtaaatattaaaatatagttattaatatgcacaataaactatttagggggatgtgtactgatgcctgtgactttccacgaaatgcatcaacaaataaaatggataagcatttggaaagagggggtagaaaaaggggtatgtggtaaatcaagtatattaaactgctaatggtagaatgtaggtagtagagggcttccccttgtcagattctttcaacttttctgtatgttttttacataattaaatgttagaaaaggaatgcctcctatattaatagtataggaaaagaatgactcccatatcccaggctcaaacatgttgtgtagtatgccagaaagaaaaggccaaattctccaagtaaatagattatgtaatcaaatcaaactggataactgcaaagaaaatatagcatgcacaagtgtaacatacacacaaacaataattgaaaaaatgcacgaggttgtttttctccaataataatccaaataagacattttactttattacagaaatagagatattcagtgtcacgagataaatggctaccttgactgatactctatttacagattagcaaacgttttcttttttactatttatttatttatttatttatttatttatttaattttttgagacagagtctcactctgtcacccaggatggagtacagtggcgcgatcacagctcaccgcaagctctgcctcccaggttcacaccattcccctgcctcagcctcccgagtagctgggactacaggtggccgccaccaagcccggctaattttttttttgtatttttagtagagatggggtttcaccgtgttagccaagatggtctcgatctcctgacctcgtgatccgccctcctcggcctcccaaagtgcagggattacaagcctgagccaccgcgccccgccgtttgacaaacgttttctgtaaaggcaccgctatttcaggctttacaagccctaggtctctactgtagttactgaactctggtgtcatagggcaaaagcagccacagaaacaacctaggcaaatagatgctgctgtgttcccatacatttttatacaaaaacaggcagctgatttggccctctggctgtcgctggccaactcctattctatttgactgaagaacattcatattaaattcctcttcaacctcacatcacagattttatagtatttataatgcaaatattggtttcagatagtataattcaactaggatgtcaaacctcaagtcttccaattcaagggactttaggaacacagttctattatctgaaggcttttttacaggatgatttttgggttggggtttgctttggagcccagctcttgctttcaaattcactgggtgtcaaatgctcacatttcttggttgcttgagtgcttactgatggggactttagtactcatgtataatggcgaagataaaataacagttgtgaatataactaggagcgttgagataactggaataggagaaagacgacggcagggcagagttaggtgcctctgagtactacaggcaaaagtggactccctttgcttcctgagcgcttgctctcgggggctggcacagtgggagaaccaatccctaccaaggcacaatccctacccttcaggaatatacactgttgtttggaagaacaccagtgggcaacagacgaatgggagaaagattcacccattacaaagacctttctacagtcagagctgtctgagttgaattttatacctgaagagagagaaaaatctcactatccctggaagtactcaaggagaggcagaaagatctccaaccaggctatttattagagcaatttctcaatgaggaagaaccttctaagtccagaatctgatgtataaggtcacaacttacaaattcaatgtgatattggaggagagaaaatacaagattttatagattgttcttagtgacagggccttgttcctcatcatgcacagtattttgaagtatttttacatgtatctacttttttctttatcgagaattccgcaaactgccatggttagtgacttcccaaagatgttccttactcttcccttggttttgactgattcaaaaagaatgaaacatttataaacatccatccctgtatctcacattagaagttaaagcctaagctattttatttagaacaaaggatttcaaaaatttcacccaggatatttgctgacagttttaaaatgacacaaatggcactgattactttcaagctcttttagtttcctaatatttcccttttgaattgaaagataaattcaatgaaaatgaaataactacagcacctcagtttattgacattttggtattttattagttaattagtcacgccttaaaatgttaacttacaaatggaaaggaagagtatctaaaaatacaggccaacctaatccactaaatctaagtatgctaaagacatattttcccaatattgaaataaactcactagtttctctgaaatgttctggagtaccaactggaaatataaaagcactctaaaaacccaatagtatgctttttcggcatatgcatttgtcactcaagggtaaaatttacttaattattgttatgtatttccatctttttaagactgagtcaattaggttacctccttatgagtgtgagttaccgagtttcagaaaccctgcatattcatgacagtaattctcaaatccttgtaaaagaaataaagttggatttaagatattcataactttcccaagagagcattttctaataagggaacaagtaagagtttggatgatctgtcatcatctttatgtgcctaatctgtgcccaccacggtgccaggaattggaggggaaaagataacagtgttcctgccttccagatgcatgagaatccagcaagcgggcacaaagtctaagatttgacactatcagaaagagtgttgggaacgattttgtgtaagggaggaaatggaagaaatgccaacggagagatgatgtgagaactaaactgtgaagactgaggggagtaaataagggatagggatgtggtttgagcttgaattgggcataataagggaaagagcatttggggttgaaggcagacatgagtgtgaacccaaagagtaagtttgggacagagacaatattctgaaatgcctggagcaaaggaggtgtcttcaagaaggaagaggagaggactgtaatcggagatggtcccagttgataaactggggaacccaaatgtcaatatttggcatttattctgaaaagacttgggtgcctttggaggtttctgggtactaggctgtcctgcttatagaaggcagtgagaagaatattccacaagcaccctcacacaagcactgcaagctcaggggtggctaggcctcttctgaagtacgaggtctggcggaggggcagttccctgcagggtcagtataggctgttatgtgttatcttaactcagcattctcagggtatgtgtgacaacatgggagaagaacctgatgatctaacctaaactgatgctgatgagagtcttcgttgggaagaaatattaagaggatctcagatgtacacaaaatggccagctgtgtattgtggactggatatagaaaactaggcgaagaggatcgtcatcttcaaaggactttcaataaggtaaagggataccaattacaaaaatacaaccacaaatgcagattcaattatatatttccatttcttttgttcattcattcaatcaacaaatacatatgtattcatgtccacaatgtaccaggccttcttttaaatgctgaggattcaatgtcaacaatacaagcaggcacagtcgtgattatagaatcaacgtgggtgaaaaggatgggctgtctgggaagcagttgttagggagcttccaaattctaatatatgaactacacgtggtgttgagaaaagcagatggtcccatattaaaaatctgtacctaatttcagagtcacacttgataaagggtctgagtttttaaaggtgattaagttgactgccatctttggcattagatttaaagaatgtaagaagcagcaaatgactaagaatgaacatgattattaatcttcatgatctacagtttatgaaaggaggctatttggatgtggacaagattaacacgttctctgaattatcaacaatgtcctaattacttaggccagttgagattagataatttaatcggtatctagaaaaacatgatttaatcccttccgaaagacatgcttcgattttaactttattagcaatagcaggacagtcctacctaagggacttacttcttttatggaaagtctaaactacatggcattctccccttcattatttatccctttcgccagggcaagtcaacatagcgattaaaaagtggctactttaagttacatatgttcaatgtcttaaagtacctttgagttaaatatccaaatgttagttttgagatgtaaactacactagtaccaccgatgtgtacctaaaacaagcagcagacacgcattctccgacatatcaaatttacctggcagagagggcaggaagctcagtaacctctcatttcctgaaaaggccaaaaccataatccaatgcatggatgcatgggtttctcaggcctctccaaccaacaccacgttttcacatcttttaatgtgaaagtcaagccttgtcactgttcactgttcagcatgcttgaattgtcatcaaattaattccttaggggtagacctagacagcagaggggatgccttggtcagggagaggagatccctgtagacagtagtggctgcagagggtggatcttcggtccactatttggccagaaattctgggataccctcgttagtcataaagaggaagtcactttttccctttcactcctttagttttctgttaatggaagaagatgtgataaataaatgtgaatagtttcttattaatagttggagttatagtcggagttatagtccaaaccacgacttttttctttttgaaacaagggtctcactctgttgctcaggctggagtgcactggcacaatcatagatcactgcagcttgtaactcctgggctcaaacaatcctcctacctcagcttccccagtagctaggggtacaaaactatggttttggcccattcaggaactgggatgttactgagctagctgccctctctgctagctatatctatctatctatctatctatctatctatctatctatctatctatctatctatctatcttatatatatgtgtgtatatatatgtgtatgtatatatatttattttttttttagagacagggtcttgttatgttgctcagtctggtcttgaatacctagtctcaagtgatcctccctccctggtctcccaaattgctgggattacagccttgagccaccaccatgcctggtccacactgggacatttcttaagagagatgacaaaggaggggaatttctgccaatagttatgcaggtacaacttgcagaagccaggacagttctgagaaaatcagacataggtcccctccctgtaattaacacacttctaacccagaagatctcattcttaatattctaataaaaatattcagatgataaaatttgtccaactaacatattccttttcatctccacctattctctcattaactttaatgtatactaaacagtgtctagctgatgtgtgaactcgctcatggcatcaaaattctctgtgatccatgtttcaccttatcttaaactcaaaaataaattatgatgctttaattctcctcaagttcaacgtggactttcctagtcaactggctgtagagggctttaattgtgatatgctatgatcctggtgtgtgagttttagaaaactattttaataagacaggcaatttaccttgagaatattggaattcttctgaaaaactccaggcaaataaaatgtatctccaaattcttaggtatgattattgggtaagaatagattgactataaagaatccccaaatgagaaatactgggaaatagtagccttgtattcagaaattgagaagactaaagtgtattttgatttcctactactatttgaaaattctcataataccagcattataaaatatatgtatcagtgttcattgctagaataatgctagagggccaacatatatatttgtacatagttatgacaaggtagttttatgttggaaaaatctaatgtatgaagaaatatgctccttccccaaattaaaatttaactttcagatggcatggatagagttatcgctgaagctctattatccataaaattgtcaaactatacttttgcttttatatgctgagtttacacataatttgaatataatcatgcagaaggagcatacttatttgttgatgtcttagtatctttcacaaagagatataaactatatagaggatattcatagttgcagaaagacagagttttggatttagaagaatctacttttgttatctaaagagctgaaaacataatgtattatcattacattgattttttttaaagaatgatagttttgatgttaggcaacatttaaaaattatatggggatcatatttggtaattactttttgttactgaaatgtgtgtcacagcattagtaccaaatacactcatgatattttagaatttttcttacaactctctacaattttgcaatgtataatttcacttgccccgaacagagttgatataaaaactgctcatcaggccattttattattgagcttatgtttataatttttaaaagaagaaaagtgttcaattctccaatgtgggatttttttttttttttttttttttttttaaagacagattctcactttgttgcccaggctggagtgtagtggcatgatctttgctcactgcagtctctgcctcctgggttcaagcaattctcctgcctcagcctcctgagtagctgggattacaggcgcccgccaccatgcccagctaattttttttttttatttttagtagagacggggtttcaccatcttggccaggctggtctcgaactcctgacctggtaatccactccccaccccccaccccacccccttggcctctcaaagtgctgagattataggtgtgagccacttggcccggtctatccaatataggattaataccctgtctcactgaacttggaagctcctgggcagtttctcagctcattaccctgtctggagggaagtgcatccatcatactgtcttctccttaatcatcagttatgtgactattaacaagatattttcgccaatatgtgcttccattagcataaacccgtgccttaattaacttacgcttttttccatctgtaactatctgacataaaaattacagtagcaaacaggcctgtgtggcttttctaattttttccaaacttgtcagaaatgacattctttgatgcgcctttaaatccagtttctttttattacttcctaacactttttaaaaaaagaacgaaatacatatttatagaaaaaatttagaaattccgtagtttaaaaaattcacatcacttataattctgtgagtcagagataatccctgtgggcatttcattgtattttattccactattatctgttaacatatatttattttgcatcttattattttataaaaataaaagcttactacttttcttactagccactggcttttttctctaactcagttttcaataaaatagtacatagatacagatatagatatatttttagtagattaaattagaatcccttgtgaatacaccaaagttatctaattagtttgttgcagattttgcttagtggttcagtattatgaaaatacaactaacactgacagaacaagtaagcatataaaattaactgtgttaatgttgatttgaaacattttatacaatcactacaaagcattcatttactcttggtaaaagaaaggagagttagtttgaagcaactttttctttattctgagtactgaaaaagtagttttgggaaataggattagctttactgaaggctttcgcagtgctccaagggtgaatagagggtgcaaatcagacacattggattctgctttgaatccaagttcctactgaagtgtaaggaaagagactttactcagcatgatcttgagggcacagtgggacagccaaccactgttgatataaaattccattttatgagattgcaatcattatatatataattatatatgtatataattttatataatatataatgattatattataattttatataatataatgattatattataattattataaatattatatatatttattatatattagtgaaaagcactaaaattaataagatataataaatacatataataattatatataaaataaatatatataatatatattacatacaccatgaagaatatatttaaagagtatattggtttctattggcattttactacaatgagtacacctcaaccaaacccactgatatgacccaatgaaaaggcatcagttctatgaaactggtatacaacacaggtcacttttgtttattacaacaaattcagactttgattttgactttaaatatgtttgtgtggtgtgtggtgtgtgtgtgtgtggtgtgtatgtgtgtgtggtgtgtatgtgtgtgtgatgtgtgtgtgtgtgtgctgtgtgtggtgtgtgtgtggtatgtgtgcatgtgtgtggtgtgtgtgcatgtgtgtggtgtgtgtgcatgtgtgtgtggtgtgtgtggggagtgtgtgggagggtgtgtgggggggtgtggcatgagtggggggtgtgtggtgtgtgtgtggggggggtgtgtggtgtgtgtgtgtggggtgtgtggtgtgtgtatgtctgtgcggtgtgtgtgtgtgcatacatatatatgtgcatatgtcttcacacaagcatgtgcagatagatacaggctaagttctctagttaaaaattctttcaaaatgttatctttactttcttctctattttgatgttcttactctcttaatgtttacattcccttaaggtatgtatggttaccctaagaagaaataaaccaaatgtgacatttaccagcactctaaataatgaaacaacaacaaactactctgatatagaagaaatatttttttcacttggaaatcacatgaaatcaggtccaaattcaatctctgctatctctcaaaagtgtgaacttgagtaagattttaaaacactcagtgagtttcaggttttttctgcaagatggcattataatatcaaacttattgggtggcataaaaaaactaagcattggataatagtagtttccttccacttaatccttttatttcttactgacaccaactgttatttggctgcttaacaacggcacaattttctttgtacatatggatgaatcaagtcattaattactctccatcagcagtgcagaatgttggctttgtttaatttcgttcagaaacagtcactgggaagaagctaagtgggctacctcggcattgacttaatgccaaaattcaggagcattaagacacttagaagtaagtaacagataactcaactgactgaatgcactgtggaagtgatacaggtactaaataaattaattactgggctgctggagaactggtgtcatcggatcattgttggaattgatgtagagaatacacaaagcattttctcttcttcagatgttcatactccaaaaagtgctaacaaaaacatgaattagctccacaattgcaggcttcaatgagccacgaaaaaacaaatgtgtaacctcacatagagaaagaaattctctaaaaatctggtcattcaaatgctcaacaagtataaattcactagctcttaggcactggtggctgttaagaggaatgcaaaaataaggaagtataagatgaagggcagtctgaccaacatggcaaaaccccatctctactaaaaatacaaaaattagcttggtgtggtggttcacatctgtaatcccagctacttgggaggctgaagcacaagaattgcttgaacccaggaggcagaggttgcagtgagctgagattgtgccactgtactccagcctggataacagagtgagactctgtctaaaaaaataaaaataaataaaaaagatgaatggtgtcaatgtatttgaagcatagtaaagacaaataattgaccagttctgggcacttgctggcccctgggacctgtggacaggaaagtgtcgataaagccttgagctgtgctgaggtcctgtggccagcactggcacccagggcctggattggggtatgtgatcagggcagcgtagccatgaggggatcagctgagggcagaggtggcccattcaggcccgagtgagtgtgaggggcttgcttgtcctgaaagccaagaggaaactgcctcagtttcctacggctgcagtaccaaagtaacataaactgggtgcttcataacagcagaaatataatgttctcggcattctggaggcttgaagtctgaagtgaggatgctggcaggaccatgctctttctgagcactccacaggaggatctttccttttccctgctggcttctgctggttgccagtaatcctcagcactctggcttacagatgcatcacttcaatttctacctcctgtcattacctggtgttctcctctgtgtgtccaggtgtccagacctccatcttcttataaggatattagtcatattgggttagggatatctcatcctaacttgattacatctgcaaagcctctatttccaattaaggtcacgcacggtttcccgagattaggacttcaacatgtcgttctaggggacacaatttggcccataactggaactaaacggtgggttgagtgtccccttctcctgcaactgtgagagtatcgggagtctccaaagcaaagcggctcatgccaggtgcctccagagggactggaggcctggctttgccaccagctctgcgtgcttctcctcacccatgcctgggatttccaccttggaaatatccaaaaataagactgcatcccagtgaaccagcagaaaaaacgtaccctaataaaagcccacttacggaggctttcagccacagggaggaaattttgacagaacaatcatatagcggggctggtgaggtgaaactgctggaagtcagtagtgagtattctacatcacatgtggagtttcattaagcagtaagttctataaataatatggaaaccaattttctaaagtaaaatgtcagtttgaaatgcagtcattctcaacaattaaacgtaaatgtaacacagtatttaaatagatatttggacacagacaacatgtatcagataccaaaataaggggtaaacctagatacaaattttttgtttgttttttgttttgagatgggactctcactctgtcacccagggtggagtgcagtggcgcgatcttggctcactgcagccttcgcctccagggttcaagagattctcatgcttcagccccctgaatagttgggaccacaggtgtgcaccaccaaacacaactaatttttgtattttttagtagagatggggtttcaccatattggtcaggctgatctcaaactcctgacctcaagtgatccacctgccttggcctcccaaagtgctgggattacaggcgtgagtcaccgtgcccagtactagatgcaaaattttaatgaaatcggtagcttgacttacagtagtcattagtgatgctagcaatgactccagttcttctcctcggttcatgggagggtcgggatctcctactccagtagcgtgaagagtggtcaggtgacattctctgagcaatggcatgtgggtagggctgttgtacatcacaggatgctctaagagccagcctatgatttgctatgctcacaattcctctgggagatgccttcacatgtcttcaagagtgtggagactatttgaggtgacaaaggggtctcagattctgacttggagctgtaaaaactaaaggttgcaaaagataggttgcctgcatgctgcctgagggcctgaaggagaagtgtctgtgctgggttcagtctgtaccccacatctgtggggaaaggaatgtgaatttctggagatcaagagagtgattcaggggtaagatgcacctgggccggcccctgcagagagaagatgagttacagaaggagcaagtggcaggctaggagacagcatgccacttgagcaagggggccgtggataaaagtttctcaaagatgttggtcacagcactaggagcaggggagtgttggtgttgggcgcccagcttacagtagtgccaactgttctggaactttactgctcctctcaactctctggtgtctcttcttccctatccccccacctcagtcctcaatggctctaacatacacacacacacacatacatatctctggagggttctttaacccccttcccgggtaacaacaacaacaacaaaagtcccttctataagacaccttatctgtcaggcggctaaggcgggcagctcaattgcggccaggaatttgagaccagcctggtcaacatggtgaaaccccatctctacaaaatacaaaaattagccagatggggcagtgagtgcctgtaatcccagctacttgggaggaaggggcaggagaattgcttgaacccgggaggcggaggttgcaatgagctgagatcctgtcactgcacttcagcctgggcaacagagggagatgccgtttacaaaaaaaaaaaaagacaaacaaacaaacaaaaaacaccttatctggagggagtgtaaatagctgtaactttgaatgaaatcagaagctttgactatgataagggaataggaatgataagtatcaaattgagacaatgctttaaaaattaaagtaactatttatttattacccaaatattcaaaatagtgaacaatctatgtggcataggcaccaatcaacaatagacaccagcaatgtcagagatggccctggaggccacctgctgtgccttttagttgctgaaacttaagagagttgggagactcagagcataagggagaatctggatggcctgtccctgagggcggatgggggctgtgtacacaaggcacgtggctactgtccacccagacagaagtgcattgctatttcaacaactcaagtggttgttacagcctgagtagcaggggccaaggaaggagtttctcccactgaatacatttcaaagaatagtgggaactgaagaaaattgctttgtgatcacatcccatgaatcttgactgcttgatgtactagttgtgtatattaacaatgtaagctgcttagagagggtttgatatgcattcatataacatactcaattttcctgagaatgaagttatagaaactcggagttgaaactggcccctaaatcaagccttgggcaagtgttctgcgaagggagagggagaatcttccgagtggaggaaatgaaggtgaaggatgagtgggtgtgcagattcacacatttgtggtttttccccaactgcacacatctgaggattagctgtgctgttcaattgttactgctgatactggttataccaaacgatttacacaaaactaatgagaatgtgtaactttggtaatgatatgagatgtacaatattaggttggaatactgaggttatgaatttatgtgctgaatttgttatataattactttaaattgtttaaaaatttagtttaaattactttaaaaaattcagtagccaaaaagaaaaaaaatttcagtagccaataaatgtgctacatccatccttacccacaagccaagaaaaaaacgacagagtattatcatgatatttcaagtctttcggggaggttatatttcattgttttattaatgttttattgtctgtctgtgtgtgtgtgtgtttgctgttgtcgttttcaaataaaataattttgttatggtccaagggctactataccaatacaagcaaaagatctcattttggttttcacagttttaattacttatattaaggtattgaaaatgtttgtgtttacattattctcttgcctgaaacatatatattttttgaacaggatctcactctgttgcccagggtggagtgcaatggtgtgatctcagctcactgcaacctctgactcctgggatcaagtgatccttccacctcagcctcccaaaaagctggaactataggcgtgcaccaccaggcctggctttttgtgtttttttttgcttgtttgctagtttgtttgtttgtttgtttttgtagagatggggtttcactatgttgtccaggctcgtcttgaattctggggctcaagtgatcctcccacctcagtctcccaaagtgctgggattataggtgtgagccactacacctggcctcagaattttttttttttttaatcctggagcttgggctcagttgtgaataaactctaagaatgaataaacataaaagaaacacaattgtctaggtatctaaaattttcatttgctgtgaatttcaatcaaaacacaatttatttttcttgctaattatgaggtcatataaataaatgtttttcattgttgtctaaaaatatcattcctttatttcaaggttatttacagatataaatgtctataagagaaacctacgcttttgtctcactagcatttcattgtccctgtatttgaaagcaaattaattgatcaactgtttcaaatgaatagtgaattcatggtagaattcaacatcgttaggctttgacaataagcacatgtggctgcattatcctagccaaaaaccacattgttattggctgctctgctgtccaacaagatttggatcagtctttcatcaagacgctagttgtctcctacctaacatgaacgcttagcaggtggtcctataaacactggcagccatctgaggatcacaggggtggaggcaggggttgcatatcatggaataatgacagcagggggcacactcaaaaagccccccatccatgttgtcccctcaaaagaagtaagataaattaattacttgtattcatttctctgttacttgaagatgaaagaatcctgatttcttttttagatgtcccttatttctatatgaaattttataatttattgctcagttacctataatctgtctccttaactagaatgtaatctcattcagagtgaagatagtttctatctcgttgactgctgtactcacagtatctactgccgtggctggcacacagacattcagtaaatgttgactgttcataagaaagctttccctggatcttctagataaaatgtcagtccaaggaattcatcatctgtacagttgctagacactgtgatctgttacagtttcattccaagaagttctgaaaaagccccactatttttttagaattagaataaactgagtgcaagaaaagcccttttcggacttagcaagggctggcttgtctatactgaactgttcacattcctcacctttctcagatcttggcttcaatggctctcaacttatgtatcattcgtgtaaaatgggttgcttctgacatttctctaccatgtagtaaatcccactgctgagatttccttgggctgccccacatgagaaacctggatctgtcaaaggtgctattggtaggttctatcataaaatctatagaagctgttattccatatgtcaccataaaaattcccaggactcgagtgttgagctgtatgtcacaccatgcaacagaacagtcgtgccttcagtgagggtgccaatgggtaaaacttaagtctcttaaaaatgactcacattgatgaaggatgttgtattgtcaattatccatgcacccaatatcttaggacaggggaagtgaggccagcagatcctcagctttgtcccactaatactcagtgcacagcacgcttctttgcaggtcctcatctagctttaagacaaaacaggggtttctggaaagagactgatttcaatcttaaaaatgcgtcccaggctgggcgtggtggctcatgcctgtaatcccagcactttgggaggccgaggcgggtggatcacgaggtcaggagatcgagaccatcctggctaacatggtgaaaccccgtccctactaaaaatgcaaaaattagttgggcgtggtggcgcatgcttgtaatctcagctactcaggaggctgaggcaggagaatcacttgaacccgggaggcggaggttacagtgagccgagattgcgccattgcactccagcttgggcaacaacagcgaaactccatctcaaaaaaaaaaaaaaaaaaaaaaaaatgtgttccaaagcagccattttatgggtagtttccttcacagttttggacaaaaaatatgttcaatcatttatcaattatagagtgaatttggtttaggcaacctcttttggtctatcaaatcataacatgcaaatgtagaaattttaaaaattataaatttatattttatataaaaattaaccatatgtcacaaccaaaggtatatatataaaatacgaatataaaaattaaccagagacactgtttttcatgtgtgtattgttggtgtatgtggtatctgtcccgtaacgtctttgtcaataatttttcccatataatcacctatttaaaaagttatatttaacataagagttgaaagcttctaggcatcacattaccccaacattaccctattgtaccagagctctacctagaaccaagagctctaaaaccaaaccaaccacaatataattcttcacctccaactatgtgtgcccaaagacacaaatgtgcaactgtcctaggaatagtaagtaatacagatcaagcatcctcatccaaaaatccaaaatctgaaatgctctaaaatttgaaatgatgttcaaaggaaatgctccttggagcattttggatttctggatttgcaatgctccactggtaagtatagtgtcaatattccaaaatccaaatctgaaatctgaaacacttctggtaccaagcatttcggataaatgatactcaacctggattacaataacatcagactaaaataataaattctaatgacacattatttattatgaaaggcagtttcaatattactatttacataattcgcacgttcaagatctgtttgctaaatcctataacatgcctatttttaatttgagagaagaaattgactaagacattcatactgaacaacacatgcgaataacacattctttcattaaaaaacaataaatgtagtggcatatgcttctacttagcatcatcctttacttgtttatacccaaataaacgcagctggcaaccatggaattccaaagtccactttcctctgctgttttccccaacagtggtacatacgttgcatggtgattacaagaatcatccaaggcataattttaaattttaaggctaaacatgcttcaggaagaaactttctgaaaatggattagcttactttaataatgtcacatgtctgcacagataagaattactacagccctctaggctaaatatctatataggtggataggttgcaaagtcaggctactgaacatcaataaaaacggcaaatgcaattcaatatttgctttttttatcctggtttttcaactattatggtggatatagttttatcacaagtccctgaattaacgaagagactatattggtaaacagaaatgaatttcatgctccacaaagagaaaatgagttgctatggaaaatataccccaaagtaagaataaaattttataatttctcttaaaagtatcgaaaaaataatttttaaaaatgtgactggaaacactgatgtccagagaagagctaaacaggtgtaaaagtgctccttcctcccaggaaattcactttctgcagctcagctcctttaaaacacacagagctctctggatttcagggatgaataccattacctcacaatgtttgatttataattttttaaaaatcaaaatacagatagatgctgagtgacactaagattgttcaagattcttttcattctaactattcattctaggtagcctgttcacaaacaggcattctaatctttacccagtaatttataaaatatcggctggtttcagaaagaaaaaaaatactctggcatagaatctaaacttttgatgtagttcatttaaaattgaagaattttgaaatttgaaatacacataatatgtgcgcacatttgtctgaagtacataggtttgcgatctatcctaatatatgtatatgacactgatcaattgtagggtgaagaaaaactttctccagaaaaatcttacatcacactcatcagtgttactcattgatggctacagcgatgagttcctgttgtgtttgaagtactgtatatttgcctctcagactttcttggctaccctgacaagcaagtggcatcatctccatgtcacacttcagggaactaatgtgactcaccaaagaccacagagctagaaggtggcaaaggcagctgaagtttaaaaccaagtctgagggacttcaaaacctgtcccctctgcaagatgcctctctcctaaaacacagcttctaattcttaacagacacaactattctattaataaatcattagcaccatcccatcaaatgtgagatggtggcactagctaatatcagaggttgacttctaagactaaaatccatgttatcaacaatgacatatgcggctgcagcactagaagctgtcccaatgtttggcaaaacacatcagctcttcttggagccagggtattttaaggaagtgaaactatgtcatttccagagttattgagacctactcaaaatttcttttccattttcccaaaataatccaatcactggaaattttttcattgcttattgtaaatcataggaggtttcagccgaaatatcagggactcagagtatcagactatcagaaagcccagaatcattaatgacaaatcagaagagatttctatctgaaagtctccattttggtttgggtatattcaaagaacatataacctagtattatcagccatgatatattccccaaaaagaaaacccttattcaaaacacattcagaattgcatttgtgtaatttaggcattttgctttgcatcagataaagatgtaacatgaatctcttttttttttgtgcatgtacacttgtactcttccttttaaaacttattctattagtttctccaggatttatactactcttcttgaaaatcatttattacacgataatataactttttaatagaaatgggattgttttatgaagatttgaaactcattctcttatggagtgttacagaaatacaaatttattctatcaacattaacactttataggatttcacatatttaaaaagaacaacaggcagaattaactgttcttagcagcaaattatttactttgttcctctccacatgagttttcctatattttctataacacttcttagatgacattaggactctacttataaaaacataatagggccaacgcggtggctcacgcctgtagccccagcacttggagaggccgaggcgggcgagttacgaggtctagagattgagaccatcctggccaacatggtgaaaccccatctctactaaaaatataaaatttagctgggcgtggtggtgtgtgcctgtagtcccagctactagggaggttgaggcaggagaatcgcttgaacccgggaggcagaggttgcagtgagccgaaatcacatcaccgcacttcggcctggtgacagagcgagactccgtctaataaaaaaaaaataagtaaataataaaaaattaaattcattaacataatatttgtatatgttcaaaaacaattttattcatacaaatcaagtatttgtttagagggattttttgattggtctgcactatgcactcacaagacataatgtaataggatattcataacagaaagttttttttcctttttttttttgttgagacagagtcttgctctgttgcccaggctgcagtgcagtggcacgatctcagctcactgcaatctccacctcctggtttcaagcaagtctctctcatgcctcagccttccaagtatctgggactacaggaacgcaccaccatgcccagctaattttttgtattttagtagagatgggggcttcactatgttgcccaggctggtctcgaattcctgagctcaggcaatccgcccatctcagcctcccaaagtgctaggattacaggtgtgagccaccgcgcctggctttttttttttctttccagaagagaaatcatttggattctttcttaaaaatcagaaaaaaaaattctgagtattagaaaatggaatgctggcaaataatttaactcttttttttttttgcagtgtaacattgaagttggaagtacttaacttgttcaagttctaaggctggacgggacagataggaacttctgggtttttggttgttcctttgggttggcttaggaagaatgcatagcactagatcctttaaaccattcaaagactgatagtaaaaaacgccaagcagaggactgaaaaatggaactgaagtaggtatagaaagctactttattcagatggagagtagtaagagaaaatcagtatcattttccatttgtgtttccaaggtgatgcatagtgcaaagaacgatacttattttgccaagtacagtgaaaatactattctctgggccccaacttaatgtttttctaattcacgtaatcgcatggtgcatacactatgatcatgatctttccattgtgggtggaaataatttgttcaaaccatgtgtatctgtgtgaagcacaaacagagctggtgcatccctacactcatcatgggactgatattgactttatttccaagtatacaccagaaatttcagattaaatggcaagacatgaccttttatgtctcttttcagaggcagcttagaaagctctctgggagtcaattcctcctccttcctcccttctgcctcttagttgttgaggtgttggtttaaaatcaatcattttgtcattcaagaagtgatcatacctccctaacaggagagaaaagaagtggatgaaaaaagatgacattttactttagataatggcaactaatgcttataaaagaaggtttttttttctgctcagaattaaagtaatcatatataataagagcattttgttttccatccgaaccaagaatgcttgctcaggcgcctttgagaaataacacaagattacttatgctgttagattctgtcagcataaatcttccccaatggtgatgggaatgcatttatttatttatttattttggaaaaatgacatctttcatatgccatgagaaggactactgctaaattaacacaattaaaggcagcagaacttttatccgtttctacaaattaatatgtgcactgcagagcatgcacaagactgcacattcaatttcagtctttcctcacttgggccaatatctacatattaccatcacttatttatcatctaatcgaatcatctgggcaatagattgttatgggttctgctacttcttgatgtgccccaagggaagaagggttgtgtttggttttcctccctgcgtcaaggagacaatgttggttttacccacatataatttttttttcttttgcctttttgatgctttttttttttttggtgtgcaaaagagggcataatggagacggaatagagaatcattttaaaaacaccctctagttttacctgatatttcatttacagcaacacgagttaggtgtagatttctagtttcacatctgtgtccagacacaggtgctgtgacccagcagagaactacgtcacgtgagttgaggggatacttcctgtgtcctcagttgcacacatctatatttcaaccccaatacctgggaaggttgcctcaaacatgttctgttattcaacatttctattataaattatattttccaaaagtacatccagggtgaaggtatgggaactatcaccttatttggtgcttttgttcttggctttaaaaaagggaaaaattattaaaaagacgatttaaaaattattaaaagataaagctttcaatatattgtatttttccattgaatgctgctaagtataatttattatagtggagttttaatatgaaggcactacttatttttctacataaagtggcaaatttaagattgccacattgtttatagaggtaagatctaaatgaaaatctagaactctggtcttcatattctgaagacagtgatttttatcaccagcagcataattgtactaaattgtctaaacttgttcattttgtaaactgtaaaataacaacaataataaaattaaaaacttgtaatagccacttaattggtgtcaagcactctcttaagcactttccgtatattgtctcatttaattttcaccttatttatttcttttttataacaaatctttgagagtgaggtgaggtggctcacgtctgtaatccttgcactttgagaggctgaagtgggaagactgcttgagtccaggagtttaagaccagcctgggcaacatagtgagaccctgtctctacacaattttttttttaagttgccaggcatggtggtgcatgcctgtagtcccagctactcagagtctgagggaggaggattgcttgagcccaggtaatctcaaaacttggaattttctagaagtagaattgctatatatatcagcagcatgatagagaaacaatattaattattaaatttccatgacaattgacttcagtcatcacattaaccaatgacatcctctgtaatattatactatttttaagacaataagaaatgacctcatttgttcaatgtcacagagccagtgagtggcagggccaggactctccactccatagttggcattttttctacttcatcttcttaagaaatctgtatactccttgattcttcattgtcagaaatggagataaattatcagtagtgcctcagggttgtgctggattattctccaaaggcaggcatttttggccatctctctatccatgcacaggacacttgtgtaggatccagcagagcagatttctgccatcatcatgggtgacttcaagatccaacaacatggcccatcagttctttgcctgcctctaactcattccatgacagctgttgactgcagtccatgggctctcctctgattgcaaccccttctattcctaactcctttagaaactcaacaaccgtgatggctgatgagacgcaagacactgaaatcttacttgcatgggctctgaagtctgacccttggacttcagctcagttccagctctgccacttactagctgagcatgttttcatgacatgataacagtatggatctaaagatgttattaagattaaatgagttcatatgtgaaagagccaaaacagtctctagcatttaggtactgcctaagaaatagcatcttactaagtcgttcaactcctcacctctccaatctctctagtcctcaccaaggggtctactcaggaaacaccctaagttttgcttacttaaaagctaaaatatatgactgtggatatgtaagaggaagacaggcccaggggaacatgctgggcaacttccatgacagttgtttcataaacagctgaggtatggattgggtagtttatacacacaggatgggagtgaagtccacaccagctgatggattcagagtaagtgtgccatgagaaaactaggaacatggcaatcctggaaaacagaagcaggaatgagttgtccaaagtccatttctacataagcctcatggctgggcaactttcaggtggacccttgaggatgtgaaatctcctaatggacgctttagtgcctgagcagacacagttgggaaggcagaggtggaaaccaggaagagcgcaaatcctgcatctctagtccattatttttctgaatgagaccaggagaacagaagttctacaagatgttaatagttgcaccctattggtccttcagttctacttccctcttggagattcataaggtacaactttagcagaggttatggtgccggtctaactcaaagatttgttttttgttttattttttgagacaaggtttcactgttgcccaggctggagtgcagtggtgcaatcatggctcactgcagcctggagtccctgggttgaagcaatagagcaatagatcctcctgcctcaacctctggaatagctgggactgtaggcacgcaccaccaccacgactgtttcttttctttttttttttttggtagagatggcattttgccatgttccccaccctggtcttgaacttctgggctcaggcaattttcccacctcagcctcccaaagtgttgtgattataggcacgagccaccatgcctggcccttaaggacttcttataaggaatcaataaataaggtgaaaattaaacgagacaatacacagaaagtgcttagcagagtgcttgacaccaatttagtggctattacaagtttttgttattattgttgttatattaccatttacagagttaaagagtttaaaggatttagtacaacaatgctgtcgatgatgaaaatcattctatctttagaataggaagaccagagttctagattttcatttagatcttacttctgtaaacaatgtggcagtctgaaatttgccactttatgtagaaaaataagtagagtcttcatattaaaaccccaccataggagactctactcggaagaattcagtggaaaggtattgttttgtcttattaaatacaatatattgaaagataaagataattgcttgttctgcccctttttaaagccaagaacaaaagcaccatgtatggggacagacttaaagttgcctgacttttcatgctgctaagtacgtctgttctaagaatatgaaatgttttcaggtagttcttttatttgtctaccaggcaaggaaactatttcttccctatataccatgaattccaaaaacctgcagaaggacattttaaaatatactttatttaaaacattaaaactaatgacaataaaacttttgtatatttctacatggaaggagttgtgggtacacttggcagagtgcatttagtcaagattgtatttaatattttatgattctataagtacatttaggtcaatgtcaagttgtaagtacctacaaatgaattcagaacctacattcttcacatgtctcacgaacttgtggtcaatgtactgatagtgtctgatggttaatgcctcaagtaatctgattaaatgactattcttatattgcaaaattcatacttagaattttgatgaagctgaacctttctcacacaataatatttgcctatcatgttgacaagatcacccgactgggatggaaagagttcttaaacccctttggtaacagatttaatggtcctgtcttcaatacatgatgcccgcaacaatccagtctacaaatacactcagagggagcctccaacataggtgagactgtggcaatatgtgcccacaaccccaccaaaatcttacatctcacccagatcacgggactactgacagaattcaaactatctcaggaaaaatttatccaagaacaaagagaaaacagatgccctatgagagaaagccaatgggagaaatgcaaagaataaagcttggaattaacatctaatttctggcatccattgtaattgtccagccaatttccaaatttgatgtatatctgaataacctaaatgttgagacactagatgtcactcatattttaatactgagaagtgtgtttagatatgagaaccaaaaatatgcaccttctactgttctctactatgctgtccccactaactgagtgatgctctacccccattgggggcccctgtgcatttctctgcttgtttttggatctggcccttgctcaggctattctagtctgggtgatctccttccagtaccccagggcctttgcgcttgccaccctactactttgcctcagatacagctcactccctttcttctccctggagtgctctgctcaaatatcactttaccttagctgactactgcacgttaaattgcactctggccaggaactgtggctcatgcctgtaatctcagcactttgggaggctgaggtgggcggatcatgaggtcaagaaatcaagaccatactgaccaacatggcgaaaccagtctctactaaaaatacaaaaattagctgaatgtggtggcatgcgtctgtaatcccagctacttgggaggctgaggcaagagaagtgctttaactcaggaggtggaggttgcagtgagccgagatcatgccactgcattctggcgacagagcgagactctggaaaaaaaaaaaaattgcactcctcccttcactttccccgctagtcctgcttcattgttctttctggttctttattttctttctcccctcactagatgtaaccctcatgaaggcagggactttgtttttttttaaactggtgaatcttgagcctctaaaagtttgtggaacaaatgccctgaataaacgtgcgctgaagggacagaaaaacatagataagtaaggcactgtcccatctcatgtgcatgtggaactggaaatgcatgcagaatgccgagagaacacagtacaactcggtccaaacccagccctttcacgggaacctgagagtaaatgtaactgcaaacccagaaaatgaaaattaggccaggtaggactatttgcactaagatgcaaagacacctgggaaattgcttgtgaacttcttgatattagaaataggcatgtctcaaactagtagagtttcatgaactcggtggtagacctttgcttggggtggtctaacgccagagaccccagctgaagcttgctgtggatgtgtcacctctgtcccttcaatgtggttgacctatgcatcttgagcatgttgtagctcgaatgagcaagaatcataaactcatggactttccaagctggaatggattttaggcatcattcagccaacacttcttgtaaacaaagaaacaaaagagtgacatttaagaaaatttcaaatgtttgcactcacgttcagggaaactactatccaataagtaattcaagattagaaagaaataaggattgagacattgattctcagagatactgtgcagcatctaggtaaattctgggtaaagcttaaaaatctacacaagaataaagttttgttcatattgctgtttcactattagattttaggtggtactggataacctaggttatattgagtcttagggtctgttctgaactgacaaaataccatcgaggaggaaaacaagggtaggaggtgatcaacaccccaggtggtgaccagatcacagtggtttcagggcctccacagagggttcctgagatttggtctcagtgctcacaaatgaatgtccccaccccactataatccagggatatctaaacacacttctgtgggttttgccccagcataccaagcagagggcataattcctggccaagagcaaagactgaggatcagaaaggtcatagttccaattttatggtctaggttctttattctttgatttcgatgacctcgtgggcataggacttgggggagctgccctctctcctataggcctggcctggctttctggccttcactgtggatttgacctattataaagcactgatacacccctgacatatcacatctcccctcaacttgagccctggccttggtctcttcagcctccctgcctttgctgttgtggcagcagagaggagtccgatagtgtcattagtggcctcaggctttagtcttagatattatgggtatgtctatagaagaaagattctattttttttttccccagagtaacagaagaatatagaaacaggttacgatgaggagaaagcatcaacaagaaatctaaagctaaaaagcacaaaaaataaaaagtaaatttaaaaatataaatggaaaataaattccattagttggggtgctcgaaagtaacttacttttatgttatgtgctgttgttgttgtttttaataatttttaataatttaataaataccaactaagaaatgagctatcactctaatctatgtgtttcttaacacttgtctgcagcaaataaaccaccaccaagaaaagaaacaagaaaaaaaggacaacaaaatgacctatcagaagctgcctcggcctcatgtggacttggcacggatgccctcctgtcccacatctgcagactcctcagtcttcatatcaaatgtggaccatccatcaatcttagtcctgcatttaaaactcattaaaaagctgtttgccattcccttcaaagattaatcacacaagtccaacataatagctttgacaatttaaatcctcccattttagcatttcatttcaagtgtactgtaattatattgcttctggctaacttagaaaatatattcaaataataagcctacttttggtatatgatacactcttaacactattcctcatattcattatgtagaaaacttgaaaatgtacttagaagcgtcttcagaggtaagagtaatctattaatccatccatccatctatctcttaaattgcacagttatataaatatgcaaatgttcatccagggagacaattattctttgagtgctttggatttttgtacaataacttccttatttttagtttgtgtttgtattgaaaaatttacaccaaacatctcagccatttgctgtctcaggtttataagcacatacatgatggtaatgtgcttctcagttatgtggtcattaaccaggacccttgtttgtggctactgtatcctagtacattagagaggaaaatgctgcctgccataatattccatgcccccatgttctggcttactccttgccaagagtgcggtatgataaattcaaagcacaaactctttcgcatggatatacagatacctgagagagcacacatggggtgcttcattaaaaaaaaaaaaactttaaggattctttatatcatgacgcaaaaagcaaacctactcactcaatttcttatatgcttttaatgacttaaaaaagcactgggcaatggaggcaggagtctatgaactacaggtccagctaagctttgacagctgaggaaagcgtcccttacaaaaaaaaaaaaagatttcatttgaaaatgagaaagacaagtttctggtttcttttttcattctcaagtgattagtgaggcagggtatagagatagccaaaataagtgttagtttcaaagcaattttaattgattattttgtgttaactcctgttaattgatgatgaactagaaccaaaatttacttccaagagttcatctaagtgatatgaataaaaattaaattctaagtaggtagtagattttgttcattcattcatctgatatttattgagttcctacaagtgcctagtcctctttaggcattgaggaattcagcagtgagccaaacagacaaaaattcttccatttgtagttgggtgagacagataaacaaaataaataagtacataattctgtagcatgttagaaggtgatgaaaaataaaatagggacagaaagtgtcaagggttcagctctgcataaagtactgtgaggggtttcactgagaggtactaaggcatggtgatcactgggaggagagagtcctgggcagaagaaagggagcctgcaatgttctccagggagaaagtgcccaaggttagagcacctgcagccctggggtgccaggcagcaggacttagacttagtgggggcaacagggctccagacaactagggcacagtcattgttagagcttccatatttactctgagtatcctcagaggccttgggaagtagggagtgaagtgatcagacttgtgtttttaattattatgctgatacttatgctgagaacactctgctggagaactgaagccagcaggctagccatggggcagagatatacaggtgagagcatggtggaccagggaggagagaaggtggtgagaagtggttgatcctggctagattatgaaaatgtgggtgacaagattggctattgggtagaatatggggtttaagagataaaaggagttaagcttggctcctgtattttattaactaaaattctaggaatataccatgatggatttgatgtgggttgttcaatcattgtgatcatatttattttaaattcataacaacatggaagaggaaatgccttcctcagttattgtgagtatgggctgagatcccaaaatgatctctccttgcaggctttgtttcttctagcttaaaggatatttctctcttcttcccctccccctagcccaagattttctctttagacttcctaatcttcataactgatttttgtcttttggaaggcacattttccttaaacagtcatgttaagaataactaagatattttacatttttgcagtaattgttcacattgttaataatctgcataacttttcctattatgcagtattaaaatattttccaaaaagccccagtcttttactatgcatacctatccagagttttccttgaaatagcacagaatatccaaaactgaactttttttttttttttgcattctcttcctgtccctattgttattttcagaagttgagcacagttaatgggttgctcagaattattgtggatagagatgcaatgtttgtgcaactggtaaaaatttgaaacataataaatgcagcaactgtacacctaggcattctcacatgatcgatgtcccaattttgaaatgctagaattaggcagacaaacaaaagtgacacagctttcctgtcacctttatttttgccagactgactcgaatgaagatcactattgactgtggtgttcctgatgggtaattatttcagcaccagctactgaaaaactcatagctataattcaacatctgtttccccttccaaaagggcacagaccctgaaaatattaaaaccatcatggtgactaaataatcttagcaagttggtccagtttagactctccaaatatactggcagaaagatgaccaactccatctggagtttgctattatttctaggaatttccttgtaagattgagggtgttgcagtaatttacttggcttcctcatggcagaatgcagttgaagacaacagtcaacttccatctccaaggtgcagatggccagttctggataacctttcctaatggcagactttatggaaacagaccagtggtacaactaaaaacgaacttcatgaaatttttattttctaacttaaaaaaacaaaactacttattgaagaggtggggttttcactctgtcacccagactggagtacagtagtatgatcatagctcactgcaaccttggactcaagcaatcctcccacctcagcctcctaagtagctgggactacaggcacataccaccatgcctggctaatttttaaattctttgtagagacgggggcttgctatgttgcccaagctagtcctgaactcctagcctcaagtgatcctcctgccttggcctcccaaaggacataaaaccatttttaaatacaaaagactgttccattgtacagtcattcacctaaaaggtagctcatttggaacaactactaatctccgctgagttctaagccttttttcagtatcccaggacttatctgtcaatttactactaagttccttctgatccattttctttgaaaaaaatgaaaaatatactagtgtcctccaaattctataatcaaatccacactagactatgatatataacagaagaacatctaaaaactgaattgttaatgaaaaactagtaacaagaaaatgtaatctcttctctcttccttttttaaaaagttaaatattgtcaggaatcctcttccattctatttaaagtactttaagaaatcatgtctctaaaaatgacaattaaaaaattatcaacaggagggcatacctcatgagatattgacaagatgacatttccaaggcccacattagtgggggttctgtaggaccatcagtgggaaagtcactgacgccatctcctgccttttatcttcccctcccccaccaaatcagttccttttgacaaactcattttctgggaaaacgatgttctatgtgatggtcagcttcccacacatgcgtgtactgcagcaacaacatcacacaggtgcaattcaccatgaaagaaatctgtgctatgccaatcttcccaggataacaagtattgtgcagtgtgggctggacacagcaaaagacctgagccaggacagctcaggacatggaaatgcccaggctcaaaggtggtattgctcacaagggcactcactgaagccatacaaaaagctccttcctaagccagtgcaccaggctggtgcccataccatcatctgtaagagatccatagcgtggccctggatgtgcagaaaagtgtgtgcagagccagcacaggctgtgcactggagcaaggcccctggggagctcagctctcccaggctggcctgcccgaccccaggcgtgatgggcaagctccgctatgtgcttgcttcatctctcctcttccacttcctgcatggtttctgctcgtcctggttgtatctggaatgggttggccctgagatgctctctgtccttctcccacactggggcaaggctttgcttatgtcggaggctgagaaggtccctgccatttttgagggtcctggagatgaacggttatactccaagtgcctgttgtttacatcgggcctgattctacacagaatattcaatgagtgtcaagaatttgtggcatgttctggcctttgaaatataattttgtttgttttctctagggttgtgtgtgtgagtcaaaataagtacgtagacttaacaaataaatatgcttttactagattttaaaagaaaagggtgacttgggcttctgggggtaacattttacttagagaaattttaatgttatttaagcagcagttttgggtatttattcccagtgataagggtggaagtccaaaaatgaatcctaaccacttagctgtgttgtgcaaccaacattcctgtttttcttctacatgcagaactatttaaaacttccagtaaatgtctttcactaacacatacatagtactttagggggcataaagataaatacaagtaactttctgcctttaaatttagttcaaaaaataataggataaaaaatatgcattagcttttagagatatcgtactgttcttcctcttctgactaaaagtgtttgtaaatttcttcttcttcttttgctaatttcaactggggagttaaacgtgtgtctgtgtgaagtcccaatctgcaagtgttactgtaatctacatcaaaaactgcacaggcagaagggcaaatgagactcaagtacaaataacagaaaaactgtattagtgcagaatttccagggagacaatcctaagattaaggcagtccctagcccatagaatagggaatcatagaaacttaagagctagtaacccttggtatcgcagtccttaagcatcagtcagtccttacagccaatggagatgaaagcaagaggacaaaagtgacttttaaaaatttgtaatcataaaacagaaaatcattaagatgaataataaactcatttaggacacttttggttttaaaaatgtcagctatgggatactttttaatcaaagcaaacttactcaggataaaaattcagggaaccatttcaagagttccatggtatcagccccaggaagccacagcccatccacagagcagcaggttcccagatctctctgtagatacagtatccaatatgtctgtcaggtcctgaaacgtccaaagggtgctcggacaatactgcagatactcaaaccctcctgcgaggctttaacgttaatgactacacttattcatttctagaaattctattttttcctttttcaaattttagagtctcttattttctcttttcattcagtttcctctagtaacttcaattcctgggttgctaatcactctgttgaaattgctgattattcatggtgactcactcatcttgtcacctggaatttttaaatctgagctcattttcagtggggtgttctctcctttcttgtgggattcttgcacgatcaactttgtggaagggcctgaagagaagagtcacatttgcctgtgctgtggccctaagggtttctacataagtctccagtttaaatttttcagcttgggtttctgcaggtcatatataactctctacgctcaagcaggtctggagtttgggtttctcatgggagaacgttttcctcacccaagacccctgagatggcaagttgctctgctgatctcaaacaagtgttcagggagtttctagctctttccacagctgaggctgccctttgcctccagtctttgtgcagggatgccatgccagcttcctctacatccagcctaaggatgtaaaacaaagttgcatgtgatttctccatgttgggtgcctgcagatttccttttttccccctggaaatcagatatgtattaatatttttgcatgcagattgtaatttattcctgacctctgaagagtttctggtgtgcaggaagaagatcagccaatatcagttcagtcacccacattgttgggagttgcataaatcgatatgcaagagagtacacgaaatccacaatcctttaaagttactttcagcacagaaaggcataacactgctgcatttattggagcaccagggccctgaaacctggatgcacgttcagagaagtcagtccgtcagctgacactgcttgttacaaacagatgatgatcacatcacaggggctgacaaagaaaggttctaagtattatctgctcaagaccagaacacccagagccacacagttaaggccagcttctcagaaaattctccacccttgtagatgcccactcaacactttctcaacataatttatttttcttaggtaattttaaatattcaagtatttttccttccttttataaaccttttccaatgctccattttcatcttgaaagccatcatcgtagatttttccctcctctcaccacctggcccaatttaatcagggattaagtgctattaattccactgctttgcaccttgcttcctgcctccatttagtctcactgctgttgccttcgttcaagcccttgaccatgcctcctctggcctggtctgagtcttcacagggctaccggagtgcatatcctatgactcaataccttagaggctccaaatataattgaaatatgttctaaattgcttagtacagcatataataattctatgctatccaactccactctcgccccctccttctttataaaacacaccctattatcaggatagttttagatttatagaaaaattgagaacataggccaggcacggtggctcacacctgtaatcctagcactttgggaggccgagacaggcggatcacctgaggtcaggagttcgagaccaggctgactaacatggagaaacctcatctccattaaaatacaaaattagctgggcatggtggtgcatgcctgtaatcccagctactcgggagactgaggcaggaggattgcttgaacttgggaggcggagatttggtgagccgagattgtgccattgcactccagcctgggtaacaagaatgaaactctgtcttaaaaaaaagaaaaattgagaagatagtacagagagttttgattgtcccatacctagttgatcccctattataaacatcttatattaatacggctcatttgtcacaattattcagtcaagaatatgatcactgactaaagtccttggtttatttagatttccttcatttgtaatctaatgtcctttttctgtcccacgaccccctccaggattccacattgcatttattcatcctgcctccttaagctctccttggctatgacagttcctcaagctttccttattttcaatgaccctgacggttttgatgagtactggtcaaatgttttgtagaatgtcccactattaggattcatctgagatttttctcgtgatctcatgattaaactgggatgataggatttggagaggaagaccacagaagtgaaatcacattttcatcacaatatgggcagagctgggtttcaaccaagatgtctaagtatctaagtccttttactttagctattatttgatacaaagtatatatatatatatatatatatatattttttttttttttttagatggagtctctctctgtcgctgaggctggagtgcagtggcgcgatctctgctcactgcaaccaccgcctcccaggttcaaaccattctcctgcttcagcctcctgagtagcggggactacaggcgcccaccaacatgcccagctaattttttgtatttttagtagagacggggtttcacagtgttagccaggatggtctcgatctcctgacctcatgatccacctgccttggcctcccaaagtgctgggattacaggcctgagccactgcacctggcccaaagtctataattttaatgcattttctatcttttaatgtagtttttaattttcttgtcatacatacagattttatagtctaaaaaatgaatgtaaacacatttgaatgcttttctgctgaattaaaaaagtttcttcgattgtttctttaacaaagagaatcaaggactgattatactcagaatacactgtttcctacttttaaaaaaatcacagtgatgttatcaacgtttctaaataacaaattctagtaatagaataatggttttgataaaggtatttaccaacagtaaatgctaaacaaattgagagcacttgatactaattagtgtgtcctctctatctgacaggcatagcttgactatgacttttaaaagctcaggaagttcattctataaaggccaaaaagtggtccattaaatatcatgacaaaatcattctgagaaaaattgatacagaagcttgctgtccttgtcaaggcttaattccacataggagttaccaatgccaaaaagaataaatatcactctccagaagaataggaattaggtttaatatggcattaattcccaaagtgaagccaaaaagaatttgaatttggtacttttaaaatattactattgttaaagtgaataaatctatgtctggcttcattttgtttttaacacaagctggcaaaacttcttgtcttccctgttaccatatatagaacaattcagcctttattttcagaagcgaacactgtcatattcaaaggtatcctaaacaacagtttaatttttgcctttaaaattaagtatttaagaagcaagtggtgtcatcgtgtgagcctttcattttatataagtacttgttcatcctattttttaaattttttgggggggatcctcacttaatccttataactgttggacaactttacacttaatagaatctcaactgttgtaaattcttcttttatagccaatgagataaccacgaatatctttcaataaaattatctcaagccttgacgtagctttgtataacattcctggcatcagtaccatataggtctaactattttatcattttacttttataattgaaataattttacttctcattaatcttatcctaaaatattttcgtttcacccattgatttttccagacaaacttcagattaattttcttcccagattcttgcctcatccctaattaattgcctttaaatttgaattttattaaatctatgagtgtatttggggagaacttgcatcttttcaatatttagtatttacgtttttgtctttttactcaattctgtaagtttctgcatttcaatcttaggaaattttggttggaataacttctaagaatgttatagtcttgagatctttgcactgttaagttcttagaacttatatgattaaactttgtaaaaggttcctatgcattgttagaactgatattgatttttatattgcagtatattttctaatttgaaaaagatgtataatatgacggtgttagactgaccagcaattatatgacatcaagttcagcacagagagtgaaatggataaaaccaaaatgtttcctagtctcgtctaagaggagagacctttactgattaaatttgagcagtgtcacctgtcttcaaaaaattatttgggcatggtggcgcatgcctgtggtcctagttcaggagtctgaggcaagagaatcgcttgaacctggagtaggaggttgcagtgagccgagatcgtaccaccacactccagcctgggtgacagagcaaaactctgcctcaaaaaagaaagaaagaaagaaaaaattagtgacaggtccaaatattctgtagaaaatacaaatcggattggcagtcctcaagagctaaactaatggaattcattttacagccagaagctttgactataagacttaaggagaatggatgacaattacattctcaaagatttaatggcacccaactgaagaaggccaactgggagtggggagagagaaaatgcaaaatcagtaagatacaagtgtggctggcagtatcttctagcccactcctggcattgaatgttcatgttgtttattataagtattaggctttccctaggccaaataataaagacataagcaacacatggcatataagggcaaccagttggctgagaaggggatactgagtgagaagagaatatttaaatttagatgcggcagcatcatcaatggtttccagagcagtaaaaaaggcctaagcaggttttctctcactggtgctgagaagtcactgaaacactcaacatacactcaacaactacaggaaatggctccatcgctattcccagaaaagatgttcatatcaaggaaaagttaaaaacccattctagagcacactgagagaaggacacagcaggtgtgtccacaggcagagcactgcaaacagaccaatgggtgagccaggaactgaggagaaagttagcaaggcaccactggagatactaggatagaatctgagaccagagcatccaagaagagcttctgtaggatccctgctattacaatggggatgccaggcctaatctgcagtgtgcaaagaagctgtgtggatcttagttaaacaaatgtgatgaatttgaacactccccttcctctcaaatatttttaagcttccgcatcatcttgtgaccatgtttggctgggatttaaagaactctttctttcttaataagcagtaatcgagagcctgaagcatggcatctatgctgtttggaagagagggtccacaaaaggagcacctgtatatgatcattatttggtttaaactgacatttgtctggagaaaaaccttcaacccttttaaccacagatttttgcattccacccatgtgagattagcaaaaagaatacaatatgatttatatgattaaaacttcaattaattatgtagataacaatttatttatttaacaatttaactgattgttcggcccacctccatgcactggacaaggcactgtgacaccttctcccaactctcccaaaatgagcaaggcttagcaaagatcttctaatctagttaggggcaacagaaaagcacttaaatattgtaatagaaaaataatgtttttgttataacagtaagaatcaaggtttaaaaatgatattatgagagcccagagaaaagagacaataatagctaattggagaagagagaagtaaacaagcacataagagaagatactttgactctggggcagctttcaaaaggcagaaggaactggtgttttctttaagggtaaatcagaaagagggcaccaagacagaagacaccaacgcaggtgtctccttagggatagcaacagccatggttttccttgaagcaccattgtgaatactggataggaaaaaaatttatttttcgcttatgaaatacttttgaaaaccatgatagctgaaatttctcaagcttgatgtcattatatgcattcaaactgagccccttagattgagtcccattagcacagcaagttgcctcttgctattttgcagcacttgtcgtcattattaccaattaccttccatggtacccttgaggttctaagcacccgccctatgtacacctgcccttcattggttcactgtgctagagccatacttctgtgacatgtcatggccacccgttttcacatctgctctgcaaagctgaggtgtaatcagcagaactgtgctgcctctgcagagataattttctgaactactaatcagacttctcaagaaagtccttttagctagaggttataagtcaagtgtgtctcaggtattaccgccattctcttcatactgcaggcaagtcaatttgactcacaagctttatttcacattcatagcctgtgagctacactgaatattggcagaaagtgagagaaattagaattgatgatggttgtatttggccagcaagatcgaggggctaaatgacttgtcaaagcttggtcaagtagccaggttgctaggaatttaattcaggattttggatactcaaggagcagtaagtaattaattttttctcccttttattcaccaaactccctaaaagtgaacaattaatggcataagagttcaacatttcttgtatgccattttgaatcagtttgggttcaatagcatttattatgtacctaatttgagtgtgcaaaacacttcattagactcttgctctcaaggaatttagggaaatcacacatataaaggatgaactctaatcaagacaaaaggaatatccaaacttggatgtgctgattgcccagtgttagtgaagtgaatggtaaacttgagacacagaagtcaagttggttttatatcagggtgcagttctcaaagagagtcagctgatgtgagaatgcagagactggcacaatgaaacctttatatgccactttttatatttaaatatagggtgactttagatattttatgtcctatattcacataaagaaatgaaatagaagacttcatgttggtaaacctggatggactcttaccagatgattctggggactaatttactagttttgttttgtttgtttgtttgtttttctttttgagactggatctcattcggtaacccaggctggaatatgtggccccatcatggctcactgcagccttgacctccccaggctgaggtgatccttctaccttagcctcctgagcagctgggactacaggtgtgcaccaccatgcccggctaatttttctatttttttttttttttttgtagagatgggatttcaccatgttgcccaggctggtctggaactccttgactcaagttatccgcccacctcggcatcccaaagtgctgggattacaggtatgaaccactgcacccagccgggactaattaactcggaaaacccacttaagaacttgtaactctatgagtagacttacattattaatgacttttcagaacctccgagtgtctttaaattcccactgtaccattctgtgttcacctgtaattaccaatgagggttattacttggacaatttactaggtgccaggcaacatgctatgtgagttatatgcacgatttcactcaaacttctcagtaacaatgcaagataggtattattattcacatttttagatgaggaaatggaggtccagatggcttaggaaaattttcagtgattctatggccaggtggaggcaaaagtaaacacaaacctggctgattcatatcacctttacatataaaaaactccatacactcacacgcctaacaatcttccccatacaatcagcttcctacaagtttctcttgcagtaataataatatctatttgctattcagtatggaaatatgcccagagaaaattatttctggatagagcaagaaacatatactaaatgttcatgattattattagaatgaaattaatatacagcccaaaacacttaaaaatgtaaagtgctatataagtgcaaagtattttaacactccttacaaaaaataatacttgacagcggcatactgttgaaatcatggttgtgggattagagtgatttttcacttcctatttccctccaatttatttgtaatattgcacagaaagggagtaggtctctgttatctttgaattatttgccagaagtaaaacacctccctttttatacaaagatcccactttaacataaaaaactggggattcacagttaagaacacttgacaaagaaaataataggctctcagtcacatttttctgagttaactggaataggctgaatgtcaagaagaatgagactgtgttgattgtctattttgtggattcagttccattgctttacgggcaggtcttttatagcccactgttttattagcaggtcatgatttatcccacaattatcacggcaattaactcccatgaactattcattattaactctcaattttacatggcctattcttagaaaagcaactttttttgttttgtttttgtttttttaacaaccatatgatggtagtgttagacacagcagacatatacctgttagggagactcaacccaaggaaaaatgtttatgaatacacatcacctattttttttttttggtggtgttgtttttgttttgttttgttttgtttaagatctaggatcttaatctgttgcccaggttgaagtagagtggcttgatcatggctcactgtaatctcaaactcctgggctcaagtgatcctcccacctcagctgcctgagtagctggaactacaagttcacaccacaacacctggctaatttttaaattgttttttgtagacacagggtttcactatgttgcccagactggtctcaaactcctgggatgaagcaatcctcctgactcggcctccaaaggctctgcggtgtctgacaacacactcggcccaccttgcccatcttgaccctaccacaaaactactctttccaaatgtgtccctttgctatggttacaataatctatgagggattccttttcatgaggtgatggcatccatgtttccttagaaaagttgggtggtaaagaagagaatgttgttatgaatagcggaccaatggaaatgatctcctgtactgcgtatctgatttttagggatttaagatcaagcaagcaaataaatatggctgatgtcaaacagtgagaagttgttggaagtcatccagctttgggtggtagagtttaacctcaaattcactcagccaaaaacaacaacgacatgacttggtaaaaattctttgttgttaagcagtctactggaattatttttcattatctactaatactagactctcactctacacttcttctctcatatatatgcatggatggatataagtatgtgtgtgtgcatattttttcttctattctatgggagacagcaattcgttaaaaaatttctcccactttatcaatttgtatccattttttcatgggcccactgcttttgctgtgcttgggggacctatacatttgatatctgtttttccaaagcagtttttgtaatacagctgattgaatgtaaaaatcctgtagtttacccatggctcccaaattgctcatgtcccttgcactttcataaactactttcatttcctgcatgaaatctgtgaaatctggcagtgtggctcttagaagatgggaattgctggagtggtggcttttcagccttttaagcaccgtgtcttcaaagcactttgtcaaaacacatcataccagccacatctgttcatttatttgaaccagagaaaacagcttttcttttaagatcttcttcaatcatgcatattgctgcttaactatttcccaaaggtagatgccattgtccccttggcagcctgaacttatcagtgacctataataattatgcattttatttcagtcttgtgaaatttgccctggtctttgagtattctaggtctggaaagcaatgttagtcatcaatgcaattaattttaaacttggaaaggcttcacccaatctggtaaacttaaatctgaatataaagaaattcatcaattattagatttaaggttaagagacgtcagacggccactgtacattccatgtttacttcacttaaaatttcactgttgtcagaacaaatttaacaatagcaacatttagaaactactagaaagggttctattatattaaacaccagagaggaaaacataatttaacttaaaaaaaattaggtttggggtacatgtgcaggtttcttatataggttcacttgtgtcatgggggtttgctgttcagattattttgttacccaagtactaagacctgtacctattacttatttttcctgatcctctacctcctccaacccttcaccctcaggaatgtcctactgtctgttttttcccctcttcgtgtccatgtgttctcatcattcagctcccacttataaatgagaacatgtggtaattggttttctattcttgcgttagtttgttaaggacgatggtctacagctccatccatgttctggcacaggatatgatcttgttcttttttatggctgtgtacaattccatggtatatatgtaccacattttatttatccaatgtacctttgatgggcatttaggtagataacatgtctttgctattgtgaatagtgctgcaatgaacatacacatgcatgtatctttatgatagaacaatttatattcctttggttatacacctagtaataagattgctgcgtccaatggtagttctatttttagctctttgatgaattgccacactgctttccacaatggctgaactagtttacacttccaccaacagtgtataaacattcccatttctatgaaacctgaccagcatctgctattttttgatttcttaatcatagccactctgactggtgtgagatgatatctcactggggttttgatttgcatttctctaatgatcagtgatactgagctttttttttttcataagatagttggctgtatgtatgtcttcttttgaaaagtgtccatgtcctttgcccactttttaatgttttttcttataagttggtttaagttcttataaattggttaagttccttatagatgttgaatattggatctttgtaagatgcatagtttgcaaatattttcccccactctgtaggttatctctttactctgctgatagtttcttttgctgtgcagaagctcttaagtttaattagatcccatttgccaatttttgcttttgttgtgattgcttttggagtcttcatcatgaaatctttgccagttcctatgtccagaatggtattgcctatgttgtcttccaggatttttatagcttggggttttacatttaagtatttaatccatctcgagttgatttttgcgtgtggtgtaaggaaggggtccagattcaatcttctgcatatggctagccagttattccagcaccaattactgaacaaggagtcccttacccaatgattgtttttgtcagctttcatgtttgaacttttaattcaccaatgccacttggagcagccttggttaatcacttcttcatgattgaaggtttccagcagtaaaacacagactgcactaactgtatatctcctgtgtgatcattttaagtagcttattacggaactttcttctcccacatgctgctcccatgatgtaagttaggtgcttaaagaagaacacagataactcccttcaaactcccagtgtattcttttctaacgcgattcagtaatagctctctgttctgatgaaattactttgacatgtttctgttacctaactccccccaccaaacatgcttgttctatgatttgaaaatacatatatgtgtgtgtgtgtgtgtgtgtgtgtgtgtaagtgcatataattagaggttataatagagtttttctttctgtagaaaaagagttgcacagagacctaggcaggtaagttcagtgtctagaaggcaggtaggaaaaagcgttgatgtcaggtgagctgcacatgctggcaaaacctgcaggatgtagaaaggcagggaaccatcttgtgttgtttctttccaaatgttactatggaaaatgagtgtagagggtagtcacccaagagtgccctgccaagccctgctggagcttgggatgaaaggggaaatgggctcctatatacactcatcgaagcacatgacgatattttgaattaactggaaaaagttaaaaaagaaaaaagctctacaatcaaaaagcatgattatataaagccccacatagtccaagctctccaaatgtcatcatcaacactcataaacccattggcaggggactcacagccaattgtaagtgacataataacaaaaaggtgcacaataacgtgggatcagaaaacaaacacatggatgcctgtctttattgaaaaatttgataccttgctcctcatggattgttttcctgaattttgatttttataaatattccctaaaaatatgacttgatggactacaattttggttcccccataagtcttgcaccttcaacaagtttctcaccaatctcaccctaatcctggctctatcagccagcattttaaaaatagtaacaataaaataaaagagaactcagcctgggcaacatggcgaaatctgtctctacaaaaaattagccgggtgtggtggcgcaggcctatagtgccagctacttggaaggctgagatgggaggatcacttgagcccagaaggtcaaggttgcagtgagccaaggtcatgccactgcactgcagcttgggaaacagaatgagaccctggagagagggagagggagggagagacggagagagagagaaagagaaagagacagagagacagacagacagaaagagagagacagagagagagagagaacctaaaaggaattatctgggtgcctcacacacaaaggaaggttgagtattatttatttgtaatagtcatatttgtgtgaactgggttgggaaaaaaaaattgattcctgtctgtaggtgaaaaacagaaagagttagaaagccagtggcccagagagtccaaaatcagacataggaattgccaacacggacagcctgtgcaggccccagaaggccccatttgagaagtttttaattacgccatttctttcttaattcctttgcacaatcttttgcaaagaacagcacacagccttgggtttggaggaaggtacctgattttctgctactgcctctctgagttttaggtccacgcctttgtaccagttcaaaaggtattctagagtctaactttctcccatcattgaagtcggactcatatgaacttgattatgccgtggacactatggcactgacctcaataccgcaggaattggtgttttgcagtttcccagggtccttcctaagcacactgctattcatggcatctttctggcagctccccagtctggaaggtttacatccctgataaatgatgtctctatggataggaatctggatagtgaggtctcctggtgaaatgccctccaccacctacacatacaaaatgaatgcaaatattctgaactcttccccagaaatattcaggattcagtgaatagaggtcttcctgaatgcattagtatattcattcactgaacaaagaatgactgagtgccctttatatgctgacactgttctaggtgctgggaatgaagtagtgaataaaaacatcaagaatcgccattctcaaggcgctaacattccagtgaggaagcggccagcaagcagactcctgagaaggacacacggcacctcagagagcagcgtgctagagaggagaacaagcgggaagggcattagagatggctggaaggagggggatgtggttttaaattggttggtggtaaaacactgtctccctgagaagcagacatttgaacaaagacttgaaggaggtgagggagtgagtcaagaaccaggagactgttgtagcaaatgagaagtccgtgatgctggaacttgactggaagattcagtatcagcaaggagaccaaggggctggtgcagaaccagggtgcaaagcagggagtgaggggagagagcagggggcaaggagttggtgtgagagggtcagcaggcaaaggggaggagaaagaagacggcatgtgtggagccttttggggcactgagaggaactgggcttttctctgagattgaaaaccacagagaggcactggtcagagcaataaaatggctttggttttcattgatagcctccttctggctgctattgaggtgattttgctcctatcaaaggcagaagtggatggaggacagtagtggtggcagcagaagaggcagaaggaattggctgaattctgggtaatttttgatgtcagagccaatggggtggatgaattgaatacacatgtgataacaggtgacagtcaaagataatacctgattttcacagttgagcacctggaagcatggaattaccatttcctgacctgggaaaggccactcaggaagagtggattggcggtgggtgaggttgaaagttcactcttggctatgaggagtgtgacctgtcagtgagacttcagagcagccatgtgagttgggtgctgtatagggctgtgcagttcaaaggagaattgtgggctacacatctggccgttggcaaagaacagatgacatttaaagttagagggtacccaactggaagacctgtttcacattgttgcccagtgttttaaaagaagagatttgtgtacctttcaatggagcatatgaccttcaattgtctacactggccgccaatctcttttgctttattcctatcctacttcactcacttgcgaagcctgcagtcttgtaagctcctcgagagtaaggatcgtgaacttcatggttcagtgatgcatgtttttggcaccgagtctgttctcagaaagtgacaaacgaatgaatgatttctggtacagaaaatgcaatgtgctcaacaaagtttaaaggaaactgaactcccaggagtatactggaagatcagagagtgaagcaggaaacagactcagaagaaagaaatgtaccagaataatccttttactgccaggcagtcccaagggatggaaaactggattgggatagacaagtgactcaggtgggagaaactgagaatgacaactgaaagcaggcatagtcatagatattagaatcagtcccagtcaacaatagaggcacaaatttgttggcatcacaagctggctccccccagccaggctgtccagttgcacaccctcaaggttctcgtagcccaactaatggccactccacattgcacaaatgaatgaagtgctttcatgtgtccttaactatgactgagctgttctccaggacctgtctgcccatttcagcccatctcactcaatattcaacgatctagccgagtgttctgctcctgtaacaccacctccccatcaccacgtcatacaaatggagagtctgtccatcatgttacgcatagttgaatttggctccgaatctgccctctggcttccacagcactatgacaatgcctaggtaagagttagtaaatgtgggttgtatttgatgtcacacaggatctaaacacagagaactcacaaataagaaagggtcattctgtcacataaatgtgctgcatccaaatatccctttagagacagcacatttctgtactaagaaaaacacatttactaagagaagtgtttatatttatgcactaagaaaggcagcatctatatcctgtgggaagcagtccatgcatcccaaatatgccccccatatatacccaagacaactatatcttcgcagtttacaattaaaatgctacatactacattctgttattttaactattctagaatataaagaatggcagaaagtttccatatgcatcatatggagcaagtatgaactcattaaaccatcaaattatcctatttatgaaaagaaaagtagattctatgtaaaatagcaaacaagacagaacagtatacaaaaagagctcaattgtgctggaggaatgctcatagagttggcaatcttgaccgtcatgaagggtagccatcctgccctggtgggcctgccaaaactttctaaaagaggtgaaagtatgaaaaatgtaaaaccttcactatttatttatacctgattatatcatatacttaggaaagtccaaataatcaatagaaaaaatctttaagaacaaattttcaaaaaaaaatgtggtttcatggcaggttacataatatacactgaaaatcaatagcttttctgtaaactggcaaaaaatgtacaacatcattgggggaaaattcatggtagcatcaaatattataatatgcctagcatagacataacagaaaaggtgaaagaaacataaaaacaaaatgtagaattgttattggaagagtgaaaacaaaaggaaaacattttatgcaatcagtagaaaaaatcatgtttctagatgggaggacacagtattttttaaatgccacttcttaacagagagagagagacagagactgtgtgtgtgtgtgtgtgtgtgtgtgtgtgcgcgcgcgcgcgtgcgcgcgcacattcaatgcaatccccccaaaatatctattttaattctttttctacttgaaaattcaagtctaaattaatctcaaagagaacctgaagaaaaccagttttgaaaaagaaaatcagctatcaaaatatactctaaaataaatagcctgttagtagtacagatataaacaaatatatcaatggaacacaaggtgtccagataaactcataggcatatgagagcttagtaaaaaccattatttggtaaacaataatatttaacaaatgataagtgttaggaaaattatgtaccattttggaaaatataggtctctgtctcatatgatattgtacacttttccaggaagatcaacatatttgggagaaacaaactccaaacaagaaaatgaatagctatgaaaataggcaaaacgtataaggccattatttttattttataatctttcattgagaaaggtctttctaaacaagatgcaaaaggcaaaagttataaagaagagtaaatcaaattaaaatttcactaagtccaaagatatcataaacaacttaaaatacaaaaggagactgaacaatttttgcaaagtatataatgaagagttgataaaacatggtataagaagccctataaataaagaagaaaaaaacacccaatttgtaaaaatggccaaaatatataagcaggcaactcactaaaggagaattaatacaaactgctcagggatggaaggaagcagcctccatttcagaatgaccaggggaatgcacattgccaggaggatgagataatatccagtagatcacactgggtgataaaatccagtagatcatactaggtgataatatccagtagatcacactaggtgataatatccagtagatcacactgggtgataatatccagtagatcacactaggtgataatatccagtagaccacactaggtgataatatccagtagatcgcactaggtgataatatccagtgctaatctgcatggggcctggatgggatattctcaccttcaatacttgttcaagttggcagaaactttcagaaaatcaatttgccagtaactattgaaatggaaagtgtgtatagtctttttttccccccaaattccttatccaggaaggaagaaagaaggtaggaagaaagaaggaagaaacaaaaggaggacattggagggagagacaggggaaggagggaatccaggaggaatgaaggaagagcagagaagatgggggagaaacagagggaggaagaaggggaaaaaggagagactgagaaaaaagcaattcaaaaatcatcactagtttatcttcagctataatgaacctaaatagtcttcatagtattattacaatgtgaagctatctttcttcatctctaatttgggaaaattttaccaaagctgtatatgaaataatttaaaattgataatataaataatcacctgctgagtagttatgttttatcctacttgttgctgctaaatagtttgaaatatagtttatatcacacatagtttatttgaaagcagcttacatatatagtaataactcaaagctttggacatatgtaaaatgtctattttaatgtctgtacttatgttcacataaaatgatgttttacctggttcactgaaaatacaaaatgagttacatattttttattcacttttgtattggtaagattttattttctttgctgaaacctccatgaccaaacactgactagaagatataaatgatcatgtcaaaactaattataaatagatcaactacggcaaaacttttatttaaattccttcttactatatactcttagcttctacttaataaaatgcaaaacttactaaaatgcatgttctgtaccttagcatcttcttaataatacatacacacagcgacacaaagtggttatttaaacaatgcaaattcttagtgtcatgttttcctttatgtccagaaatataccaccatttttactataatttaaaaatctgaccatatggtcattttttttaacactaccctagtagagtttacgtcttgtaggggcaaaaaatattaaactccaaatcacatgaacagcccagtgataaactgataaccacactgcaggaaatgcacagagatccatgaaggtggcatgtggcagtcagagtgcagtgtgctcgtcagagtgcacagttacatttccagggacgctgtgagtctttaaatgcagacaccattaaaaattaaattatatatgcttataattaaatcatttatattaaaaataagataatattttacattttactatgatttatgcttttgaggttatttttatcttttgtgtctatggtgaaaatactataatgtgttactttgcctctctttccaactccatgcgacctcatgttggtagcttgaaattgaccacggtgggagtatttagaccacagatacgagcaaagactacggatcagtggcttttttttggtcccagagatctagttgttaaacattttccagcataccattgcaggaggctgtatatcaggcagcagtgatctaacctgcagatagcaggtatgtcaagatgaacagggaagatgcagcagatgctgctagttgtccacccacactcattctcagccactgttttgtttgtggtggcaatttgcgcagctacaaaacctcatatcccagcctactgcctatgatctaaacatctgattatctaagaaaatactgacttacttagtatttcttaaactgcagtagatttcccattatttatatactttcaaaaactgcctttaaatttttttataacgtttatagttagcctactttaaagtaataatatccaagaatttatggatcagatgtattatgaatggtttttaaatacccactaaaatatataattgttgagccaggggccaccagcaaccatgtcatgtcatatctcgctacttctcttgccccaccatttgagaaaacactatctaaatacagttatttctctttcacatcgtagataaagaacatgttaaccaaaaatgcggttccattacatattttacgtttttgaaattgctattggcttcatctttttcatgtaaaagtttagcttcttaagcagcttaagtaaaaacatgattgaaaagaatattttaaaattaccaaccgaattggtaattttggtatatggttttgtgaattataacacatatatagattcatgtaactagtagcataatcaaaagagagaagagttcaactacctaaaaatttccctcatgcaatcctttagatactccctgacaataccccaaaccctagcaatctactgatctattggcccactttccatcgttatgactgtccttggagaatgccatactaataaattgtcatatactacataatcttttccaaatgtcttttgtcacccagcataatgtctgtgagattccttgaagctgttgtgtacatcaatagtttgtccttttacattgctgagtagtattccagaacatggacgtgtagagtttaagcattcactagttgaggttattcaggttatttccagttttggactatcacaaataaagctagtataaatacttgtgtgcagttttggtgtagacacaagttttcatttctctagggttaatacctagaagttggattctgggtcacagggtacgtatatatttatatgaaattgccaaactgttttccacagtctatagtattttgcattccctcgagccatgtataagaattctacttgctccacattctctccagaacctagtactgttctgtttttaatgttagccattgtggtaagtatatagtgatctctttgggttttcatttgcatttccccagtggttaacgatattcaacatccatgtgcttagttggcatccttataccctctgagattcagtgtctattcaagtccttccattttaaaccacagacctacttctttttgaccatattcctagataaaatttgtaagacataaaaatatggctggattccacagtttgctagaatttcttatgctgtcaactcattttcctttcaaaaattcaataaatgtggtctgaaaattattgaataggaaaaaacgtgactagaggagctttccaacacacagttttacttccttggagtgaaatgaaagcagaatgggttgggagatgcattctcctggataatgtaaccaaatatgcagagaagttaatgagtaataacacagtgattggcacacagctgcccacataacatttacattcacataaatttattctccatacttgctcactgaggtgtcctaattcacatatgattgttattcattttatttataaattttaaactagatttattattaggaaagcatttatcatcggcaggcacagctgtgtgtgaaacaacaacttagtgaatgcgtacgagatcgtctctgtgaatttcgttctaggtttattgtatttattccaatgcctcttgcctccacctgctctagtaatggctcagattcatattctagaaagagctttgcagccagcccagtaccactcctggcccacactgacagagggtaaaatccctgatgtgaattcatgctgataggtggtgcaggcaaacctcatgataaaacaaaatctcagcttctcctgagggtctaactttctgtctttattgttttaacatttggctttttgctacacagagcttgcaaccacatttttaagaactctagtcaatgagattttttaaaattttcatatgaaaataatgatgcacatatttttgaagccagacgctgacagtcaaagaatcagaaaatggttcacaattgtgttttacatactaaaaacgtaatatattttgagatgtatgctgagctttatcctttatgtgctatttataaaacataatgttaaaataaaattaaaatgtagtttccatagctataatttatttcatagcttttgaatgtacatgtatatttatcacacatttactctttggcaaatatggactaggcactaaataaaagatctaaaagatccacaaaatgccagatgtaatgagaactactcaaatatctcaagacatttcatttgaattttatattcaaattattgtgcctgactacaaatgttggccttaagaaataaaaagaacatgcacctgtacagacacatgcacacatgcacacacacacacagaaacacactatgttttaattttggtttttcattgcttagataatttgcttagataatctgacattcttaaatattaatgaatatatcaggattgaccacagttcatcaaaagccttcaataatctatagtacacttaatctctcgaatgagataaaatatgccaaataattgctcatcaaaataaaagtagaaggcctggcatggtggctcacccctgtaatcccaacactttgggaggctgaggtgggaggatcacttgagctcaggaggttgaggctacagcgagacgtgattacaccaccacagtctagcctgggtcacagagcgagaccttgtctcaaaaaataaaattaaaaataagaaacaaataaaatcacgagactgtttaggaggggaactgtaaccataatgaagaaatcaaaaagcaagatgaatgtgaccatctgcttccagatttttgaaaacacagagtgaagttttagaaagtctgaagctttcaaaattccatgataccagttatgacacggattattattaccacctagtatcctcctgtcctggttccagttgctttcccagtgacacatgtccacctccaggctcttttggggaggtctccataaatgatggggttttggatgtttactgggatggcccatttattttaagaagtgcaaacagttcaatagtgcttcctgggtaccacacacaaagtgctttcttttttcccatgtgttatctcattcattcctctcatccacaccaacaggtaggtacaattcttaataacatccccattttatggaagagtaactcatgtgtcgagaagttaaataatttattccaggtcccagcactaggaaggggcacagctgggattccaactactggcagtctggctccagagtttaaaatcttaaccacaccctgcctcctgggaagacagaaatgcaaagcatctcatatgcagagcagaatgtcaaattctacttctacaaaggaagttctggaatgactgaaggctcatgcccgtcatcacagttacatctcctctttgcaagtgctctggttcctcgtcggtgagtgggacccttgaagcagttattgatgccaaaatggagagatgctaaagtgacaattctgatttctaagccgatacccagtcaatgttttaaataacatatctgagacagaatccagtgactcagcaactacttgtgacgcattctagttaccattgaacatttggttctctctagacactctgctgtcaccaaaacactgctatttcatgcatgaaaacttgcttagcaaaaatattttcaagaagaacaaggacagctgtcaaaaatcatcataacctttgcaatgtgaggaatcataaaataagctgctgggtaatctttaagtgtgagatggaaaccgggtatagcattcaaagctcataacacagaatactaccatgcacacatcccatatatcgctttatgatgctaataaaccacacatgcccatgtggcttcacatgaactctgcaactaccacatggggcaggtaaacggcattttactggcatgttctcagaaaaggtgaaagcatcaatccatggttactaccctgtggcaaaggagcttttagactggtgttctcgcctttacaagatgggcaacattcttcatttcctgaggtcttggtacaaggaaggttttattcagtagtgtgggtgtgtcttacacatatttgtaagtatgtgtaaatatcagaaaatgcatatgtagatatctgtacatatgtctatatatatgctttctgtgaatgattttcagatatctctttctacagctatatatatatatatgtgtgtgtgtgtgtgtgtgtgtgtgtgtgtatgtgtgtgtatctggactttctttctcctatcagccattattccatgaaaaagaaataaactaatacaaagtagtaaaataaaaatttctatacatattaatagatatatatgtctttattcactaagaggtatatacatctttcattaataaagatatatctatcattaataaaaatatatattcattaatagatatatacatacctatatttattcatgcaattattcttcatataaatattaagaaaaggctgggtgtggtggctcacgcctgtaatcccagcactttgggatgctgaggggggcagatcacttgaggctaggagagtaagaccagtatggccaacatggtgaaaccctgtctctacttaaaaatataaaaattagctaggtagggttgtgggtgcctgtaatcccagatactcaggaggctgaggcaggagaattgcttgaacctgggaagcagagggaagattgcgccactacactccagcctggatgacagagctgcagtgagcccagatcctgccattacactccagcctggatgacggagtgagactctgtctcaaaataataataattaatctttattcatgcaattattcttacagttactgggtttgaatgagtgacctgcgtggccttgcttaaatgaccacatcctggcctgctgtgtggaaagcaaagggatggggttatgattccatcagtacctttcagtctcacctgcagaatccctgagtttgaagtatcagggataactgaggtacaggggaaggaactgagatttcaggctccacaacttcaagcaactaaaactccatctcttgggttaaactataggctgcacttctgagaaagatttcactaggaattctccatcaaagcagacgtgaaaatcattgatcctgaaggttccttagagctgtacacttctgccattgaattaacttaatgtttaaatgtattgtaatcttataaagaatggcatcttcttatctatacatctgagcaaaacacaggcaagcacaatattgctgctttaatggagatatataattgtctagaagtcatgtatactgggctgtgatttatatatcaatgcaagactttgacaagagctgttgccttacttagattaatttcagttaactgtcagtattcaacaatagttaaattccatttagcagaattctaaccttcagacttcattttatcagaatcaatgaggttttacttaatgtcttatttcagaagaacatgctattcttttaagaaaaattttgaatttggctttactaattttctctataaatattttcaacataggaaaaaggttaaggatatgaaaaaggttaatttactattattgtagatttgtagctgcgataatttagaattatgaattaatacttaaatataaatttttagatacataacattaaagagatgtcaaatattacagtgattaaaaaatctttttattaaaaaatggtagaatttgggtataaggaaaattattgaaatttaaaggactgttaattcaatatctatccctcaggaacaaaagatctatttgtggtccttaagaatatagtagttgtcacaatatcctgattagcaggtttctaaaccttctagtgaataattattacaatcactgctaatagattaagtgaacttcatgaacattttctcactctgatgatagggtcaatttgttgttatataatcaaacatgatggaccttttggtctcacatggccaaagagaaggacaattttcattggtaacagacattttttgaagttcagttttaccaatcacttactgcattcgtctgtttacaaaaaaagagagtgatttctcatctgtaaatacctattataatatggctcaagtaccaaacgtgtgtgagtggtatttgaaagaaaaaaaaatttgaaataaaataaatacaaataattttcaaagaggtgctgccaccttttggttgaactcccctgaagcattcgctcatttctgaaaatttgcaataaaaatgagaaatgcttgatgaaaggactgtgaaaatatgagaataataagcaattccattatgtcagtatttcttatttggatggctcccaatacttctgataggtttcagaaaagaataattgatatgaagtggtttttccaaatgttagtatggcagtagaaagatccacttcagaaatggagaaatgttccatgctttattgaggtcagccatattaatgctatgcctctgataccaattgagtcaataaaaaagtaatttttattgtattgaacaaaagaccacgaaagatcacttatactttctgttctcagtattccattcagactcaaatctttcatttcatcattaattatttctcatatctgtgaatatcctttcaccaatgccattctctagatataggaggggtcaactttctcctcactgcttgacttacaagttctttaaaattgctttccttcctaaggaatcaatttgccttagtgtttaaagagcagaagccccttacgaaatcattttgccacagtgtggctactttagttgtcatctgataaataattacactaagagtgtgcttcatgatttttaacaactgtatttaactgactctgacttgaaattggaagtcttttttcagtcaaatggtcacctttattaattatcgaaatatgtggaatgaatagaaagattagtaatcatttactaaatgccaaatacttcactttaaaacctcatcttgaggaatatttagtagcattgctgatatttacagtatttcttctatcccctttaaaataattatttattcaaattaataacctaaaaaccaaaaacttgcagtttccaaaatgcacctgtagcctaaaagaatcaaagctaactatgtgagccacaggctaattctaaaggactcaagtcaactgagatttaatccagtttttgtactggcgtcaaccttgaactgcccttgagtccagatacaagctgagaccatcacttccccttgagatctgcatatggggactttggactcttggcttattctgggcatcttcacattccaggaggcagtgcagggcttccatcaacgactcttctttctcttgaacttctgcattcccaccactccctctctcctgcctctggcagaacaaggcttgaagttcagctcttaagtgacttttgcaacagaaaatcaccgaagttctgactccagcagctcttgctgacatctgaggagggtgaggacacctaggcccaatttcccagctcctctctgctcccactccccccagtgacttcttcacaacccctcaacccagtggcccgaaagatgcttctcccacaagaggacctgtgtatctggcagtacctcaagtcattgctatgatgttgttataattcttctcctttcctcaccccatgctgtctcaggtcttttccatattttctcacttgatatcctttaacatgcttattctgaatcgggctacactaaatacaagtgaacacaatccccccattaccttcccttttgtctctccttacctggataaaatagcaccatgaatactctgccaagggtatttctaaagtgcattcatctattgctgttgtaaggcatgaacaaacagtagaacccattgaaagcctgtgtcttgacctcagaacagtcaggaatgagtggtttcaggtgcaccaggccagggctggaacctcactgcctgtcagcacatgctgtgcagctctgctaccattcagaactgtcacactgagaacatgtttggcttccatcctaaagatcatttaggtcatcaatgttttattgtaagatttcttcacaggactagtccaattagagctgctctttatgcacatgacgcagaaaataggggtgtccagggcagcagcactggttatattgcattccatcagaaaatgcacttggggctgtggagtccccctccaccctaaggtaggagtgtgtatgaaatattacacatgtacatggtgaagttgggaaggttctacataatcagggaggcaaagaatccctcattactgtcagtaaaaggaatttgccacaaatttggcaaattttgcatctacttgcatctattgatgcattatattcctaaagccctacactcagtcagttgttttgaattccaaattcattttcccatagaaacagtggtatatgttagttccaagttctgcttataaggttcttcaacatcaaagaacactatttggattacactagccataaagcaggactggtgacatggtgtgagagtgggactgggccccacacctgggagaagaaagagagccagcccctcctgagttcctgagttttgactgcctgatatcggcatattactgggctaggtattgtgcatccattatctcctcaaaaatttggtcatagttagggagtacagggttagtaaacagaagctcagaaaagccaggtcccttgatgaaggaagaatgaaggtctgaccaaccactagagctggggctcagactcatgtggtctgtctgtgtgtctctaaagtgagaaattcattccatttgaacagaggaagttcttcctccagggttctaatcatattgattcactcatgtgactactttttttttttaataccataccaggtatttccaatatcaatggaaacaaagatgtcacttctgagtcaataatatttgaggtctaatgtgaaaggtggatgtaatctacccacataaagaacgatgcaaatagaaattatgatgggtgctgcaggaaggagtagggagctgtgagcacagagggggctatgttagattaggtggtcatgaagaccactttgagagtggcacttcagctaagacaggaatgatatgttgacatccatgaggcaaagaatgatgtgcgggggggtgggggggggcaatatgtgcaaaggccctgaggcacaaaagaacatgaggccttttaaagtactgaaatatctgctggggatactataagggagtggagagaggagaattaatagacacaggcaaaggtgaaataagaggcttattttctagacattgacttgtgtgtgtgaatcatccacgaatctagtgtgtataagtcagaaattactcataaattgggcaagaaaaattaagaagataattatatgatgtagggaaatggttttgtgatgaactgtactatcatttagcaaatctgtactcctccccaccccactgccatggaataggctttgtgtcccactgactatggactttgccaggtaatgtgattcagccaatgggatgtgagaggatgtgacatgaggcatcagattttctagccaggcagcacatgctcctttaccctgggcccagaacaactgcacatcaaaggggcctgaaccctgtctgcaaagtagagtcaaacccagtgaatgaagtgcctgaaatcaggactccccagccaagaactggcaaattggaggtcaggcacaatgtgcatgattgtgagtgtgcaaataagtgcctggcattcaaggcccctgagttttggggtggtttgttgcccaattttactgccacaataacagactaaagaaaaattttaacattaaaactagccatcactctcccccaccccctcaaacacacatacacatatgcatttgcaaacaagcacacacacatatcaactctgcccagctcatcaccaagttcgacaaaacaacaggaaaatgatgattaggagtcagtgcagcatgggaaccttgatcatgaactctaacactactaaaagatggcttgttaggccatgaccttttaattgaatgaaaaccaggctgctaataccaatgacaccactctagacttcctcataaaacaattattcagaatattttcaatgttctgcaaaattatttcacttacaacaatgtagggtacaagcaaaacatgatggcaaaaaagaccttcattaactagctgccatatccatgagctcagttttcagcttatggatgctcccatcttttctagcagcttcccttccatacagccaataaaatgctggcagttaaagctgctgctttggcccttcgcgtatagctagataatttttatattgcaaaaatgcttcccaattcttaagggtttttttcctttacttaaaacaaattttttaaagcatatcttttaacagtgaggttttctacatagactctgggacgacaatgaaggtcatctaagagaaagaaaattgcattgatatattcggtcactgtataagtggctcaagcagtctaagatctggatgtgtgtttttttttaaatgtatttgatggcttttgaacattctcatctcctaagaatttgaacacattaaaatgcagacttcatgagatctggaatcctttcttctgtgcagggtgttttaaaaataggacaattaaatttcttgttcttagatacataggtttatagaattttccagctaaagaggcttcagaactcctgtattctactatatctcaagttttgagggaataaacacctttgaaaatctagtaaagcctatgaactacctggccagaaaaaatttcaagttaaaatatggtatatatttacagggagcaaagcctcctgaaacctatctatggataccagttcacgatcctctgaaaaatagctctgatcttgtccacattctagatgaggatcacttttcctgccctgtccatctaattctgcattgccctacaggcttagtggcagccaaaatcctgacaagaggccagacaatggcaggattaccatttgccaacttgtttctggtttatttgaagcatttcataaacatagagagattactgaactttggtatatccattaccaagctccaatatttgttaacattgtggccaccttgtttcaactatccttcgtttttggctgaagtatttttaaaaaatccaaggcatcctgccatttcattcatgaaccctgcagtgtgcatccccaaacaataagaatatgccattatcctgattaatagcaattctcatgccaattatcagaaaaccctatcacctgatttcaaattcatataaaaatttctcttgtctcaaagttttttttacagttggtttgtttaagtcagaatccaaaaaatctgtacatttaatttttaaatttatcttaaggctcttttacttaatagtaccttcctaaattctctttttattgatttgtgataaaaagaagtatttttttttcttgaagaatctcccacattctgggtttgccaattacttccctgtactttcatttagtttgttacttcatcccatgcatgccctaaaatttggcaggtagagataagtgatctttattttttgctcaatcctatttaatataaaaagggagtgagggcctgtaagaatccccttatgaagagtacgatcaatgaagggcatgtttttatgtttcaatctgaatttccctcatctctgctgtaagatgctgtttcactaattctctgataagaaacagacctttcctgtatagacaccctctatgcctgcatattatcctattctgaagagtaggtaggccgtaataaagcatattccaaatcttgccctgagacaatatgcatgggagtgtctggcacaatccctaacacatggcaagctcttaaatgttagctgaagcttaaaataaagctcatttctcactcaaaataactaaacatcagttattaaaataaataatccctttcagaattgaggtaaagaaaattctttacaacccatcataatataaatcaaaatgttctctgtattgaaatggaataagaatacctcttcctgttcactgtcatggatgatgttgacttctagccaattttgtgcttatctgatatccaaagactgataataaaaacaaactaacaacagcaccaaaaatacctaatcaaaaggcagcagacccagaatacaacttaggaaggcaaaatcagtatcttagcagggttgcatattattgttgctgaaaaatgaatattccaggtaatcatcaccatgctgtcattccacacattgaccagtttattactccaatagctacatattctaaaatacacatactgaacaccacgctgtgaagtatgcatgctaaatgtatctcagagtagattatgattttatgtgaagaacataaatagaattgatttttttgtattctctcagaatcaaaatctgctgctcagaaaatatctaaggattattattactatatagacaaaacctaatggaccctgatgtaaagattgcattagccagaacattagcatgtcagctataaatacctcttaatttgtaattaatcaaaaactgctttatagtatctcttttattgaattttcttgttgtttaactttttgtgcatctcaagcatattttaacactccttgaaaagagactactctagtggagttacttaaagaggacagggtttatctaattgttcattctcttattagatagcctgtaaaaacaatatggttacaaacacagctaatgctagaaaaataaataaaaaggcacagttgttgtcctcaacagacttacttctttgaatctctcttccacccattcctgggagccaagggggaagccccagagtttcacatgctccaagaacaagacaggagccttcaggattatctctctccagatatgatccctactcctgcgagaatgagaatgacattccagaactgtgtactcctggcaagagttcccacactttacaaatgggaagtgactactgggtctctcacctgaccagtgaccacccaagctcaacaaaagcagaagtcactgaaaccctgcatctcaacactgagaggtccttataacataaatggaaagtcagtgttagtgcaatccaattcaacaaatacttattgcaactgactgaatgtttacgttgtcgctccccaaattcatctgttgaaaccctaatcccaatgtgacagttactggaggtgggaacgctgggaggtaattaggtcatgaggatggagccctaatgaatgagattagtgccctcataagaaggggcaggaggctgggcatgtggctcacacctgtaataccagcactttgggaggccgagacgggcagatcacaaggtcgggagattgagaccatcctggctaacatggtgaaatcccggctaacatggtgaaatcctgtctctactaaaaatccaaaaaattagctgggtgtggttgcaggtgcctgtagtcccagctactcgggaggctggggcaggagaatggtgtgaacccagcagacggagcttgcagtgagccgtgattgcgctactgcactccagcctgggtgacagagcgagactccatctcaaaaaaaaaaaaaaaaaaaaaaaaaagaaggggcaggcgtgctctctttgcatgtgaggacacaacaagaaggcagctgtctataaaccaggaagagagtttaccaagaactcattcctgccagcactaatgttacacttccaacgtccagaactgtgagaaataaatgtttgttgttgaagccacccattttgtgaaaatttgctatgaagtccaagctgactaacgcatttattatgcaaccactatgtgctgtgcatttttctaggtactgactgtatagcggatgtacaaactgttacctttcttcatggaaattcaattcaaggagtgtagtgtggaaaacagaatcctatataatccttacgatttgtacctgctgatggttgctttgagttgggagataaaagactggtcaaggaatttaatatcagcacatggttgagaccattcatgtctgtgaattacttataaataaaaaatatgatacttaaataaattattaatatatgtgtatacaatgagactcttggaagacatcttccacagcagccctcaccaccaccatctatcttgagctctttgaaaataacttcctgtgatttttatccctgttcataacaatcaccacaaagaatccgggaacatttggtaccccagactatcatcctcatagggttttgcacatccccttgtctaagattttccaccctcaccaactcctgaaacccttcccctgtgacttcttggaaagatgaagaaggaagctgtcaacaccaaaagaatttattaaagaaaacactatgaaagaagggacctagaaatacatgcaaaaattaaggccaagtatacttcacactatgagaatacaattaatggaaatgtaagtacatgtacaaggatatgatttgtattcaacatcaaataggagttctaatgaaagctttcataatatccacagtcagcatatacaaattaaattgatgtgtggattattatattcacattagaaactatcaatgaatgaaactgtatgtagcaacagaaatgaggctaaacattgcagggatggagtcttgatttcataggggtcagctcgcatctgccctttccacatcttcagattgcatctatccccttcgcagtcacatgaagacagcctgcaaatgcactcgccatgcaggggagacacagcttattaaagctccttcactattaagtgtctgaacaaagtaagggtatattgttacgcttagtgagggctgaaagtcctagtttcttttcatatactgctcggacaaaaacaaactatgactctaaactcttacttcttctaggctattatatttagcttgggaatcttgttctcaattgaaagatcaatggcctatgtgaccctcaaatgtctccgttgaccaaggttttcttattatttaaacttctgctttcagcttttattttgaatgaatttcgtgagctgccaattatgtgataataagctttaatcaattaatcaatcaatgcatcttcataaggaggtatcttatgatattgtttgtatctaaaagcagcggggttgtgtaggtttattaccactgcctaaggacagctttagtcatgacggtgcaaacataccacacattcactcaaactccagagtgatttaaagagcaccatgaattttgccattggattgagcattataatcttttctttctgtaaactggtttgttcatacttctatacattacgatgtcttgtacataccttgtgatggttacttatggaacaaaacaaggatgttataaagaagaagatgtagcagaaaacatctaaacctaagtatgttttcctatgcctcctttcctatctctgatcttgggagaatgagccattcagaatgaaggacaacacataaatcatttacaaagaaaaaaactgcatgaaatatattaaatcagcatttccatttaagtggctttactgctacctcattctgaaagataattatcaacgtacaaaacatagagagtgctaaagaatcattatatttatcaccgacattctctggaagctagactgaatttggccattatttgtagcttttacatgtgaataagataaccatgaagagtgcagacagggaacctgatgctcctctcctaaccccaccctctccaggggaccaaatctactccttggataaaggcatggtcaggtctaatgctgttgctgctgctgctgccgctgctgctgatgatgatgacgacgatgactcagcgtaatgttagaaatcattattaatcataaaagcaagataattccagtaactaaaatcttgtgttttttaagagttaagagcccagtctttaaaaaaattgtatatgtatataaaatttcatcatgtccctgcaccagctaggacctgcttcagttgagaatcctcctatggtaacaaagaggcatggctggcttccagttgatttccccgcctgacaattctttcccttcacaccctgagctggcatccacgagggcttcccactccttcggggccaagatggttggggccaggccagcgattgggcatggaaaagtcttcctggaggaacggtgtcacggcccagccttggtgctctccaatgtggatggctgtggggagctgatgcttgcctttttcagatacatttcatgggtttccttgagaggctccacagggaccatctgacagccactgcctgagcctgggactagggcaacacctctctgttattccttccccacatcctactaccgagtgcagctttagagtgtgacagtgaccctgtagccttccttgctgaagattcctgctattggcaggcctcttgagcaggttccttttcctgagaacctggtaagcctcccatccacagagaccccacatggcctccttttgtcctggagtctgaagagccattctctcccctggggccctctgctgcacatccacatcagctaatctcctgcctggaggctgctgcgggcatgagtcatagcatgaactggtgaaatatttctgttaaaagagttggtgcttttataaaaactaggtcgaatgttttggaaaggcactatcaaaaactgttaacatttaagaaaaaatacgacaaatgataagaggaatcattaaaaaaaaaaaaagtcgagaaagtctctgtatgcaaattgcttcacaagttaactccaagataccctgctctttaaagacgccaaaactagaaatggctgaggccatatcatgggtggagtttgcctaggagagaagttgagaaaatccagtcagcagggccacatgcttagaaaaggcacgggctcctcagcaaaatgctggtaaataaatcaacactcacagggtttatgttgaaataaaccgcttaatgtttgcaagtaacacatttataattttgtctgaaacaagttttccagctgattgacaatctacccaccattcctcactctataagaacaagcgcttctgttttgtcatgttgtctcctactgtcaggttgtagagccagaaaacaaaaaggaaaaccaaaaatcctaaggcagaaaacaaaaaaacagccccctccttcatttggcttctcccatctgcccatatcttttttcattcgcaccccaagttctaaatatcttagtttacttatatctccatgcttgtatttcaaaatccctcaaaatgtcactagaggccagtttccatgaagctaatgaattatcccccaaattacacaactcagcagctcctcacgatcctctgtgactgacttattttctggagtaatgacgcaggcccccgtcatttttctatggttcctgtgccagctgcgttgggttttcctctcttcgatggcatccattcattgctcaaccacaagatccttccctgcagcctcttctcttcctcttgctcataacaccatgattaaatgtgagttgaaactcacatttctagggtggtacccatggtgtctgtgtgcatggtgtcacagctcgggacactgcacttggccactgacggaggctcaggaaaggtttgtaggataaattgctaacttcccaacctacactgttagccttgactcctccccaagctccagacctacatattagggggctatcataggagattggccaatagggcaggctccagcatcagaccacctcggttcacactctgtctccagtactagcaaattggaaggctttgggaaagttacttaactaagacgctttttcttacctacaacacagggataataaaatagagatttaaaaaataagcagtatattgttttgtttactttttatgccaaagctttattattattaatattcacagcaatccttcaacacaggtcagaggatacaaaatagccaaaatgtaggatgaacaagtctggagaggacagcatgaggactatgatgtgtacaattatactacatttggaatttttgctaaataagtagattttagctgctcttgctacaaaaaataaaggtaactatgtgagacgaagcgtgtttattgattccactatagtgaccattttagtatgcatatgtgtcccataacaccatgctgtttaccttaaatatacacaattcatttttttaaaagataaacatttattgtaaacactatgaggcatgcccagggcttggcaaagtgcctgatggctagcaagccttccacaacaggtagctttgcttaaccacttgctagataccagctcactcatatcactctaacacctcaaatgtgtccaaaacttaatccattacttaaactcaaacagtatcttcccttcttcactaataaaatcaacccagctttagcgatgcgactggtaatcaatttctgaattgttttctacttccccctcaacccttacatcgaattagttgtcaagctttacctctccacgtactctcccaaatctacatattaaatcttatatctgatcctttcttttcacagtctccgacctacttcagacctcatcacctttcgcagggaccactgtaataggctcgtacctgggacagtacacaaggattgcctgtagagtgcttgcccataatacttctctttcacctccaaatacacccttagtatggctaaggatgttcctacataataatggctttaaatgactgagaaacattcaatggttctttacgaaatgaagaatcaagtccaggcttctagctctatgtagagtaagctaagagaacaggccaaatggaaaaataccaccacacatgatgatggtcttgtttaagctatacaatcaagagcatactttgtagagataaggctgggaatgccttctgagagaagtaaatgcccctcctccatcacccagaggcagaaaggaactgggcttttgagtggggaagggatttcctccttcctccgttgcataaggttggtaccacatgggctcctaggtgtggtgatgaagcacaaggtgcccccaccatcaggctgctgagaagtctggaaggggatcaagagcaacaagcagacagctctgagagcaggtgtaagccatttcctccacgggtttcctcctggtctttataacactcagcttttaatgatctgtgctgtgggaaaccagacagcacagggtcctgtcccacagcctggagttggaggacaagtggctgtgaacagcagaagaaatacggtcgtgtgcagatcacagcacgagcagccacagatggctggggacccaaggagtcttaaggacaaaaatggagtggcatgttccaccgtcctggcgaggaggtcccaggcacaatgttccaaaatactcggtgggaaacctcgttgaatgggctgaactccagcaaataaggacaaataaggctcgtgttgtgaggctttggacatacaaagaaatggattttttttttttttggtcggcattagctgcagagaaaagcagcagttacatgattcactatatattacatctctgtcctaaggtctgggattttatgttacggttgttaggatttggaattactttaatgaaacaatgttctcctatcgctaaggaattattccatagaaacaattcagctactgtaaacagctggtctcttctctggccaaaataattttgcttgtaaatatttcctttacttatggacaaaaccagaagtctgttttgtagtaacggttctctcttcaacacactgcatttgaagacaatgtttcaggctgatgtgggatctgactttttcccttgctgttctgatgatgctctgctaagcaaacaattgccatgttcccgagacttcaggttgaaacaacagatgtagaggtagggaggtgaagtgttttccttctgcttctgacacgataatgcaaacgagaaaattcatttcctttaatgtagcccccaaacccatatatcaacacattatcaagtgaaataatctcttttatgttgcactctgaaaaacttttaatattcatgtgaagataaaaaaaaatacttggggttagaaaaaaataaatgtaacatagaaaatattcccagggccgggtgcagtggttcacacctgtaatcccagcactacgggaggccgaggtgggtggatcacctgagatcatgagttccagaccagcctggccaacatggtgaaaccccatctctactaaaaatacaaaattagacaggcttggtggcaaatgcctgtaatcccagctacttgggaggctgaagcaggagagtcacttgaacctgggaagcagaggttgcggtgagctgagatcgcaccactgcactccagcctgggcaatagagtgagactcgttttcaaaaaaaaaaaaaattcccaggatacaacacagttttcaagtcatcaaattacagagccagtaatattaatgtttgtatggaagagaataagtagacttacaattaagttgcagggactttaataagatgttaacatgatttaactttgacacaggtaactttttgatacttttgaattttgtaaggacaaaacccaatcaactgctttaaaatacagaagagtactatgaagatcaaataaccaagttttaataaaaaggaacatgtttccagaaattctaaggtctagcattcttgcagttcccctaaggcattgcatcagtgaacagatttgagttttattggctaaagggaacaattctctgtaaatacaggcatttagacttataaaaggtgcctataaaacagatagaagaagctggaaattatacatgttgtggaactataaaaaaacccatttaaaagccatcccataggatgttttataatgtttatccagttcaaaacagctttatatttcccatttttcctacataatagtaaactttaagggcaaaaaaggcaaaaaaactgaataatgaaaaaaaggaaagtaggagggttaaagagcggatcacataagagaagcttgaaagcaggagaatatttacatttataggatacagaaattgagcattacggaagagaccacaaagtaaaacaaatgagaaatttaaacaaatagataaaaggtaaataagaaatgagtatccttcttttatacatgtataactcataaaatctctgaactaggaaaaatcttaaaactggatctagtctctttacttctctttcggcagaaatgtggttaaattttaacacagacacagctgtaccaaacaggtgctacggaggaatgttttcggatttcacaccttttctacagagagtttcccctccccacaaaggcagaaatgcttactgtaacttttaggaacagaatcaaagcttcacaaggtagaaaaaagcaaaaaacaaatcgttattatttttcttttagagacagggtctcgctctgttgctcaggctagaggacaatggcgcaatcacagctcactgaaatctcaacctcctgggctcaagcgatccaccctcctcagcctccgagtagctgcaactacagacacatgccagcacacttggcaaattttttattttattttatttttgtagagatgatgtctccctaatttgcccagggtggtcttgaactcctggcctcaagcaaaaatcctcctgctttggcctcccaaactgttgggattacaggaatgagccactgtcccatacccatttttttaagccctaaattttactctaagatctaaacccttggcaactaaaaaatatgatctttgattacagaaataaaggcatcacttaaaatcttgttaaattacagaatctcaggccccttcccaagctactcagcctaaatctgcatttaacaagattccttatttctacactcattaaattttgagaagtacaatgagtttgtctaggtatcacttctgacaacgtttaccttgtggttttatttgtacagctgaataaccttaatttatacctttcttttattaactattattaggactctctataattacacatatttgtaggtggcattaaaattacataagaaacataattcaaagtaacagaaaagcaaacacactcaaatttaaaatgcatttgaatcgggcacaatggctcatgcctataatcccagcactttgggaggccaaggcgggcggatcacttgaggccaggtgttcaagaccagcctggccaacatggtgaaaccccgtctctacaaaaatacaaaaaattagccgggcatggtggcacatgcatgtagtcccagctacttgggaggctgaggcacaagtattgcttgaacccaagaggcggaggttgcagtgagccgagattgagctactgcaccctagcctgggcaacagaaagagactctatctcaaaaaaaaaaaaaatgcatttgaatagaaattatttctctagctttcatcaccatatcctgaaagaggtacatacagcaaagactctacatgacaaaataggaaacttccataatgcgtactatgtccaagtatgctaactgtatgctaatgaggccttgcacagtaaaagccctgtggcatttcatgttgtcttgttgagagttgattggggtaattctttcaaggaatcattactctcagcatttctgtcatgctttctcagaaagtgttaaaggtcatttcactttcttaagaaaaaatatctaacatttaatgagtcacagacatatcattctatttggtttctatctgtagtaggcaaacatcaaaatcaaagttttaacccaggatgtgtccagaaattagagtaattgatccagagtcctggctctggggaagatgagcgatggcagggatccgccttggtggtaacaaagaggaagccagggctgggaggggagaaggttgtgtgtggccaaggttagtgagtggggagccaggacaaaaacccaggacccctcacatcgaccattcccattccattttcccctcatttgggggtgatgtgtccatttggggacatatggtggatgtatcttctaatttctagctatgcactgaaaacatgcatcttatcccaaataattattatttttttattttatcctacctgctaatttcccctttatatgtcaagctctgaacttgaggcaggaatactgagaagaaaagacatctgaagaaatcctcccccattgtgaattctgctgttccataggtttctgtccgtggctgcctttactctcattctacatcctcacacagttttcccgcaggtgtcatataccacctatgcactacaaacacgcagctcactatttcaagatcttgcctctcttttgtgccccagactcatacttctgactgcccttggacattaccaaagaatttgttttcagctaaaaatcattagaacaaacctattttgcactctcatgaaccagattttctttctgaattccattctcatgcaatgggacaaagactcctttattcattcgaattcattcaaacagaaacacagaaggatcctggattgatctcacctctccctcattccccaaccaatatagcttcttgggcatatgacctacgcagtctcattgggccccacactgagaagaacaacacagtgtttgctttaatgctctgctgttgccatcttaaaattcctaatatttttgaacaaagggctccacaatattcattttgaactagaccctgcaaattgtatgactggttcagtcctcaaatcctataaattgtgcggttagtcctgcttctctataatccgtctctacacattgctgctggaattctcctaaatctaggcagttaggatgtccattaacaaaattttttaaaggcaaaaattctgcggcttatcaatttcccacaaagtgtctttgagccttgactgcaatgaattttccagcacaaattcccatgcatcttgattttcaactgtaaagggcaacctgccctggttatcatgtatttgtgccaatattacatggactgaaagtcaccacctcctttctatatctgacacactctattcatccttcaagcttcaattttcccaatgtggcatataactcttctctgccttccatcactctccctaggtaggtccagcacctgtggtcaacagtattagcatggtaagtgatttctagctgatttacatagggctccaggggaatgagggaagacctcctttcagtccaggatttcttctggcaacatcttcgatgaggggaacagctgagacaacatgagtgtgtgactgcatggtacattcattacactggctttgagcaaagtctgcaggagaaaagacagatgctcccaaactacacatccactcaagtatacatgttcaagttagtttttcatacaaatctcacgtccttcctttgttgactttattccttctctgcaccatgaaacttgcccatactcctttccatatcttcatgaaggtggcaggaagtcacttcaaatcacagctgacttcattttcattgctgtttttcttcaaaaacatgttagtctgcatcagagccccactgccaggcacccaggagtgggtacaggggacacatgcagaccagggtcaggagtagcccagccccattcaacagcattccagctgtgtgcacaactcaatgcatcccttccatgagctgcaagacggtgcatgggccacaagtacctctccttgttttgcttttctctctaagaaatcagggatctcaattcctgacctaataccatgcttgttttgcaaaccagtttcaactaataataaacaatgttgtccttgacagcagggccattactgctgtttccaaataccctcaagatactctcacatctgtttcattagacaggctgcaaagggtttgatcaatgtgatcaagaaaggattagcatttacttctattctcaggttcctacgctcacctactttcactcaatttttcttcctttctccatttcactttacaaattgtgattttcactaataataattatctctattacagaaaaatagaagatgggcaaaaatatgtaactgaagatccctaagtatgtattgatgacttaaatatctttttgaatttgattttctagcaattcagttgtgcggctgttaaaaaaaaaatctctttaagtacgtcttaatttgcaaatgtgcctaactacaagtgaaccactcatttaacagacatttaatgagtctacactatatagtatgtgtggtctagagacacatagccacacctcaataatctaatgagagagagagataatattaacaagtatttgtataataataggaagtatatataagtatcaaatgcactgaagacaaacatgcctttgactccgcaattccatttctatatatttataattttaaaaaatctaacaagaaatgggccagcctgggcaacatagggagacttcgtctctacaaaaatttaaaaaaagaattagctaaatatggtggcatgtggctgtggtcctcccagctactcaggaggctgagaggggaggacgcttgagccaaggcagttgaagcttcagtgagctatgatcatgccactgcattgtagcctggacaacacagcaagaccctgtctcagaaaagaaaagaaaaagaaaaaaaaaatgtatgaacatttaggtgcaatagtttcaatatacacatatatatataagacatatatatatgcactatataaataaagatttaaaataaagcctaatacctggctacatatccaaggtaatccaggtttaaaaaaataatgttctacaaatatttgccatattctggaaagaagctagttatgttcttttcctgacagctggctgtattcatttgatggattttgagttattaatatgtttaagagcatgaatgtaatacaaatatttaacgatttaaaaatcattttctgtacgtataattgcacaacacatttcatgggtgatcagctgtcaagcttattttactgtgtcctttaagctgtccaaaatataaaaatttcttcgtctttaaatgtcatagtgtgacctcaaaaagcaatgctgcatgaatgtgtagtgacagttgacacacaggaggtgtcattttaggcatctgcacagaaagtacaaaaacatacctctaaagtacccatttgcttcgacttggaacttttccctaagatgcaaatatgcatgtgcatgcaccccattccccccaaaaatcacatgcagtgatatttctttcttgagacttagtcccgctctgtcgcccaagatggagtgcagtggtgcgatcgtggctcactgcaacttccagctcccaggttcaagcaattctgtctcagcctcttgagtagctgggattacaggtgcacaccacatttctataaaaacatgcaagtacttttttgcatcacaataatgaaaagaatgtgttctaacgtttgtgtcacataatgagaacttgaaatggaatcaatcaaattttcttaaaggcagggcaaacaaacgaaaacatgcatcccattaatgcacaccaaaaaaaaaaaaaaacgcatttcctaatgaatgggaggtgcttttctctgcagaagcatcatggtcatcagactctgagtgtgtattttctcaacgggggtaatacttcagtgattctcctcaaatatcagtccattcatttccctctataataaaagtgacactggaaggttaatgatgtgaaactctgcagacaaaatgaagctactatcctctttctgctgacaagaccacagtaacgcaatgtgacaaattagaaagagaggaatagaatcttagatggagattccgtttaggatgtatttttcccagcagtgcctccacttgactaggtagtatgtaaatgtgcataaactttttaaatttatggttaagagggttcatgatgttataattaagggacagactaggtcaagttataacatattctataccatcccataacatatctttgaatttctttgtatttagtaatctttgaaatggaagcaaatcacgaagtatgcaattacatgatttttgcaacactacaaagtatgctttttatgaatctcaacatagaccacattaggctttaaaatatcactcaaatttgaatttcagcagaagtgcatagaaaatttaaatactcaaaggtacaattttctgttaaaaggctcaaaaacattataaaatctatcataaagtctttagctaatgaaaaatttgttaatagttcaattcagttaaaaaatatttacctctttgggaagctgagggtggaagcttgcttaagctcaggagttcgaaaccagcctgggcaacatagcaagaacccatctctactaaaaagaaattttaaaaaattagccaggcatggtggtatgcacctgtagtcatagctactggggaggctgcgttgggggagactgcttgagcttgggagattgaggctgcagtgtgccatgaatgcacactgcactccagtctgggtgacagagcaaaacagtgtctcaaaaaaaaatttacttagtttaagtgcaataattgcattattatcaaatatgaaatagggcaaagagtaactaaattgtcagagtcaccacaagttttttattatctaattataagaaataacatcttgaaacaaatcataacaactaagattgagaataagacaaggatgtccactctcaacacttctactcaacatggtaaaggaagtcctggacgaggcaattaggcaaaataaataaataaataaataaataaaaataaaaggcacccatataggaaatgaagaagtaagacaacctccatttgcagaagatatgatcttacatatagaaactgctgagaattcagaaaacaatgtgttgaactgataatcaacttcagtaaaattgcaaggtacaagatcaatattttaaaaattgtttgcatttctatacactagaaatagacaatccaaaaatgaaattaagaatacaatttcacttacaatagcatcaaaaattaataaaagcaaaataagtgcaaaatgtatatcatgaaaataaagaaaaagaaggaaatgttaaagatctaaataaatataaaaatggtccatgttcatggacaagaaaagttaatattgttacaatggcaatacttgcccaattaatctacagatttaatacaatctctatcaagatttcaggtgttcttttgtttgtttgtttgcagaagttaacatgcttacccaaaaattcatttggaaatgcaaggacacagaaaagctcaacaatcttaaaaaagactaaattttgagaactcacacgtctcaatttcaaaatttgtagttgtttatgtagttactaccatatgtttatgtagttactactatataaattgaattctgcatacaaaacatgtatttcttaggcaagcatattatagaattactttccaatatcaatacaaattccaatattccagatttcaggaagttctagttgctgaataagcaacacttaaccattgtgtttatgttccacacgtgatatgtgacgtacacactgctaaataccaagcacaaaatacactcgaatcatgcaagtatcctcttatctcttaaatcactggcttaatttggccttccataactttacatctattttaactactctgctacaacttacacttattaattgatgtaaaagaaaatattaaaaagccaggctttaatatctgtccccaacaaaatcacattacttgcatacaaaaaggttaaggtaattctcaaactgtctaaattcttctctctacaatagggtaacactaattcaagtgattctgctacttaagtaatttttaacacctttgttaaagtataattgaaaaattaaaattgtacatatttaaggtatacaatgtgatgctttgatgtatgtatacattgtgaaatgaccaccgcaaactaatatatccatcacctcacatagttaacattttcttatttcttaagaacatcacacaccggggcctctcgggggtgtagggggcaaggggagggagagcattaggacaaatacataacgcatgcagggcataaaacctagatgatgggttcataggtgcagcaaaccaccatggcacatgtacacctatgtaacaaacctgcacattctgcctgtgtatcccagaacttaaagtaaaataaaaagaaaataataataaaataaataaataaaaataaaatacataagaaaaaagatctctcctttcagcaaagttgaagtacacgatgcagtattattaactatagtcatcatgctgtatattagatcttcggacacagacaaatactgcaggattacgtttatatgtggaatctaaaatagtcaaacttacagaagcagagagtggaaaggtggttaccgggcattggtggaacggggcaatggggtgatgttgccaaagggcacaaagttttagttacagtcacacgacgtcacataacaacattttggttaacaatgggccgcatataagatggtggtcccatagaattgtaatgaagctgaaaatgtcctattgcctagtgatatcatcttgttgatgctgaccttatgtaggcctaggctaataggtgtgcttgtgtcttagtttttacttaaaacatttaaagagtaaaaaaaataaataaataaaagtaaaaagcttatagaataatgatagaaatatttttgtacagctgtacaatttgtgttttaagccaagtgctattagaaaagagtcaaaaagtgaaaagaaatttaagaatttctgaagtaaaaagttacagtaagcctaattacagtaaggttaatttattattgaagaaaatgttttcaataaattgagcgtagcctaagtatccagtgtttcttgagtctacagtagtgaacagtaatgtcctaggccttcacattcactcaccactcacagactcatccacagcgacttccagtcctgcaagccctgcatggtttaagtgtcttatacaggtgtatctttttttaaaaaaatcttttatattttatactgtatttttactatacctttactatgtttagatacacaactacttaccattgtgttacaactgcctacagtattcaatacagtaacctgctgtacaggtttatagcctaggtgcaatagactataccatataacctggtgtgtagttggctagaccactaggtctgtgtaggtacactctacgatgttcacacaatgacagaattgcctaaggacacatttctcagaactcaggacttatctctgtcattgaatgacacatgactgtacttaagtaatgcaaaggtaatagaatttcaacacaagtacgtccactggctctcctttttttccctatttcctctccctatctcaacacacacacacacacacacaaatttaagtatatggaggaaaaaatggaaaaaaatagctccatgtgttctccctaacatcatcattgcatggatgaagttaatggaggttcagtaaggttaagtgactagttcatctcaacatgcctagcaaacaaagaattcaaactcagcctaattttgtagactatacacttgatcattcttaatagcaacaatttacagcttctttttaaagcaaaacttttcaaaaaagctttcacttctttgagtaccatttacctactttaattggacttttgaccccttcatttcattgaaattgactttgctaaagtcaataatggcttccatgttagcacttccaataggtcttgattcatcttacacatcttcaaagcagcactgaacccagctgacagccttatctttgaagttctctattcccagccactgtgacttaaaggctctatggtttacttttcattctcttttgtgggtttttttttttttttctggtcaactgctaaatattagagtgcttcaggcctagacgattggcgtcttgtcttctgcatctctagtttctcaagcaaaacaagatactgtttaatattatctggattttatttccttatttattggtttatttttcatctcctcataccagtgtataaacttcatgagtcacaacagataggaagtgttttctaagtgtctgttggataaataaatggaaggaaggaaggtaggtaggtaggtaggtagaggtataaattttaatccctcctttctgagaaaactgtgattttacctgataaggagtgactgttgaaaatatctctatctggccaggcatggtggctcatgcctataatctcagcactttgggaggctgacacgggcggatcacctaaggtcaggagttcgagaccagcctggccaacatggtgaaaccccatttctactaaaaatagaataaaaaaaaaaacagctgggcgtggtggtgggtgcctgtaatcctagctactcgggaggctgaggcaggagaatcactcgaacccaggaggaagaggttgcaatgagccgagatcacgccactgcactctagcctgggcaacaagagtgaaactctgtcttggaaaaaaaaaaaaaaaaagaaagaaaataaaagaaaaagaaaatatctctatcttagggatctcttttgcagtaaggcttggatctgctttgtctgcatgctgcacccctcagtattccacattctaggccaactgcccctcaatggttgactccaagttattatcacagccctgccaccaggaaatcctaaaatcaacctagattaaagagaaaggcctggtcagctgtgatacttgctatgagtgcaaatgttccacagatgaactaggtcatgctggatttagccactctctcaatgagcaggaatgccaaaactcatgggggcagagtgaggtgcgtaccaggcctaaagtgactgcgttctcagtagaggatccctttcacaagtgtttctgagaagctcactgtttattagcatcagaccttgatctcaatcatagcaacttgtcacccatgagacacgcccagccctcatctcatttcttttgagtcctccaggatgctgcctagattggccttgaattgtggccctcatccaggcatttggctgccttcacccagtaccagcccatcacctgtcatgcctcctgctttccccagccagatgggcagccccaatttcttagcagctcttgtggagaagctgtgttatttcaacaaccatatgccagagcttagcacctagcagtttgtgataaatagacttaatatagtcaggatctctgtttaaggagaaatgctaatgatgataaagatttacattttgtgatgcaacaatgtgattatataaacctaaggaaacaaatgaaaataaatcacgttgtgctatttggtttacagtttacgtgatacgattttcattgttttccgattttctatattttgtattttaagtcataggaaaatagaggggtaattcgaattttcaagttgaagatgtgcttattaccattttagaaatataataaacattcatatcaaagggaaatttggcatgtcagaaaaatgacactaagtttttgtttcaaaatgtggccatatatttcttaatgttttttaccttttaatagcaccttcaattctacattctcccccagcgatcacaaagtcaaaaacatcctattgtaacatcaaggcacatatctgaggactcttctctctaactgagccttctttattattcttgggcaaattatttaatctattttagcctcttttcccatcatcattctcacaaagggttagtgatagataaggtaagagcttatctttcacttaccttagagagttgttctgaagactgaatgaaataaaccaggtgaaatatttagcacactgcttgcttagtgaatgctcaatgcatgtttgtcatcatcattctcaccaccatcattaaacatatatacatagtcaacatttaacttgggattttctcagcattcttcaaaacagtttaccacagatattaatattctggttctaaaacagtatccggcaaaaattaggcatttagtaaatgtatattaagtgttggtcacatattatcttctttggtagctttactgaggcaaagaccatgttgcatcccatctgaggctagatgaagtatcaggagcagcaaagacaatcgatgctcgttgagtgaatgatgcatagccgatgttaaacatccattaggaaataacatagagagctttgcattctattacaatgacaggtgacaatggatgcactcccaacgagaacaatttataacctctcctttcttgccttttgctgataactgattacatatttgaagatcattgctgcaacctatatagtctatccagctgtatgagaccagcctcacagagcaaacttaaagcatagtgaagggagagatctatcctaaatcaagcagacacagtgcatgattattggctattaattctgtggacacacagcgtgagaatttaaattcataaacattaaataggtaactgttaaatagagagcacttatttaatttggtcacttaacatactttctgaatctctatgtgttagaagaaagattgtaaattttccatgacaaacgtgataaaagtataatttatttctcaatttctgtattgcatggtttagtagaaaggaccctgggctggaagacccaggaatacagccatagccttggctttgtaattttcacaagtcaccttacattacggctttagttttcatctgaaacctgtcagttcccttccagctgtaaaaccctaagtttctaataataaccccatcatcaaaatctggtgttttgttagtatcattctcccaaagcattgccgcagactacaatcaactctattatccatgttagattttaacgttatacccgggctctatctacagggagacaatatcaaatcagtgctcacaatgatgatttgctatacccacgcaactccttctccatgcgaatgagaccttctctgtgtaaattgaaattgcacatagagaacagagatatcataaacgagtatttcccattcattctaatcacagttgactcatgacaagatggcagacaggaccatagcaggtatcagactgcattactcaggaccaattaagccaagttattccatatagacacaggtttttttcttgaacgatgaagggaaagacagaaatttttggccatagaaaaatttactatgataaatactgtctcaacaagctacacatacacatgtatttttgcaaagaagcacccatgcgtttgaattactgttaaagtcaagttgctgtgtgaaaactgggacactttcagcatatattctccaacatttctgatatcaagttacagtggagctatttggcatggttggatgcgatgggctggcttccctatgccatatgctattgaatatgcaagtttttctacaaaagtttccataactgatactaatttcacacttaatccacatatactagctatgctggaagtttaatacataatataattatggaggaaacgatcagtctttttccaaggcttgttccagccctaaagcaaatcattctgcattatctgtggtaatacgtggaagcacaataatgttattttgaaataacatgagatttttttttaagattctacagtttctgatttggagttgtttctacacttttaaaaacttcatatttttaacacaaaaacacaaatgtaacataaggttatggtatcatgtatatcgaggcacacttgcgtaaccatcgagtctctcaacaatgaatgatcctaaattcctgcactcagaagcctccaatgacatctttgtattttatgactctacactggaataatcacaaacctacaaaggggcatttctcagatgtgcacaggtttagtggttcagtacagagtactagaggctggagtccacgtttcttcagagaagaacttttgatgaatttactacagtgacaatctcagttcatctccaagtagaacataacaagaaagacaggtcccttcactgaggtctgaaaagaactaatgcaccggggacttcctgcacctgctcttatggctctcttttttctggttggattgcctcctcttcccttatcgaaactctgcccccttctcagccagtcctactcactggtgcccttgaccactctgccctggccagggcttacaacaatgagcccatgttgctgtgaagcgggtgcagggggtctgcacgtctcattctctccatctatggccttcagttctggtgctctatctgtgttgctgtcacagtgattcctcagctaattaatcccctggttatacaaactcaaccatgtttaaaaagtgatcctcataaatcatcatgggcagaaatgcttgttaaggaaaaaaggccttctagggctggctccttttggaactatctcagataagggtaagagggtgggcaggaggtgggctgtgaagccctaaagcctggggctggaatctgtgatcccctcactgcaccccacacttgccccacctgtgacctccaccttcccacgtcccctccacaggactcttcagcctttgcagacactcaagacagcgtgtgccctttcacctcctaacaaaacagtcatttgaattgtttccctgacttatgacgccctgactcaaacacaatcacacactaaggcatgaaatctgaaagtacttttgttgtaagttgcagaatgaaatgcttttgttctttggctaatggaatttcaagcatcagcaaacagtggatttttattgttcttttgtgtctagaaggaccagtgaagagactctccagtcctccctgggttaatggaggctgagtgaggacgctcctggtgacacagggaaccctgcattaacacagtttctttcccccaacaaagccctgctcaaaagaattttaggcaatttgaagacggatgctagaggcctaaggaaggagataagcttctgtctgttcccctccaggagttcctgtctaaaagagcccatctctccttgttttaacaaagtacctacacactttaacaaaatgattgtcaaaacaaaattaatgcagttccaacgtttactggtgataatatacactagagcttgtaacgtacattcaactgtatacgcatcatcacttcgttttgcaaaacttattttgtttctcatcatgcaaaggaagcaaaccttaaaaaaaaagactacaatgttgtccttttacttgactcaaacatagcatataaaaatatgctatgttcattgatccatagcttactcacaattctcaaaattctttgtatgatagatttgacaaggaatttaaatcgaatatttaactaacttttactaatttagaaaagcaggctgtctgaagaagccgaaagtcatttttgtgtttattgtaagataacctttccccagtggcagccagcaacacatctgcattcctaccttccttatgacacactcactatggagagctctagggctttttagctgcagccaaacatccatgcttgagttacatatcaaaggagatttttcatccttagcccaactcacagcacttagagcacaatgtgctgaatttttaacaggaaaccgcctctttgtgtagtcccttccccaggaggctcttgtcaaaacatgtgatatttcagagttcaacttcctggctgcacaaactgatacattgtctttttgtaccatgagtaacattttcaaattaaaaaaaaaacacataatcatatttcatgtcctcaaagaatttaggaagaggttaaatttaaacattttgattcagatctcagcctttgtaaataaggatacataacattccatcacctacctatgagaccacagaaatatcaaaagctaggacaagaacagcagtactgtgaaccacacacagttaaaaagcgttcattgtccaacaccacaagtaagttcagcagttctcaaatagcatccatccctgcccagggccactgtctgtgtgtcttcccattctccccaggtctgcagaatcccaaaaatgtgcacatgaggttaactggcacgcctacacagtcccagtgtgagtgtgtgtgggtgtgtgtgaaaggtgcagcgatgggatggtgccctgttcagggcttggtggccacctggtaccctgagctgctgggataggctctgggccacccaagtccttgaacagaaataagaaggtaaatcactatcttacttgtttttttgtttgttcgttttgaggcagagtctcgctctgtcacccaggctggagtatagtggcactatcttggctcactacaacctccgtctcccaggttcaaggattctcctgcctcagcctcctatgtagctggaattgcacgtgtgtgccaccacacatggctaatttttgtatttttggtagacagggtttcaccatgttggccaggttggtcttgaactcctggccctaagtgatctactcgcctcagcttcccaaagtgctgggattacagacatgagccaccatgcccggtctatcttacttgtttttattaaactttcctaaatgtatggataacacacattcatttcttgttgaatattagaagcgttttggtcttcattcagaagtttggtgatgtttttgtgaccagaagccgccatacaaacttaactcttgtttataccaactcgcctatggtgaaattggttctgtcatatgttgttttgcttcaagtcgcagtttccggaacctatcgatgacgttaagtgtgcacctgctgtgtatgctgccttgttttaggcagtgctgatcctcaggcctcacttccaggtgctggcccagctggctgaggacaggggcagctggtgccttcggtagaatcacgccagccaccacttgctagagtttgccacacgccagccctcttctaaacatgtctaagcattttgttatgtattaacacttaatcctcagaatacccctgtgttttaggaactatcagcacccccactttatacataagaaaactagggtgcaaaattaaaaccaaaattaccacttgatccagccattccactcctaggtacacacccaggagaactgaaacagggactcacactgacacctgtacaccagttttcactgcagcccgaagtggaaggacccacgtgtccatcaacagaggaatggaagaagaaaatatggtctgtccatactgtggaatattatttaaagtgaaaaagaaaataaaattctgatacatgctcaatatagatgaatcttaatgacatgctaagtgaagtaagccagacacagaaggacaaatactgtatgaatctgcttacataatgtacctagagtaggcaaattcatagagacaaaagaaaaagaaggtggggttgggggagagcagatggggagttacaatttatactttcagttttggaagatgaaaaaattctggaaatggatagagtgatggttgcacactattgtaaatatacttaataacactgaattttatacttaaaaattattaaaatggtaaatgttatgtatttttttaccacaataaaaaaaaagaaaaaactaagatgcaaagaagtagaatacagttctccaaattgtcaggcctacaaatggcagagtgtggcttagaactcaggcaggctggcgccagaagcctcgtccttccctactcatgcaaagatacactgtgccccacagtacctctttcaagtctccactgcatcccgcacaaggccttctgggagcctgccctggaatcccaccccctgtacccttcccacccatccacctctaggcagaactcaggctcgaggtctccccacctttgctccatctcagccccttccctttatctccaagctctaaagctccccttagatagaagcaaaggtggagtcaatggcagttccaaggcatctctgagactttttatcagttgttcctctagtgatagtttctcaccaagagcttggtcatagcatgacactcctctaagctgctgtgtcattatatttaatatttcatataaacctgtcttctaaattttactgtatactcttaacgagaaagggtgatcttatgctttatgtttccctgggcacttaacagagaacagtggacacacaggcgtgcaataaacattgtgtaataaatgtcttcctaacagttaccccagggtgtagtcaacataatggcaatggtttatgacttgggtacggcgctgcattaagggtgtttttccaaacagatttaaacagatttctttggaaaagtaaataaactagaataatatcataataacataacaatattaatagagtcaatttaaaaaacccatgcagtatgagcactcatataaagagagccacatttaaaagctcgcgggggacttatcaatcaatgtcattttcacaatgggtccccaagcctgggaatctcatacagggttcagaaagaatgaacatattgttactactgcagttgtacttggtgtcaaatgacaagatcatccatcaaggaggcatcactgtaacttggagacaagccgcacaggtcacaggcacagaagcttttggagttgagataattttcacagacttgaagctgtgctcttaagtaatggctttctgggttttcatttgtatactcactttgtgtcaacaagtaaaacacagcaacccatgaaatgaagagttcttattcccagtagttcacataaaaaaaaaatgaaatttcttattagaaatattcaagagttcgtcctccatgtcatggagttatcaaaagtcaaagtaattgaaatatatcagagggactgggacagccttgaacagagtgggaaacaacatcccttggaaaataccaaaagggaggtgcagagtctggggctggtgtcaggtcctcagggaactcttcctccaatgtccagcttcacactggtgccaagccctgcccaacccaatgtaagcctgcaccacagagtatatggccttggggagttggccgtgctggcctttctgagatgcacaccttacaccctggagtctgaaccaggggccacaaaggaagtgagcagcgacctagctctgacagaagaaggccttccagtggggcaggcacctgccctgacctcagcaggcactttagacttccccttttcatcagtggccaggtggccccagaggctgctgggatggagcagagctgtctggctgggcaattcatgttgtcggcttcaagagacacacttgagtttctgatcttctcacagaggccggcgttgacaggtatggagtgatgaaaatatgtgggaagggaaccccaggatcacagtgtgctaaccaggacagactggtgccggcaggaaatagcaatgcggaaaacagggacacaaggccatatttttccgtcattggctgtgaagatctaggaaataagggttgcttgccactgaccaaaaggaaactgaaatgaagtcttgatcaaaaggtagcactgtctgcctcctacttagcataatgctctattagctgtgcaaaaaactggcaaaaaacaaaacaaaacaacaacaacagcaaaaacagagatattgtgtttaggaatgctactaaatggattatttaatttcagttaaaaaattcaaatgctttataaaaccaaagcgtcttccaatgaagtacattttatttgcagatattcagaaaaggaaacaaaattcttccatagttcataaacaagaaatacacactgtggttctacataatttgagccatctttgatctatttttaactctgccttggcactcaagaaaaactcacgggaaaaaaaatgattcaataaaaagcaatatcctcatgggaagataatcaaataaagcttagtttggaaactggttttgtagtttcctaaatacaaagcatgcagtggatttactacatctttagcataactatgaatatgaatggggtctccagagctaacccaagattatgcagatagtttaagctttattccaggcaaaatttcaactagatttagaaacattttcataaaaaagggctgtaaagagattaatggtattttcaaacaatctaaaatcatggatttgagagatcttgccttggtttattgtctttaaaattactcagaacaatacacacttgggtatctaaaacagaattatcaaaatccttttgtactgataaccccataattcctatattatttagaaaaagtaatttatcttgaaaattacatattatatgctataagattgctttttaaagctgtactttttctgagcttcaggcaatattgtaccttgcagtaagcttagtttccgaaaccaaaaatgttccaatggaattggcatcctagattctccttgactgcaatagttcctttgattttaactccataagtgctcacctcaaagttttcattatcaaaatagttggcacaactctactggggaagcaaagatatgatgaggattccaggatgactcataatatctcgatacataatgagtgtaccaaccaaaagctccctttagtaaatagcaataatgtcagatggttagaaatgggtaggagttgaataatcctgcctcgataaccatcacgcagcttcaaagaatggacttatagatccaatttggcctcatgatcaagtattcgttacccagcaaatgcaaaaggtctcatggcctgtgtgtgtgatttggggaagtccccctccctgctttccagccctgggacatctccgtagttaatttccaggaggtagaagaggctcactccaaggtggatgcagcagtgttttggggacaggcacagccagtcttcaagtcagttcaggacaccaagtcctttggaattggggtgttgtggcatccacagggcttcagacctccaggcctcagcactgcactcaaaatactagaatgtgttattttctggaatctgacatcccagtcacataagaggggcagagccttaacaatatttctgatcacatatatatcttaatgccactcatttcgtctacaactacgtgtttctagcttcccttttgtacttagcaaacatgatggtgtggattttggtaccaatttttgaagggcccagggatcatacttagattatgaactcttgactggggttttttaactgctgattatccaagcctacagtaaaaaataatgtgaacttacaaacgcacacaaaaagcagcactctgtttacactgtagtatctttaaagtcaattgctctgcagacaatacaacacacggctttgtctcctgcaagcaacgaaaataacatcctgcagacataactgtcattagaggtttactctactggcaagagatgaagtaatggaaaatgttgataccttgttagaactgatcattctgaatttacaaaaggtgtggtcaggcaaggatggtgggtacaagtgtctccagaaaaggacacctggccaaggaacatgggaatagtaccatgaaaatatgtcaaatacaggaacaaaagccagcagcaaggaactaaataaaggaccctacacaggtgaggaaagagggagtcagggatgggagggaaacacggccccccacacagtgagctaaaaaagacagggagggctgggcacggtggctcaggcctataatcccagcaatttgggaggccgaggagggtagatatcctgagatcaggagttcgaggccagcctggccaacatggtaaaaccccatctctactaaaaatacaaaaattacccgtgcatggtggcaggcacctgtagtcccagctacccaggaggctgaggcagaataatcacttgaacccgggaggcagagattacagtgagctgagatcatgccactgtactccagcctggaggacagagtaagactctgtcaaaaacaaaacaaaacaaaaagacagggagagccactgccatggcggattgttatcataaggtagtaaatattaattactaaaatgagacagctcaggaaagaataaaggatgaaataaaaacactcaaagagcattttgatatatgctttttcagccttcctttctatgaatactttacaagtgatatgctgcacatagacatttacattctgctatcttcaccaaacattacaattaataccacataacagcactttttatattttatttggcttatccaccaaataaagtctggtcacattatttcaagacacactaaccgcagtgcacattgccacgtgcctcccaaactgttcccccagctgctgggtgtgcagctgcctctggacaacactcagctgtcaaccccttcaggaagagccagacattatgctcccctccaggaatggctcacatctataactgcctggctgtggacatagaaaggtgcagcccctttgcaccacctccaaacaatcctgaagggctctcccacctccagagcctccctacagggccactgtagtcttggttgtgactacaccacagcccaacttctccctctgccaggcttgcaggctctttcccttcccatcccttgcccctctccctcttctccctcctttttctccaaacccacccccacccctcctccagtattggcctcaagaacatccccaataaactattctccgtatcttagtcggtttcccagggaacctgaataatgtttattggaaacataagatatttaatttccaacatttttgagagaacattcttcaagccaacttcaattccaaaattttaaaatactctctcaataaccaaaaggccattaaagacctttgaactataaagcaactgtttattgagctattgagcacctactgtaggtcatccaccttgccaggggctgaaaatttatgaataaatcgggcaactcaccaactaagagtggtgaaattaacagaaagtaagaaaactgtggaaaaaatagtttgttctatcatttcaaattatttctataggttcaatatcgcaaaacaaaatcaagaagggccttaaagaaaaaggacatttgctagtcaggaaatagactttaatcaatatttcactgaataaatttttacatgatcaaggatctggatcagatgttacagcaagtgacttcctatggcccccagaaaagggttacttgttgtttctccaatgacaggagaaaaagaaggagggaggtgggaaagagtttgaagtagtcactttgcataaaagaagtatgcaattcagaggagaatgtgaaattatgttagcaattaatgcctctttatgagataataaagcaattagtggaaacttgaacaccagccactagtgttcccatgaagtggcagcccagggggcggagaagaggaaaggtggaaatgcaagttcacaaagactctcactctgggctaagaggagtcaagaggagctcacattcatatgcataaaaggtcagccatcttttcaaaaatattgaatttctgttaattcttctgtcaaacgcaagacttccaatgcaaatatgtaaagcatattttctaggaaacaacatgatagcctgtgcttatttttctgtgtcatcagttaataggcttcaacagccctttaatgtaaattatactcaggagtgtccttgaagtgctaaggggacatcatctcatggctccttccacctagggtgggatttagagctcacagatgccccagaagaaaatgttccccgggctggcttcattgtgaagaatgagccaaagtcactggacctcaggcagcaaggaccccatagccttggccatggcacagaggtccagtgtgagccagcagacgtggggtagcacagccctagctaagcccaacacccagcacaactcttcctttccatggtagcccatgaagcttcctgtccctggcaaaagactctgctctggacatcagcattctcacttaaggaaacttcatctctggcttcatggaagcaccaatttttacaatcaatggaccactcagagcagcttttctcaaaacctgatgtgtatttatgtggcttcagggtctggccaacacgaagattctgactcaggagttctgggatggacctgagattccgcatgtctaacaagattctgatgtcaatgttcctaggcctagaacctcactttgagatgccagggcttagtgatctggactgtagagggtggggaagctcacacattattctggagagcattctgcattcacactgcctgtaagaatggatgcattcacaacatgcaggcttctgtatagcagtgaattttacaggaccacctcatgcaaagagtttgtacttcccctcaccaataaaaaaattaacatccatccttttattcttaaatggtaggaatataaaaacagcctcctaccgtgtttagatcatttatattttgtaagccattttcacttttcttaatttgatgggtagaaacaccctgcagaaaaattgaaaaccccaagtttgttgtaagtaactgctgactcccacagttacatcagcttgttgtaggcactaaaatctcatattcttggaggaaaatctagggaacagtgtagcccataagagcaggggacagaaatcctgagggtgcgccaggtgacagtggctcacacctgtaatcccagcactttgggaggccaaggcagacagatcacctgaggtcaggagttcgagaccagcctggctaacattcctaccaaaaagtacaaaaaattagctgtgcatggtggcatgtgcctgtaatcctagctacttgggaggctgaggcaggagaatcgcttgaacccgggaggtggaggctgcagtgagctaggattgccccattgcactccagcttgaacaagaagagtgaaactccattgcaggggaaaaaaaaagaaagaaaagaaatcctgagggtgattctatgcgctgagacctggtgacatctatttaaagcctgaattcctggtttcatgattgaaaacaggagtgatgccttcctctttagaaggttgtcatccaaataaaatgaagtctgagagctgtctgtgagctaaatattctaagaaatatgtaagttagtttttcctcgaagactttgctgacaatccattctctctgctctaacttttgttctgaagtgaacttggacaaggattaaacacttcaaaaaaagatttcttggccgggagctgtggctgacacctgtcccagcactttgggaggctgaggcaggtggatcacctgaggtcaggagttcaagaccagcctggccaacatgacgaaacacgttctctactaaaaatacatcaaattagccaggcatggtggcggatgcctgtaatcccacctacttgggaggttgaggcaggagaatggcttgaacccaggaggcagaggttgcagtgaactgagatcacgccactgcactccagcctgggcaactgagcaatactctgtcttaaaaaaaaaaaaaaaaagacttcttatggaacattcacttatctgtactgatttaaaatgcaaaaggaattctaataaaatgattcactttctcactctacacaaatatactgcctccagttcttgtcaaagaaacagcctgcaatatggtgtaaaatgtgcttcaagataccccaaaatattatatatcactctctcttgtggatgttagcagtatgggatatttacttttcaagtttgtttgcttccgtatataattttttcctataggtagtatcatgataactatgaaatttctggccttgttttctttactctccattataacaagaactttttttgtaagtgtaatcttataagtggtaactttttccttatttattccttgagtatttatagattgaagcaaaactaaatgcatgactccatctgcaatcacacagaatattattaaaactatggtattttatgcttgacatagctcagaaaagtggaattggtaaaatataaaaaatgcacagtgggaaaattatacaattcgtaaatacataaaagggttaacttacaaagatctttattccccccggtgttacaagcatgaggtctgaacctacattactaagtttaaattccagatctgctacttacaactaatcaggtgacttagaaaagtgtcttgaatgcttgactttccatttttccaactataaaaaagggtctaaaaccagaactttcctcatctgtaaaacatggctaaaaccaaggccaacctcacaggcttgttatagaatttagtgtcattctctatgtaaagtgtttggaagagcatttagtaagggcttaataaatgttagctcttttattttatttttattttccatttttgattttttagtgacaaattctcactctgtcacccaggctgaagtgcagtgtcactatcatagcccactgcagctttgaactagtgggctcaaacaatcctcccacttcagtctcccacgtatctaggactataagctcggccaccacattcagctgatttttttattttttggtagagatagggtctccctatgttacccaggctggtctggaatccctggcctcaagcaatcctcctacctaggcctcccaaattgctgggattacaggtgtgagccactgcacctggccaagttcctaaggtatctacccagaggaaaagaagttattgtacgaaaaagatacttgcacacacatgtttatagcagcacagtttgcaactgcaaaaatatgaaaccagcccaaatgcccaccagtcaacaagtggataaagaaaatgtggtatatatttaccatgaaatactactcagccataaaaaggaacaagataatggtattcgtagcaacctggatggtattggagattattattctaagtgaagtaactcaggaatggaaaaccaaacattgtatgttctcacttgcaagttggagttaagctatgaggattcaaaggcataagaataatacattggactttggggactcagaagaaagggtgggaggggggtgagggataaaagactatacattgggtacagtgcgcactgttcgggttatgggcgcaccaaaatctcagaaatcaccactaaagaacttatttatgtaaccaaacatcatctgctccctagaaacctattgaaataaaaaataattcaaaaaagttttaataaataaataaaatgcatttaatatgttagagcagtcattctcaaagtgtgatttccagatctgcagtattggtatctgcctggggatttagaatacaagttcttgtgtcccatccgagaccaagtgaatcagaaattggaggcagcaggtggggggaaggaggcagcaattagtctctagtaacccctccaatcattctgctacactcccaattttacaaaccactgggatacaagcagaagatactattgactctttttatagatacgaattcctagtggattttcagttttgttttaggtattaattaatttgacaaatttgggaaaggctggctcacagctataaagcaccacttaaagatgacccaagcgtcttcaatgttggttcataatctttataatatttgggcattctgaaacaaaatcctttctctgattgataaatcatatatctgaaaaataatgttgaacttatcctttttgttatataactccttatacaactgagaaattagtgttaaacatcttatttgaaaaaaatatggggttgaatagaatttatatacatcgttcaactcatagttttgaaaatccatctcttctcaggtattgtaggattcttttgtgttgggcactaatatcctacaggcatagtgtaaatagttaccttaaaatttttatttcctttctaccctgcttttacatggaaaaggaattcaatgataaaataagaaagacattcacacttaggttggggagttggcacttttgtatggtagaattcagaagcagggactcttcccaagagtatgaagaaagcagcatatatatttaaagtatagtaccagctttagtagaaaggattatgataaacgtatcttagcatcacatataaaaatacaagaaaagcaaactgaataaaatacctattcacaaactactttataaatttttttcattatgttctcctggaaaatcatattatggagaatggactcataagtgctgcttttgtgctcactaatcatacttaagattctctttattcacctacgctgttactagaatattctgaagcagcatgagagcttgtatagcctttggtagattcaccatggactcaacctaaagaaactcttcctgcgtgattgtcactttggagctgaccatccattcccttactatcccttactattattcttaaatagcaaactagcattttgtccataaaccaactgcttctctaggactggctgattcgagaatagcctcgaagtctacaggaattagacaggttccaattttattagaatagtttagaagtcagaattttcatctaatgggagagtgggaagaaggaataataacgaataaggtatgggtctttgcaggacactcagcaaagcataccaacctctgcttgttgtggaataattttccgtcaacaagtaatgcccattaaaaggaagcatggctgtaacctgaattcattcaactcttttgttaaactaaccgtttcctcatttaaccagtgaccactatgtatgcttagcatatcaaagcaaagaatgctgtatacacagggcaaaagaagatttattgtaataattatcttcccagtcttaatcccaaagagtaactgtggctgcttctgctattttcataacactctctagatgcccagaaacccagtaacatggcaattgagaaactttatttataatattctatatattccatcattactcaaagacattctccttgagatacagatgtttaatgacgagaatgtgagtaattgatttcttggtgtcctgttagttatttttttgtgaagagctctttcctaatcagactggatggaacactcaggtcattgctttctgttttgtagagctctccaactattcacaggatgttatttttaatgacaaagttctcataaacaattctcaatagttttccagaacactagtaagatttttcacctggatgtctataataagaactaaatggaatcccaaaaagccatacataattcttacaaaaatgatgtattacacatatactcaatttttaaaaatctctaagttattgctattaagattcattaatattattgccattaattgttgctccccagatgcatggtgtacactcacaagtgtacaatgatcactggtatcctatgttcaggctgtaggggacaaaaagatgaaaatgtcagggagtccactctccatgtgctccccaaggccaaaatgtgagataagagatttttgaaacatcgtataaatgccaagtcaagagcgttctttgatttggaagttacttggactgatgatagaatacctccacatctgaattccgggtgactgacgcctgtcacccagactgaattctgggtggcaggcggaaagaacttgcccatctccaaggcccagggcccagcccatgtctgctttgtgagttccatcccataaatctttcccacaacccactggagctacagagctctcagccctaattaagtgtggtgtccacctagctacttatcacctataataacttgctgtttacaagtgccttgctgatatttcagtcactctgtactgttgctgtctaggaaaccattaatacgggtccatgtaccagatgagcaagtcattcagttgcaaggattctcttgtgacgtttatgcaagcagcaagccatgggtcctgccaatggtcagtggaatttgcagcctttctgcagccaatatgaagccttcaatgccactggggctctcatggcactgccacatgcttgttcctccacctgaaacatttaaaattaccattgtgggccgggtgtgatggctcatgcctgtaatcccagcactttgggaggccgaggcaggtggatcacctgaggtcaggagttcaagaccagcctggccaacatggcaaaaccccgtctctgctaaatatacaaaaattagctgggcatggtggtgggcgtctgtaatcccagctacttgggaggctgaggcaggagaattgcttgaacccaggaggaggagtttgcagtgagctgaggtcgcaccactgcactccagcctgggcaacagaacaagactcggcctcaaaaattaaaaattaaaaattaaaaataaacgtataaatacattaattaattaattaccattgtggtgggtcaaatggctggaaattaacaattccatatatttcaccagctatttctacaaatggacgccctatacaacccgacacaggttaaaataaacgacattccaagtgtgccctcctgctgctcacttcagttaacaggaatctttctctcctccagagtccctcttcagggcacttttcagttgccagtattgcccttcttgacatgtacttgctgttaagctgtgaagcatgtgccctcctgaaggatgcactgttccccttcacctttgtatcttgcagactcccttactccttgtgagtacttaatcattttttccaagagtcactgggaatcccgctgggaattgctaagagggagtagaataaatggttacgacacagacttaaggtcatactgttcatgctgcaatcttttgtttgtttgtttgttttgagaataagtcttgctctgtcgtccgggctggagtgcagtggcacggtcttggttcactgctacctctgcctcctgggttcaagccgggctcagcctcctgagtagctgggactacaggcgtgcatcaccacgcccagctaatttttgtattttcagtacagatggggtttcactatgttggccaagctggtttcgaactcctgacctcaggtgatctgcccacctcagcctaccaatcatgttgcagtcttaacatagttttttcctactggtttatatccacctgataatggaaataataagggtttatacttacctctagtatgagagttaagtaagttaactcatcaacaagtgctttgaacaggcaggggttgagtgaatattggctattattgttattatttaaaggggacaaatgctctaaacttgtctcatttagactcaggacttagccctttgacagaaataccatgagtcagactgcaaaatacgacaccattgttcttatccaaagcccgggatgcacaggcaatggatgccatcaactgaggagagcagcagcttgagaatatggagccaggcactgcccctggttgcatattagcctcacctggagtactccaagagctgtagacccctaggctctccccacagaccaatcaaatcaggctccctgaggttggtcccagggataagtgtttcagaaagcttcctaggcgattctaatattatagcattttcaggaaccactggtgcaaaacactcttggaacacacttaaaattacttttaacagtttggtaccggtttctgggataaaggtaaatagccataaagaaaagtcattcagaggaaaagttcttttccaaggtcatcacaatctcaggaaagtatcaccattcctgtttcttcgatctcctcacctgtggccaccacgataaaaggacataggaggagagaacacattttctaaattaagctgaaacttagtgaaaagcctgtagggatcagaggaaaagcctaactaagcttctagtcttagagaatgacgaacacacttgaacttgcatttttctgtacagggctatagacaaagaccaagaaacagttttcttgtctttgctaagggaacatttagataagacatctcaactgaattgactgttttatttgcccacaataagcctttctcagagcatcttaatccaaatgcatatcagacccccgcagtctgtgttctatatggtacaaggctcctaatcctcacgagtcagatttgtcaacttattatttattatcgaccccccccccccggccaaaagccttttccaacttttattcctaattgcttccctcaccccaagcaactttaccaccacagataatctgttttcatactgtggcctttggaggttcacagaccactataatatctaaagttttgtgtcctccccaattaaaaaaaaaactatttttgtccccgtagggacatcatcacccccttcctgttgaaaaagcacaatgtaattattaataaatggctctgtcagccaagaacatgacctgcagggatttacctcagaggcaacacaagagtatatgcctgcaaagctcagaccaacaaacacaatcaataatgaactgcgccagattctaacccggatccctgcatcatgctgcagggacccaccgcctgttaggacagaacgccttcttttcaaggaaggttagaatagaaaattataaaataaagaatgactctacctattcattatttcaaatgtccttttacctaatcattccaggttttcctgctcattttctgggtaaattctcaaaatgagaattctgagtattaattttgattagttttaaaataaatggtttgatgactagagcagccaacataagttggtgatatatagcagccagtaatgcaaaatgttttattattataccaactataattacttccatttacatactgctttaccatttaaaaatatgttcccatacattcctatttaaataatgagaaggtggtgaaatgatgtatgtattcaataatatacttaagaaggcatataatccagtcaaattattataattatgcttttaaaagaaatgaaaaggtcattatacactcttaattcagacaattttttgataaacattaagacaatgacttccatttttacccttgtctgtcaatcaaagccttatgccacttcttgttcatcacaaagccttgataaagtatcaccctacctctgctttacgtgggtcccccaaaacccacagcaacaggaaagggaggctacacttttggggaggtcaggatggggagtgcacaggatgtccctgcatttcatttctgaatgttatactcatttattaacatcaaatcttcacatcaaaatctcaagtcacatatataagtgcactggattgtctgccattggataaacatgtgtgcacctcttctacctctgctccaggaacaacaaacgagagtactgcaggttaagtggaatcaactttcatctatgtgactgctcaatcagctgcaatcaaaatcatctcatgcctttcaagtctaactttaaaagttattcaagggcaaccaatatgggcagggtcctctcatcatgttctatgtagatgaaatctgcaaacagtccaggctctgctacacttctttgggttgaaatataacaggaactaatcagaaaggttatggcagtgtcctcaccacttaaggtaagtgttctccacagatacagacattccttcatgtaagggagaccctgcaaggcttcagggcggaagacattccttctgactacatacaggtatctacagataaaaagcagtctgatgtagcttgtatagtttatgtttatgacaactagatagtctgatggtttcttgttgtcttgtttagttttattgcattttacacactcattgataatacaatgaattaggtcaacttctgttaaaagccgtaagtacatactggagctactaaaaccactgaattttacacttaaatgggtgaattgcatggcatatacattatatatcagtaacgctgtttttttttttttttaaacctacagcagttcttttaatgataaagatcaatggaattccattcaattaatagctcagtctaaacataaaggagattcataggcatttcaaaacagaagagtccttactcatgtggtttaatgccctgtttacattactaatgatgctctacccaatacagaccaataatttagttcaaagtggtcctaagtcagcaggatgccctcatactcggcagaataaaagatacatctttcttggaagaccataccttaaactctgacctcatgtaattcccataaataagttacaaggaacatgaatccacaatcggaaatcttacacacatgagaaaaaatgcctcagtgagcaggctgtcattaaaaacaataaatagaagaatcaaagtgaaggacactgaagattgttgaattatcagatgcagaaaaaataagggaaaagcatatgtaatatacttaaaaatttaaaggggactttaaaattaaaatgaagagttcttccattattccaaggcagattttttttttcttttttttttgagacggagtctccctctgtctcccaggctggagtgcagtggcgtgatctccactcactccaagacagatttgaataagaaaaaattgaacttctagaaatgaaaaatagaacttaaagtggcatattagaaacagcttaatagaacactgatacactgctgataggattagaaaatggtaaaaccactttgggaagtaatttaaaaggttaaggatatgcaagcgtatgactcaatgatgccacaactagggatttactcaagaaaaagtaacaattaaatcatacaaacacctgttcacagcagctttatttgtaaatagcaacaactataaacaattcaaatgtgcatcaactggtaaatgaatatgcaaattgtgttacatcctcacagtggaatactactcagcaaaaaaggaatgaactattgatatgtgcaattactaaaactgaatcattctttatgatgaaacacttagcaaatcagcaattaaaaggaatgccatgagggctgggcatggtggctcatgcctgtaatcccagaattttgggaggccaaggccagtggatcacttgaggtcaggagttcaagaccagcctggccaacatggtgaaatctctgtctccactaaaaatacaaaaattagccgggcgtggtggctcacgcctgaaatcccagcactttgggaggcggaggcgggcagatcatgaggtcaggagttcaagactagcctgacaaacaccatgaaaccccatccctactaaaaaagttacaaaaaaattagccgggtgtgatgacgcgtgtctgtaatcccagctacttgggaggctgaggcagaagaattgcttgaacccaggagacagaggttgcagtgagccaagatcacgccactgcactccagcctggcaacagagcgagactccgtctcaaaaaaaaaaaaaaaggaaaaaaaaaaaaaagaaagcaaaaaaatacaaaaattagccaggcatggtggcaggcgcctgtaatcccagctactaggagggctgtggaaggagaatcgcttgaacctggaaggcggaggttgaagtgacctgagatcgcaccactgcactccagcctgggtgacagtgagactctatctcaatcaatcaataaatcaatcaatagaatgacctgaaccagataaaatgagcctatagaaaagctacatttggctgggcatggtggctcacgcctgtaatcccggaattttgggaggctgaggtgggtggatcatctgagttcaggagttctagcagtgtggccacaccctgtctctactaaaaatacaaaaaattagctgggcatggtggcgggtgcctgtaatctcaggtcctcgggagactgaaggcaggagaattgcttgaacccaggaggcaaaggatacagtgagccgagatcacaccattgcactccagccttggtgacagagcaagactgtgtctcaaaaaaaaaaaaaaaaaaaaaaggaagaacataaagaaaaagaaaagctacattaaacataaagtgaccaagcaattctgcttgtctagctataaacctaagagaaatacaaacatgtgtgtccacatataaacttgtacatgaatgttcatagcagaattattcacaatatccaaaaggtagaaacaatccaaatgtccaccaactagtggatttatgtcattaaagtataatttatccatacatacttctccatatatatctatacatacctatatcattaactatgatttatccatacaatggtatattgtttggcaactaaaaataaagtccttatatttggtacaacatcaatgaaccttgaaaacatgatgctaagtgaaaagagccaataataaaagatcacatatggtatgattccatgtatatgaaatgtacagaatgggcacatagacacagaaagtctagggttagaagaagcttggggtttcttttggtgtgatggaaatgttctaaaatggactgtggtgatgcttgtaaaaatctgagaatatattaaaaaccattaaattttatatttaactggatgaattgcatggcatttgatttatatctcaataaagccttttttttctaaaaaaagccctgcagcagttcttttaatgataaagattaatgtaattccattaaataaaaaaggttgtctgctctcccccatttcttatcagtacaaaaagacaaaacaaaacaaaaattgtaagatttttagaagaagacacaatacagtaattttcacagattgcttatataaaaaccctaaagaagtctacaaattactagaggtaattagcaagtttagtaactttgcttggtatcagatcaacataaagaatctactgcacttctatataaaacagaaattcttagaagatgtctcttttttaaaaaaaagaacatttccaagagtaacaaaaactctgtggagcctagcaatgagaatgaaacaacgaacaacacaaaacctttctggaaaaatgtctaaatttcactgaataacatttgagaagaattaaatggacatcaagttcatgaatgagaacactcaaaatcataaagctgtaattctcccccaatttctcagaagcagactacacatatgtgaaaaattgacacaaggcagatatggcattaaagcttatgagacaaatgacagtctgctcaacagcaggtattaggagagctactttacgtgaaaaaaagaattgaatctatgcatcctaacatgcgaaaaaatcaatgaaaaatagattaaagattttaatataggtcaagcacagtggctcaaacctgtacagcactttcggaggccgaagtgggtggatcacctgaggtcaggggttcaagaccagcctggccaacacggtgaaatcccgtctctactaaaaatacaaaaattagcgggcatggtggcaggcacctgtaatctcagctacttaggaagctgaggcaggagaattgctttaaccctggaggcggaggttgcggtgagccaagatcacgccaccgcactctggcctgggcgacagtgtgagattccatctcaaaataaataaataaataaataaataaataaataaataaataaataaataaataaagtaaaaagatatagctttacaattcacagaataaataatgggaaattatttaaatgttgttttaattctgaaaattgtttaaatatgtcttaaacaagactgatcaacctaacattaaaaccaagcattctattcatcaaaggacactacagtgaaaaaaagacacaaactgggggaacatgattctaatacatacaactaacagattagtattcaaatatattcagaattaaaataactaaaataaaagacaaaccaccaatagaaaaatatgctgaagacatgattaggcatttaatcgaagaaaagacatgagtaagtgacaagtgtataaaaagtgctaataatgcctaaatcagggaagtgcaaacttcaagctcaccagatttgcaacaacagcaccaaaataattaggaaaatgttaagttttgctgaatatgtgcagcaatggattacatattgccagtgggaaagtaactttgcacaagtacttttgaaagttcttttgcattatggagagaagttgaggatgttccaatcctacaacccagtcatttctcttctgtgcccgcccaagaaaccacttgcacgcccacacaaggagactcatatgacaatgtccctagcgatatatttacagaagaaaaccctgcagactctgcaaatgttctcaggagaaagtgtaaatgccctgtggcatattcaaatgacggagtaggagtcatcagtgaaagaaaaaaaaaatgcatgaactaccagcacccacgacaccatgggcaaatctgcacagagtgcagcaaaaagcaaggtgtaaagaacacataacatatttatgtaaaattcaaaatcaggcaaaccacgtaatactttacttattaggatgcatatgtgtgagaaaatataaagaacttcaagggtacaaataaacacaaaattgagaaagctgtttgacatagtggaagagagacaatgaggagggggcctagaagactctccaacaattactggtcaaattctacttcttcaacagagttatagcattttttaaaaccatgaatatgcaaatactgcatatttgcaatagtacatatcatagatttcattatattatgcatgctactatcttaaaatataagatttgtttctgaaaattatatttgtatagcaaaatctcaaacaaattctctttataattagagccttattaatcaatgacaacattttaaaaatagtctatgatgtagttcagtataatatttttatttggaagtatcttatcattgtgtccaattaacacctcagagctatatttggttttgtacttttctgacacaaaatgtaacaatcttcctcaggaacaacgaaggaagttaaatcttccgtgtaaagtgacaaatccaatcctttaacagaaaaaccactcgtttctttacattttgtttcttaaaattcccttattttgtagttgtcaatatttctttaaatgttttaaatattctgtggagtttatttctttattagttgattatttatttgttctgactccaagatctgcacataaaactaaattctgattaattttcttcctctggaatgctagttcattagccaaacataataactgtttaaaatggtccagttgaagcttaaaatgcacttctgcatccctaccccaaaaggtagtttaactagaaaagagttaatttaaatttaatttcttctcttgaattttgatcttgcacttgctgttttatcttggtattaattggcctgtcatgcttaggagggttagcttgatatatgtcttgttattgatacctaggaaagtatttttaaccagcacaaggtcttgctatcatccctgctaaggtatgcatttaaggtagcataaagactataggttgcttgagggcaggcagtttttcttatcgggatctatatttggcgtctgtaacattatatacggtgtctgcaacattgtgtaacacatggtacctccacaattcatgtgttgaatgaacaaacgaatggatggaggaataagatttcaccctctttcccatcagagcagaggatagcacaaactcatactcctatacatttgtccttgattggctgaccccagcatccactcacccccaacaggcagactccagattttagatgcaaatcctggagaatgccatacatttccataatcccccaaataataatcccccaaatatccacaggctttaaacacattcaaacaattccagtgtttgggtaacactgaggattttctctattcccacattactctctttggtaaaattcttttctagtaccaggttaccagggaattaaatgaagcttattggtagtagaatatagaccccaaaattgtagggaccttgagcaactatccacctgagggcaataccattttcatagtgatgagactgtgtcctaaggagtgtgatattttcatgtatcacagctatgttatcatacacatattactacatattaatttaagaacattgctgtactctagtgttctttggcaatagctacaatacttgtctttagctaactgaagacatcattatcattcactaaataaaagaaagaaggaaagccataagtaaataatgtatctgtaaaaatcagggcatttcctatctattcacgcatataacatgtcataaagatgttatatatttcaattaattatttaagaagagaaagagcccacatgtatggaatactttctcagtgcctaacaccatgctaattgtttgaaaacacttctacattaatgcttataacagatttctgaggtaactgttattctcccgaatttacaaataggtaaatggggtttaccagtatactttccaattacacatcactagtaatatgcagagctgagattcaaatctcaaagtctatggttccaaactccgttgtcttcaccaccaccctggctactacctccttaaattagagcttcagaatttgttgagcatttatgatatgacaagcaatacatgagtccaaaagacaaaattgaactctttaccttaaatgagacatgtcaaaatgacgaggacttcccaacaggtggatgccatcattcccacattagggagagaaggttaattgttaaatttcgaggaaagttggcagtcaatgccttggacagatcttttcaataaaatcttgctgagagtcccattctcaaataagtgcataagacaaaggaataatgtgtgacaatttttaaacttcctcagctcttgaggtactaaacaaacagatgtgtgagaagactgggacttatgaatacagcgttactgtcaactaattaggcgacttcttctctgcctgctgctaacacagcaatctctgaaatttaacattccatgatagtttctcctggataaaagggaattagaatacattcacataggatgaaaattttttaaaaatcaaagggttcttgttgaaaatggagaatggttgtggtaaaagttaagcccacaatattggattagcctaccaaatgttttgttaaatgtttttttgaagtaagtaatagcttcccaatcctgccctgtgtcctttgacaaaagtgagcctccagatcttctcagccctagctctgcagcctctggaagccctcgttaccttgggtgaaatttttctgacctacctcctgggtaaggccaccctctctaacgtgcactgtggagcagcctccctgggcttccatccctcctcttggacactctattgcctactcagcaacgtgcaaagtctctagctggatgtgcagtacgtggcctctcaaagaatgggtatgctcagtctccatccttacccaacaccagtgtaccccatcggctccatttcaaccatactgatcccaaatagcagtttgtcttttgactgttctttccctctgagcaatgcctttaccccatttctttccctgccaatattttgcatccctgacaaagaaatatccctctgtgagccatccccagcaccacttactggttttttttttcacagcagcaacatattttatcatgttttagcatatttatgctttttcttttttctttttttttttttttttttttgataagggggtctcactctgttacccaggctggagtgcagtggtgtaattatggctcactgcaacctcttcctcccacctcagcctcctgagtagccggtaactacagatgcatgccaccacacccaactatttttttttgttttctttgtttgtttgttttgagatggagttttgctcttgttacacaggctggagtgcaatggtgcgatcttggctcactgcaacctctgcctcccagattcaagtgattctactgcctcagcctccccagtagctgggattacaggcacccgcctccacatccagctaatttttttgtatttttagtaggcacaaggtttcaccatgttggccaggctggtctccaactactggcctcaaatgatctgcccacctcagcctcccaaagtgctgggattacaggtgtgagccaccacgcctggcgtttttcaaattttggatagagatgaggttttgccgtgttgcccaggctggtctcgaactcctggcctcaagtgatccccctggcctcaagtgatcctggcctcaagtgatcccctgcccttggcctcccaatgtgctgaacccgaacctgagccaccttgccctgctgcctctgtctttatttgacagtaaaaccccagaaggcaagagccacatcgtagtcatccctgaagcacaaggatcactttaagacattaaacccttgggaatactacataagcatattttcttttaatggaaccaaatattatttcttaaaaggcccactccaaggtatccctcagtgtgaaacactattccagttccttagctttagctcaagttttagtcaaactggaaaacattcagaccatatgaggcaacttacaatatacttataaatttcttttaaattgtgttctccctcatataaagttcatgccttgacctaacaggagatttctatatttaaaaaaagctaaataaatctatagataattcatctgctttccttgaaagtactaaatctcattacttttttactaaagttcaattaatgtccccatcctaaaatattcagatgaacagcaccagaggagaccactgggaaaagccaaggctctttgtgtgtcctaatttacaggtgagcgaaactgagatacagaaatccaaatgactaccttaaaggcacgccttaaatgtgtcgctgccaagaccacaatcttctagcactcactgcaacactttctgctataccccccttccttttccatccgaataatctgaacacttggaatcatgttcatggtggtcaacaagctgtagtcatcccaagattgatgactgacatttcagctgactttcctctgaagcacatcaaatgctcattgttattttgttggctaaaatatcactgtttccaatgttctataatgaccataaacaaacaaacaaatatgaacatgcatcttggtaaaagcttttggactctcagcatctgaaggaagacagagtggatatgatggagacacaaatgcctttctactcctcgtcatatttatacacttacagcagggagaggaataagcgtgcatgatttgggcaatctcttcctctcttgctgtttgctgtttgaagagtatctattcaaagagtcactgacttctatatattaatttattatgcattccctattatacatatgttattattgcactatcactcttctttttactatcacacaatattgaaaatctcatcttcagttccagcagtgcgcatggagacctattaaggtggcctgcgtgaaagggaaattgatttaagctttcttccatctcatcttgtcaatttctgtgtggttgtctagactatattatgaaggagacaaacatggtactactctgatacatctttttagcccacaatgagaggaacaattttataatcttctgtagaaaaattagaaaagagacttcaatgaaagatgttctgtgtattcatcaaaaagggaaaatacacatgattcactcataacagttggtatgtgagatggtttacttacatttctcacttagccactgcaaatttatagaagagcattatccccatttttatagatgaaagaaataaataaaagataaattatgactatatttcaaggcaaagctaggaaatatcataaaaacataacaatgaaatttagctatcatttatggaattacaaactccatgttttggatctatgagtctgaaaaagctctaagaagaagagaaaatataaagaattttcaaccctaaataaattcataaagatttccagttctctactgattagaatattaaatttcaaaattcattagagttagtttttgtaaaacatctgtttatactgcaattcttctaaataaaattagttatattgattgtttttagatgtaaaattaatattagctttttgaagtaagatgacatttaggaaagaaaccacacttcaaaattgatataaaagcattaagatacagtaattgatgtaagaaatatgtcaaataattataaccataaagtattcaacctttctaaggccctacatcaaattctttgaacagctgactatttattattctcaaataaatttagaactattatacgcttaatatgatgactggtattttatagacaagaatattagtataatttgtcaattggcaatttgcaagaattaatatgaaggtaattatactaatgataacataaactcttaagcttttaatttgcataaaaataaatctcaaaaatatattttgatgaagaatctcaaaacaactataatcactgcagtgtatggaaaggaaaagaagcagaatatcagttcaagaatgttcgcatccctagggtgaaaacagacgagagacatttaggtgactatttacaacacaattcaagatactgtgttagacagaaggacagccttgtggtgtgacatttgaatgcatgtgcttggggagtacagatgcctagattcggaaatcaatgtctagacaccattgaatctatagaaagtgattttttttctctatatctcaatgttctatctacaaaataaaaacaataagactttaaagggttaacgaggatgacatggtataatctatctaacccatttaattttgtgtctggcctagggaaactgctcaataaactctgcaattattattattaaaattattagtcattactattgttagaactactatcatccttttcttaagatcagagtgaaagtatgagactaaatcaaccatagttccacattcggaggacatcaagctatctggccctggaatccaagataccacgttaacaagtagatattttcatgaaaattaactatgatgaatatcaaaatgtaatattatgacctagcaagatcagaataatatatactatttaatgtactgtataaatcaattatatatataaatatatctacatatataatacatataaaatgtacataacataaaaaaatgaataatacaatagataatatgtatactggaagatataaacatagaaatacttaagattaataagactggtgatactgccaaacaataccaatgagataagaacagtaataaaatcactgtatgttcattcgtctgttcattcatttattcattccgcactgattaaataaatgaatacagtattagttgctgtgtgctggccactggtttcgcatatgcttgtcatccccgtcctggagaaattacttatagactagccaaggaaatggaagagaaacagacacctagttctagcagttgacaaggctcagcaaagccttagtatgggaggcagcagctttaatccagtttgtgtattttgcttcaggattaggagatcaaagaaaactggggtactatatagacatggctcagtagagtggccttggactcttggctagatgagaaagtctcagagcactagtgactacaaaaaaagagaggtttagaggaataagagcttccctgttaaagaagcaacggctgtaaatgctcctgctattcgggaggagaaagagaatgaaaacctgaccagaaatttgatggtgcttgggaagcatggagatgaatcttgaggacccaaaaagtattttagaatatccctcctgctttatgaggaaaaaggaaagactataagaaggaatcttagaggaacaatctcagcattaaaaggcaaactacatgaggttagaattaaaataaaaaaaaacagaaataatgtgaaagaataaaggggttatgacaagaagaacaatgattcataaggagatttttgaattaggaatatttgtgagggaaggttctgctctggaatttaaattggaagaaaacaaagacagaaaaacttggaaaaaaacaaaattggcaatgctgagaagtctccaaaatatgtctatagtccctctaatttgttcttctggttttgtagtgaagcagacactctcaaagactttggaaatgactactgcaatgttaattctgaatgacaattcaataaactaattgtcttgtttaaataaatcagtacaactttattggagcagtaataatttagcctcatgagaaatggtttttttcctagcatggaaactaacaattactccctaactttgaaatagaaattatatttaataaaaaatttccaaaaaaatgatccaaaagcaatctaactttttttttccacctggcaaatgtgtactcgctgtggtaaggatataaattcctatggctatggttggtaaacagtaaaaagcatattcttcaatatataagatgtctggtttccaaaaataaatattttggcaaattgattatttatttaagcaagaataaatcaaattatttcaatattgtatcctgcagaagataatgaaactataaaatgtcttactttgtgaaacaattatattcctatattatttatttcctcatgaaaattcacatttatcatgcttttgaagaaataaattttattctcacaaaatgtatgtgaccactggcttctgtttcttcactaaatactgttaactattaatatattaactggaaatcagcatcttctctaaaataagtctgactttttttgcatatgtggaaaagatttttagactctagttatagaactgttggcatttgggctcatgaaatttagctaataaagagaatggcctttgatagtatttataacacgtattccttttgccccctaatatccaaagtatggcagactttgttggaaacctctctttgcaaaagttcaatagttcaaaggtgggaagaaaagaaagcacttccttatgtggagcaagcaactgttaatatttattacgttttatccttttaggtgtagctaacaacatcaacatcttgggaatctatataataaaaatggtggggttaaagatgattgctttatttagttgtccttattctatagtaaaccatcactccactccagattcaaattctaccacttctcagaatcaaagctacagattagcttttgagtacgaatgcatgcatatatgcctgaaaaataaaatagggtatatatattaaacttttgaagggaataaatattgtcacagaataaaatttattttctctcaaaaactttaataattcagctttttgtaatatatatctaacatgaccgattacaaagcattgtattacttttctatcatgcataaccaatcaccaacagcaacgttcactgtttcagctaacagttttataagttttgtcaagtcagacttggcaggcaagtcagacttgtaaaactctgtttggagttttacaaggctatcatcaaaatttctcaagggctactttctcttctgcaggttctggggaatcatcccctttcaagttcatgcaagttattacctgaattcaattctttgggccatcagatcgaggttctggttttcttgcaggttgtgagttcaggatcctcctcagcatgtaaatgccatctgcattactagcccacaaagcccctccgtcttcaaagccagcaccagataatttatcttgtgtcaaaactctctagcttcgaattgaattttctgaattttcctttgtctctgacctccagacccagatttaaaggacttgtgtgattaggtcacacccacccagataatctacctttcttaaagtcaaccatgctatataaaataacctaattaggagagtgaggccccttcatatttacattcctaggattatacagtctgcgaaaaccaactgatgacgggaatcttgctggacaccttagaattctgcctacctcaagcagcaacgaattttcttccacctaataatccttggaaccatgctgggaatgagggagttattgaagagacatacacatttggaatctcttgataatccaggagggaattagcctagcggaaaattccaaagaacggttcattttctttaggaagggcacaggttgctgcccattggcaaaaatattaagaggtgatttccaaaaaagacagaggaattatttcaataattaacaaagggggaggtgactgaaatccataaatctagaaatccatagcgaagttggttagtttcagaaacaatgtttaatggaaaatggtacaaatctcaagactacattttggaaattttcagtcatcatttagtcaatcaataagcatttactggggaaaagttccatggcaggtaccatcttggtgcaggggatacaggaaagaacatgtcaaggtcacgtacagaaagggctcacagtcaagggaaagagacatttacctaaatgcagataatggtaatactttggctgtgagaaacacgtgtgtgtgtgtgtgtgtgtgtgtgtgtgtgtgtgtgtgtgacacacaaggtctcactctgttgcccaggctggagtgcagtggcacaatcttagctcacagcagccttgacctctccgactcaagtgatcttcccaacttagcctccagcgtagctggaactacaggagagcatcaccactcaaggctaattttttgtatttttttttgtagagatggagtttcaccatgttgcccaggctagtctcgcactcctgggctgaaacaatccacctgctttggtctcccaaagtgctgggattacaggtgtaagccactggcctgtgagaatatattggtaggtatacacaggtgctgggtggggcccaggttgtcaggatcagggtcaacctatagctttgagtgcaagaacatggagtttggaacctgtgactgaggtctcgatctcagctatgcacttactgtctatgtggcattgtgaagatatttaacatctaagcctgtttcctcatctatatgacgtgagaatacttaccttgcaagtggtcgtgtagactaagtaggtaacacgtaattgggagctgttaggttctacactagcaccactaccacccccttttctggctaccaaatgtatatttggtttgggcatcattgtgcaaaaccattgcagaggagtctggaatttacaagatcccccagggtatggctggccaagtgaggccctctgggaaacatttttcctatattttcatatatcattaattatagaattaatatactatatacctttatatttgtatgtgtatatatttatacacgtgtgtgggtgggattgtggaagacagacagataggatgtaagtcccttccctcctttccagttctacatgctcacaagtgagactgtggtgccttacaaccatcaggtgaatgcttgggaatcagagacgttgacttagggtcatggcaccattgagacatctaaagaaaagaaccctgtctaccttgaggcttcatgttaactaaggctgagacaataaatgtttccactgctctactccattttagtccaatattctatgctctccacttataccacataaaatgaatttagcacgacgctttaaactgtgatcccttcaatagtaaaatggttgttgttctatcttctatacctaggtcttacctggaggattcacaagggtcagagcaccccaagtctccatgctatgatatcttgcctgcttgcccagccttctgagacgcttctccccagcctcctgagatccttctccccattggagccttccaggagtagctggagggtgcacaagggcatggtgcatataatcagaactgccacctgcttctctgcagcttgctgttgtcaccatctttctccttcagtgggggctgtggctctgctgtccttgggctacagtccacatcctcactgctggacaactgacaagtaaagttccttccctctacggccttctgacgcccagtgccagctctgctagagaagttacctcagcaaagccctgagactaccagtgacctggctgcagaggccatctgcagggatggtcaccctcacgctgtgtctgattcccctgccccttgcagcctccacctgctttgttcaatgtggcccacattgccagactcctccacgtccttgcaaggatccattcttcctgccttgctctgctgtggcttcctaattgacgaagtggagacaatgatgacacttaactgaaagggttaccataagcatgaaatgaggcaacatgtacaattcttcaaagagtactagccctcaggaaaaactcaggaactgctggcctcactctttataattgttattattgtcataaatcatcatcattttcatcagcataagtcttctaagagttatgtgtcatttaggagcagtccatagatagatctaactgttggtcacactcctcataattgttgctattgtcataaattaccctgatcgtcaatcacaagtctttccagagtcaagtcccctttaggagatgttcataagagtggtccaactgtgatttgaattccatttctctaccattatgttactgatgcctatggaaatcaaggaatatgtataggtacctattaggtgcccttaaattttcatcaacacttggagaaatccctacccattctttgactgaaggttaaaatattctgtggtagggcacttatggtaaagtcaatggagtgatagccccaacccttctccaacactttgtgaagttacaaccactgccaacagtccagtgagaagaacagaacagagaaacagtccagtctgtgctgatcgagaagacattcagaaggatatgagccctgaggtgggtcactagatccataggcagaggtaaccatgctaaagagggaggatattctaggaagaaagcatcataggctctgagatgagaaatcatcatgcattcatagaactgcagaagtggggaaggatccttcacagacatggttctggtttatgtatcctgcagatctaactcacgccgtgtagaggatggacttgggctgaatacagacagagggatgagtctgaatgctgttataaggttaacggagagtatgacaagggcaggtactcaggcaggtctccaggcaggagcctcaacctggacgaggactggatggctcattaagctgccggataacacctcattgacaggcctacagcctcaggaatgggccttgggctgagcatgagccagatcattgtactggccagaggttagggctggctactaccaagagggacttgattatcatcttaaataaagcaggacttgatcatgacccttcataaaaaagcatcatctgtatagtgttcctgcctcaggtctgcatagttcttgggaatcatgaagaaaatatgaaaccaaaatctctatttgtgggaaagatgaagaatccaacagctttttgatctgaaaataggttctgggtgaggaaagccaagacagaaatgagataaggtacaaagtaaacctttagctctaataaaaagcaccaataacttctttccagatgactcagaacccttagacaatcactaaacagtctgaattctggaaactatgatatgcatttggatgtttaggaaagtctgtgaagagattaagagaacacaatgttcccatttgcagggagttataacctacagaggtagatgcagaagctgatctgctgcaacaataaagatctccagattgcttgtcccgcaaattcctagcatcctcctgtactattggatggactgttaggaagttgacttgtattacaaatgcatactgataatttttttttaaagttgaaatgttgatgtgactacctgaaaagagatctttggctgggtacagtggctcatgcctgtagtcccagcactttgtggggtcaaggcaggcagatcacttgaggtcaggagttcgagaccagcctggccaacatggtgaaaccctgtctctacctaaaatatttttaaaaattagctgagtgttatggtgcacatctgtaatcccagctactcaggaggctgaggcaggagaatcccttgaacccaggagggggaggctgcagtaagccgagatcgtgccacagttgcactccagcctgggtgacagagcaagactacatctcaaaaaaaaaagagagagagatcttgggaatcagataggtgcaattcctaccaccattaaagtcagagtaaaactgaagtatatttattagtcatttctacctcttatatacaaatatgtctggcagttgtgacttgattttgtttcttttctcctaagaaactcttttactcactcgctagtatcattaagaggtatgaatcaacatcgaaattaccagacttttaaaatagccctctttttttaaaaaaaagttgacgttctatttttgtttaaatatcccttttgatgtgctaactaggttagtctatcacctttaatgaaaacttgaatttctaaaggtgcatttctaaagccaagaaaacaagtaggttatgacaaacaaacaaacagtggaagtgatgctatgcatcaactgttctccagagaagtatcaataaattgcttgtagttatacaaatgcagatgcatacattagagatttccaaaatacaaaataattaagcttgatgaagactgatattatatatggcaaagggaaatatttaggcagtgtcatcttcactcaacactattatttagtacagatttaagacagatttattgattatatatcataagctgtaagctagacatacaagacacagtgtaaagaaccaaaagttgtcatggtatcatttttctgtctaccttggaattaactgatgtattttattcaagacactttggatgtaataaatgaaatcaacttgagatgaatcaaatcaaatgaggaaagaggacaggttttaagaaggtatcaggtaatgtcatgaatgcaacatacatgaaacgtacattaggcagccagtcctaatgaaaactatacggctctcactgactttcagggccatatggcttctctgttttgggaggctcactgttaccacagagtcctccactagcacacaagccactatggccaccattgccaagcacccactattgtatgtcacagattttggcttgcttatttcatatcctccagagtaagagcccatatactcacagtctggtcaggtccatttacaatacaaccaggaattggaaattgattcacaggttactaaacagttccctagacccattcctatcaggggctggagttgcatgaaaccatgtaaaaggtatacaacatgggaaaatgtcacacagaaatatcaggaacatgaactgaaaaggtaaacagaccaatagtgaaacaagaggcttcaaagccaactcgacatcaagtcaatggtgcatatggacctataaaatctggcaggcttagcttttcaagtgttcagctttaataggaagctcttcatgtatataaaattagatggagtaaagcaaaaatacacttaaaattattatttttctctctccctaaattcaccaccttcaattagtccaacttataaaaccaacttcaagtgaatacagtttactttttgttttcattatccatcctgctttggttaatctggatgtttaggcaagtctgtgatgagtttaatacaccatgatgtacgtatttgcagcaacatatacatttggatgcagaagcagatgctttcacatatcctaaataaggttttataatggaaaataatattccatccacgtggttaaccccgcttaacaacagagagtgcagtgctttctatttaaagaaaaaaaaaacactaagcaatgttaaaaagtttaacagcatgtgactccaatacgaaatgctgcaattacaaagttatactcttacaaatataaagtattttggaacaatgaatacaaagacatttttattcttttgtggcagcaggtagctaagagtcaaccaaactcatgttcctacttctgcagagtggctgctgaccccaggactctgccccacttccatcgatgagaggtcatgtgactgaaattcactaatgaactctgagtgcagtgatgcaattgatgatgcaattcaggatggagccataggggatggcaaggtcatcaagttagaaagagggcgtgagtcactatatggagaagaagtaggcttagttggctaccttagagagaaacaaactactattgtgttaagttcactgcagtattcactgcagtttatttgccatagcagccttggttttctccctaaaaatgtagtagagtgccaaaaacacaccatctaacaagagcgtttttgagaaatggaagttaagccttatgtctctttcacacacacatgcacacatacacttacattttcatatacgaaagcctggttctaaggaggataattttattttgtggtcaagtggctaaaaagttataggctttaaaaaatatatatttcataatctcaaactaatcactaattgaataatcatttatgtttatgaatgaggaaatatttttacacatggggaactgcacgtgtggttgatcttcaaggggcaatttcataacttagcattatgtattagcaaaaacaatactggttccaccagaatgttctcacttttatttcaggaacctggagctctggatcatttacgaaaaaaaaaaaaagtcccaaactcggagactgtgacttggcatctcctgatttccagcaagctggctgaatgcaaagccttcctttgtgtaaaattacgtataatttgcattcagggcaggcattaattttgttaaaagagtttcaaatacaaatcaggacattttggacaccttttgaacatcttaaatcaggtcagttacaatttctttccaacgtttgactgaatgttccaattccaccaccgggttggaaagaagagaaacatcacgatttacttgcaggggcaactcaaagcacagacaatgaacagagcggcgctagtacctcatgctgctcatgctgccagtctcggatccgagcttgcatcgctccagctggctggctacgatctgccgttcagcctccagctctcgggtcagcctttcaaactgtaattcctgaaagaaacccatcaacaagatcaattcaatcatctacatgacaggtgaaattcagaccaaaataataggacggctgagggagaaaaatatgattttccaagatgtcaaatttgagaaatgtgcaataaaactaggattcgaaggttagacaggcttgtggcccactggccatgcaactttgaataagttaattcatgtaagtatcagtttcatcatttgtaaaacagacttaaatacttatttaataagatggatatgaggattaaaggagatactgtcatgaaaaattatcctgtgctatctttggcagacggtcagcacccaacaggtaccaatactcctgataccacaagtatagcatttaatgagaaaaagagttcagtttttaattatcttttggagttttgtgtttattccctactggccttctggccaactctatagtgtttactgctttcttcatattacttatatattgtagattgaagaaaataatgctttataacccacactcttcataactttgcattccagcagaatgacaatgataccaattctacacagcctcattactaagtacataacctttgagatatttgatatatcgccttaaaaacagacaattgaaccaatgaaaaatgcttctacaaaactgcctcaaatccactgttgaaaactttaatgaatgattcaatcagtacttcaaaaatctcagctgttccaacaacaggattttgtaccatattttactactgatgttttctttcctcatacacttaagtttttttaaaaatgaaaataaccagagcaaatcatgtattttaataaggaatggcagggaaagtttttacaatgtcacatttaataccttttaaaaataaattatctaaacagttatgttttggggataagaaacaagaatgctttctcatactgaaaaatagctcaggagtcagttttggagaatttaaactcaaaaggttgcagggatatatctttccagaaaataagattttatttacttgctaccccaggacactcttgcatgaggtctttaaaaagtagaatctggtgtgtcccctatatacattaaaaatatcctggctcttttccataggtgcacattttaatattgacattattttgggaaacaaagtaaaagacactttgtaaatgagagcttaattttccctttaaggtgctgaaactgagggaacattttgttttttaacctcaaacttttattcttacatattctgaagggcatcaaagtattatagttaagaaattaacaagatctcggctgaatgtattttatgcatctaacttcttcttctctcttaaagtcctactgcttttttttctttctggaaatcccttttcataatatccaacttttagaagattttttcacttctagacttcttaacgtattgcatcttaaatctctctgtgaaacaggaaactcacccatacttttaagttgataacacttttaaaaacataatacttgaagaccatacagaactcctcacatgtcgatggaaattcattctttgtagcatctaaagtactttgatttgctgcccactttcctgtgttaccgaagttcaacatggtgaaacagtgcagtatttggagtcagaattcatcaaccaggggcttccgctaggacggatgttgctcttggtcatccccgcttcaggtggtgacttctccatggtttcacctcttgtcagtctcacaggaggggtgacaatgggagatgactttctcgtttgcaagcttccttcccagcacgcagtcagattttccaagactcttcatccattcatgtagatctgtatttgcatctggctttattttccttccctctgaaagaacaaccttagagttgttattatggtgcagttctttgggtaaagaagtcttccagcttgacaggccttcaaaaggtatatatgtggttctcattttggaagacgtttttgctctgtcatcctcttgtttgcactgtttctaacaccaccaccaccacaaaatacagttacccttaaatttatttctctatatgtctatagtgtttattttgtatttttttattttttttttaattgagatggagtctcgctctgtcgtccaggttggagtgcagtggcacgatctctgctcagtatatagtgtttctttttaatttttctctgcttttaagattttctctttaccagaagcactgggcaatttgatgattatgttgcttggtgtagttttcttcatgtttcttatgcctgggttattcagcttggatatctggctttatagattccagcatatctgaacattttaggccattatttctttatgaattgtttttctgttctccattatttcctttccttcaatgactccaattaagtgcattttaggccacttggaattgtcccacagttcatggattctcttgcaattcaattttttttttccttttgtgtttaatttgggtagtttctattgttgacttcaagttaactaagctttgcttctgcaatgcttaacctaccatttatcccatccagtgtatttttatatcagacactgatgaatcaaacatctctaaaaatttcatttgggtcttttttgtatcattcatgactttatttaactttttgcacatgttgattatacctatattaattatcctttttgttaattctaacatctgtgctagtttcagctgattgacttttttctcctcaatctgggtcatatcttctgctcctctagacatgtaatcatctttcaacacagacattttcattttacttcttgggttctggataggtttgtattcctataattgtcttcagctcttttatgaagcacattaagttatgtgaaagcaatttgatacttttgagccttgctttttagatttgttagggggagcagaacagcatgtagtctagggctaatcatcctgccctatgaaggcaagacacttctgagccccaactcaatgccccatggactatgggttctcccagcttggctggtgggtgctggcaaacattcccacctctgtgtgagtaccaggcacagtttcctcacatcctttcagatggttctttccctggtctctgctagtttccttacatacatgggctgctaagttgtttgctgaatatgagaaagggcaccttgcctttctgatatttggacccatgaactccctggactctcagcactgtcttaactactgagaccctgctaggcttcctcctttctgcactgctgtgtggaaactctctcaaggcaatcatttcctaccttaccccaagccaagggtctatggcttacagggaaaactgtttgggccttgccacaccactgaggctaggatctgtcaagatgtaaccaccctgaactggaatggtattctctttggagttgataactgagcttgtgaatggaaacaagaagagctagaatggaggttctctaacttggaaagactgactgatttttcaactgaggattaatttttctccttggtatagacatttttgtggcccaaaggcatctagagaagacacagcattttcacaagaatggatgagattcttttgcactggaggatacttaaactgtggggtaaatggaaagatgacattatccatctctaacacagtttggggtttgagggaggacagacctctcaggaatgaataagctgctgagtttcttggaaaatttgagatgaaacagcattcaagagagggatgttgctaataagggcaggtgagtatacaagaagttaactggaaaattagaactatgtgaatatatttactgaaacttgtaattctggttataagtaaatatgtagtactaaactaattcagcaaaagtgagactgtcaagaaagaagaaatatctctaaagattatctagatttgcagaatagaagaaacaatagaagccaagataataaatagaagagtaattctggggtaaaggatcactagtatggccttctcctgggtaattctggtggagatgtggtgatgtaaatcaggctgcataaaatgtaatacagagactgcccagagacattaagatttcatgggaatttagagtacctggtggtttagagaggacatccaatggtaaaagaagttataagaaaaagcagagcagtgttagaaagcctaaatctccccactatgtggaaatcaacttatgtaagagatcataaatattcataaaagtattggagatatgatgcaaaagttcattaaaatgtacaaagaaccagatttaaatggtttcatcctagaatagcacattattgaaccatataatacattaggattattataagaaaaattatcaaacattttataacttttcctaaacagcctaaattaatgatttatttggtttaattaaatggagtttattaaatgtttttaagtagataaaagcatgtaaagtctcttggggggacttagctaacttagtatgaaaactgaaatcagaaaactcatcgccatagtttcattacttccctcaataaatatgttacttaactttgtggtatagcattagttgggatggtatcatccagatttaaggaagtataaaaatggacaattgttaagtcttaacaatattgaggcttcttcatttctatggtctaaatgcctgtgtctccatcccctgcccaagattcacatgttgaaatgctatccctcaagatgagggtattaggagttagggcctttgggaggtgactagatgaaccaggaagtgggccctcaccagacaccaaatctgcctgcaccatgatcttgtgtttcccagtctccagaactgtaagaaatgtttcagctatttataagcaatgcaatttatggtatttggttatagcaacctaaacagcctaagacaagatgcacatactattttttgcacagtttcatttccattcacatacaacattttgttttccctaagttaagaacttggagttttttgttcctttgctcagttgtctatggacttatcaaaccccaaactcctccgatttgtataaaacttctcttcacacaaacatatgaaataatatgtcaactactgaagaaatctctcctggagtttttgacctgctccaatctggcctggctgccttctttgcacagctgtcttctgggatctctctccatcttcaggcgggagatttcctttgtccctctcttccgtggattcctgtctcctctatgagttgtcttcttcattctcctactttatttccttttctggtagaaaatgtctttccagatacacagagatagagagaatgaatgagaggtattatgttctgacactttgcacatctttatatgtttttattctactctcacacttagtgaataataggacttagtaaagaaatagagaattctaggttggaaatcattttccttcagggttttgagacagtgattttttgcttcattatcttctactctccaatgttgctgttgagaagtgtgaaaactttcagaggttttcttttcttttttcttttttttttatgaaatctgctttcactttctcccagaaaacatgttgtatgtggtgacatatcttgatatacctctatttttagacatgtttgctggatattttgtgatctatttatttagggatctttcgatcaaaaacctattgtttattctaagcaattcttttgaaaatttttaatgcttttctcctcctttttaacattactcttgctttttcttcaactctcattattcagatgctaaaatctagtcctcaaggtttcttcctttagtcttcttctcttgtattattctgtttctttatcttctgttttactttctgaaaagttttatcaatttaatcatgtaagtctctaatgaataattcattgctattattatgcttttaatttctcggagctagtttttattctctgaatatttcttttaatttgcatctggtatttattctatggatgtaaaatcatctctcttctttctccacagtattaatgtggtcatgtttgttttcttctctctgcatagttcctattttatgatttttctgtttgttttaaatatgtatttttgaaggtatctcaacttccctggcagtctgctcatatgtgactgttggggtgaaagagctgacacttgtatgagcgccagcatgagtgaggcttgttagctgtgccttccaggagaaccactgtgtgcagaacatcatgcagaatcccctgaaaaggctcttcctagctccagctttgtgcataaacatttgcctgctctttttccgcaaagctaagcaagattgaggaggggtgggtctcaaaatttagcaagtaaaactgtattcaatacctcacttttaacagtttttcttgtggtccctgcgtcaagagaattaatttcaccccttccagagaaaaagcctctagtttttggcatggtggggtaggggatttggagatctagctgatatctaaattagtgttcagccaatctccggagcttaccactatacttcatgccccatgcacccacaccccgcaccttcgagagattttcctgtgtaaattggtctacgatttaactcacccccctgcttagaactccattcccttgggtataataagtcacttcccactttgtccatctaccttctttcatccattctaagtcacacatttttcacactttaatatctctgggtttaccagctcatgaattgggatgacttgcatttgatagtgtgtgactctttattggaagtactgttgctttcttcacagtgctttaagtaaccctaaaaattgatggcctctcaaacttgatgaaatatggttctttatttacccactctctatgtttagggggttataaccccttttaaaagtcttactgccattttggcaaggaagcaggggttaacacaagggttcagtgcatcttctttatttggcagtcagatcatcttttaaaataacttggcaagctcagggcaaagaaggacaggtcagagcaggagtgaatctaaaacgccccaggtctttgtgacatctgctgaacccctgagctggaatattctagtggcataggttggtccctctgctctccttctaagcataaccatatcctacaccaagatgctgatcatgttcctgtttagaaagatttaaagaatgtctgaagtcccatacttcaggtttcggtcaactttcctgctgtgtcctctatttctgaaatttgggttcatacctagttctattttgagcaaatccctgggtcaataatacagagagaagtccttctctaggcctgggcctttacagaagcattttgttgactactcaaccttcttggggaggatgttctgcctctccacacctgttcctgctggtggctccactggatggtaggttgggcctattagatgacatcctcctgatacatccctctgctccacttcaacttcttccctcctcctttcctacgactgaccactagctaatatacccactggctcctgacagagtctcagcaaattatctatttcccccagtggcccgctacagtccccatgcttcattcactatccctatgtctggcccatcctgtctatagatgagacctggttctcagatgcacaaatgccaccacgatcgagttagctgcatgtaaaataagagaatgaaacagcaattctgtatttcttctgcagctaagattgaatggttttatggagtctgacttagtgacaatgtttgcaataatagagcaaaataaccactcaagtgctctgaagtatttaattagaaagcagatttcagtcattatcattgtctaaactttttccttagatgttctacctgggagaggatcaaggtacagaactgtggtttctctgtcctagtttcccactctgggttagactgcttgttacagttccagctaatctttgggaagctacttaacatctctaagtctgagatgtccccgacaatcaaatgcctaccttattgagtcaacattggaataaataagttaatacatgtgaagcacttagcagaataaggtacatgataagtaattgcttaaaatattaactgccattatgtgctgttatcataagtagatatgatagtatcaccactctgtaggtgagttcttgccgcctggtgtctctcctctctgcactgaccaacaattaataccattgagtatgcctgggtgatcttttttcttacatcacttttaattcccatttcacatgaatgagttgactctacagccacgtctcttggcaatgttaattttaccccactgaaacatgttgccaagccaagtttgaaggggaagtggcacaaatgacagggtaataattggaagcctacagcagagtgtccaacaaatctggacagaacaagccatgatgtcaagatggaatggaacaaatcaatgtcaactgtaaagccgtgtacacctcattggtgagtcagaaactgtggcaaagagctgtctgtgaaagtttacaaaactgacagattaatgttttcaacaacgacagtgtcatcctgggttacccagcaaggcagcagatgacaggaatcagaacttggaaatggaatcataagcacctttccagaacacattcaataaaataaaaatataacgaaacacctctttctctccaactccttcattctgcagtgttccatctgcttttgctctgccattttctcttgccaaatgccttgttagccaaataaagcatgtttaatacagtttatttaattcactagctgacaggactccatgaaattaacaaaggctacatgtcttggtatttgaagatgatgtataattccattatgcttaaaaaattagtagcaatattatatgggtgactctaaactctatcacaataatctctagaactgtttaaaatgcctgggtccattccccgagaactgaagacacaaatgtggaggcaacagagcccagcatgtgcattctgaaaatgttccattagtgattattatgctcatatctgcttggggatgactattctacttatgataacagcacataatggcagttaatatgttaagcaattacttatcatgtaccttattctgctaagtgcttcacatgtattaacttatttattccaatgttgactcaataaggtaggcatttgattgtcggggacatctcagacttagagatgttaagtagcttcccaaagattagctggaactgtaacaagcggtctaacccacactaacagttcagaaacccattgcttccaagctctaggaatatttatttccactgttttaatgaaggctatataatcaggaacaatacagcaaaaataatagcacaaatttctttaatgaggaagaactatagctcatcatttcacactctcttttattttagttttcctcgcctgcctggaaataaaatattagaattattatgtccaaccacagaaagaattatacttattgtactgttcaagttcacactacaactgaaataattccttcaaataatggcccttaacttttaagaggagcactgccaaactcagatataccaaacaagggcaatgaagacagagagggggtgtacaccaacatctttgcctatacttataccacaatagagaaagcagcctttctatatttaaagggtgaaagacaaaagtaccagaatcctagcctcagccaaaatcgatgacttgcatttcctcaaatggactttgcatgtgttcaatctgcatttattcactcattgctccaaatatccatttcctcttctctatcctttccttgttcctcaagtctagcaaaaatgcctttgcctttcaattttacagtgatgaatcacattacttcatttaattgccatctgttctatatatatgcacatttctgacctcaccctcaatctcagcacctgagaagaattgtccaccactctcatagcactaacaacgctttcctgaattctgttatttacattcctgtctcctctcctggaccatatatgccttgatgacaggcaccatgcttttgcattatcaccttcttctcatctaccatagagtgctctcagtacatgaggaatagatggatgagtggatggatgccttacttgacctcaacaaataatgtttgcatccatatgagaaaatgtgcaatagtgaagagcaaactcaaactatcgatctgggaaaatctaaaatatgacattagatcacttttatagcacttccaatgcagaatttctgttcaatgatctttttccatgaattgctccctcactctacctctctctcccctctactctctgtgtcatcattgtacatcctttgtataactaacccgttttaggaataatgtttttcagaacagaaatatttgagtgacaaagtatgatgtttatcctttcttactcaatgctctttgttgaaacttaaatagctaaatatccatatcaatggaataattatacatgctcttatcaccaaacatcatgtactcgacttgacctggtaacagcattttactttgttggtctcctgttccttcccgcacaaactcttctgatggtttctgacacaccacctcctgctttctttcccacctcttttgctgaccctctcattttcctctgtggctgtctcttcctctcttaagccaccattctccttgtgattcttatactttctctgaacaagctcatccattccgaaagcctcaatgactagttcttggtgtttatccactgacattcattcccaaaaccaagaggttcacatccaaaaccaaaatcaaccaaatcctacaaacctactcccacttcttcattttcctatctcacagaacgacagcatcatttgcccaagttgcctgatccacagatttgcaaatctttctagactctgtcctctccagacatacataacaaatcatctttaatctgccgagtgatgcactaataccactccagttttggccacaagtatctcttgcccagattcctaaactcagtatcctaattaatctcttgccctgttcatacttgctttcaatctgtttttcaaaatacagccaaaatttttcatgaaaaataacaaatgtgattatgttactcatttatttagaatattttagtgaatcctaatttccaaaggataaaaattaatttttcttaacatattaatcatataaaatatagttaaattacatacaattaagattaaataattatatataaatatatataattttaaaaggttacttattacagtacagttatattagaagatgacagcatcttcaaagttatgctccatttattggccaccaagaaatgtatgtaaaacttttcagagtgaggaagaacactgttctgacttttcagaaaagcatcagtagatacttgatttctatcaacctagctgcaaagctctctgtccaaattgtgaaatctacattaaaaaaaataaactcagtcataaaattgacactttcagatatttttatcctacatcattacatggcagaataatccattttctcatcatttacctccttcctagcagaacagtctgttttctcatcatttgccttcttcctaacctaaaacgttctaatgaatttcagagtgcagtagctctttgagagttgaatgtctgtcagtatttcaagactaggaatagtttccagtctcttcggtggctggagaattcccagtgagttacctaatttgaccactggaaatcaaaatttgcccccaacaatatggtggtactgctgctgaatttctgttaaatacccacagtgtcggagttttctagtatatatatgaaatgccgagagcgtgccatcttctcactgacaatgaccacaggggtgtattgagtctttcgcactttgcctggcagctaatcaaaagttccaattatttttgacttattattatgttttatttcaaggcaagaatgacattatcttctcatcgaaatctctggtatattatcacatattaggtatcaaatcaacatttatggaataaataagtaaaacagcagtagggcaacagatgcttatgtggaaagcattctgcaaggtgctgaatgacgcagtcagggaagatacgagcataaaattaattcaggtgtggatcctgttgacagttctaagtctagtaaaatagttgaaatcaacacatcattaaatagaatgcaaagtaatgctaaattgtaatgagatgcaaatgaatttcaaagatgactttcccttagaaaagatggaagggtgtggggacaaggagggcaacgtcacatgcaggaactagtatttgagacggacaatgggagattattatttgaccatgtgaaagggatgtcattccaggctcaaagaacagcagggatttaagcacagaccttgacaaatactgaatgtgtgtggttgtgtttcagagagcaattagattccatcttattggagtttaggggcaaatttaccatcaggcaaattacattggaagtttgacataagcaaaaggttgatattcaacaatgatcctaattttcttcgtttactgaatttgatgcaacatctcatctatttccatactccaaataagaaaccctttgaaattttatggaactcatgtgtttcactgacaagaaaatagttaataaaatttaactatgtttttgacatttgagggtcaatagtgtaaacatggatcttgcactatattgcactgcaaggatgttagtttgccagtccctaaatgtccctgtcaacagtagagcttttccgtaattaggcaaacacaataaagtccactggggctatggacaccagtagatacaggttcttacacccaaaaaaatagtctcagtttcttctgcttcatttatgttgacattttttttcacccattccgtgtgttatttttcatagctcctgctcctcattgcctccagagtgaattttaattgctgctgtcacatccactgttgattgaggggactgaggttaccatagggctgacatcaggtaagagggagttattattaaaattgtaccctaacgtaatagcataatagttttattatttgtacaattaacagccatattgttactctattttatcttcacaatgacccaatgattgatttagggtataaactataatccatttatgtaaagagtagtgaactgggccaggcgcagtggctcatgtctgtaatcctagcactttgggaggctgagaagggcagatcacgaggtcaggagttcgaggccagcctggtcagcatggtgaaaccccgtctctactaaaaatacaaaaattagccaggcacggtggcacgcacctgtagtaccagcttcttgggaggctgaggcaggtaaatcgcttgaactcgggaggcagaggttgcagtgagctgagatcgtgccactgcactccagcctgggcgacagagcgagactccatcacaaatacatgaataaataaataaataaataaataaataaataaatagagtagtgaactggcaatcacacaggtaaagtgaactggcagtcagagaggttaagtgaataaatcagtatcactcagttagtgggatagcagaggcaatacagagatagctggcccattggtatttcctattcttgataaggtatgtaatatatgtatgcatgtcaacgcttttgtttcatctgagaaatatatttccctgctgcttaggaagtaatatattcaaaacatgaacattcttatattaacttgtttaaacccatgtgggacaacaggattgattttactgttcatttcttacaatactgcgcattcaattaaatactctctctactaaagcagcttaatgatttgaacatttcagtgtgatccgttctcagatcaacttcaaaagactgaatttaaacctatcttcaagctgtgaaggttttagttcctttcctttttttttttttttttaactttttaaaattcctctgctgggaacgaattaagtacagcctagcaaaggatagatccatatttgcatcctgctaatcaaacaagaacttgtaagaatgtagcagtgataaatgtaccaccgttgaaatcatttgtataagttggagcaaaatgaactgtgaccaacagattccttccacagccatcacccgtctacattgctccaatgtgcggaagtgtcttaatggatgtacattatcaagtttgcaggcttattttcagtcataaagaatagtgtaccagatgctcttggtacactgaatttgtcacaccgtagacaagctaatatcattatgtgagaccacaggggaaaaaataaaagattcacatttaatccatattaactaccaggagacccatcaaggcagttgggctggctcatgatacagcagcttctagcaaattagcagcccataacaacttagttataatgagctgcaagatcttacaccataagctcaactccattaaaccgagttcaagtacatgaattcatgtacaaagtataaccttaacatctgtctgtgcttagccaatattttgtttatgcctttttaggaacaaccaaattatctttgtgtcccctgaaactagggactgtaatttccatcaactgcagttttacctgatagagagggctggactgatcaccactggcctccccggctgcggcgtccagcagcaagctatgcatcatcccggcagctgttccctacatattgggccaattttttcccaaacaattttcccttgctgttcaagtgggaaaagcaatagtctcctcagaaattaaacagtcaacaaagcatgcatatctaataaatactgtagaccttgtatttacttaagcccaatgagttaaatcctatcctactctactcaacatggagaacatgttttaataaacttaggccatttttttttttctcaaaaagcaatgtcctccttcttttcccacagtggactgactactctttagggactcaggaaatactatcaccattattataactgttatttctgttttacagatggggaaatagagagatagactacccatggttaaccagttgctaagtgaggaaacagatattcagtatataatttaaggtattttccatggagttttatgtaaagaatgaatacatatttatgggaataatctaactttcttattattttctgtcttacataacaagtgtacattattcacttgggcagtgttttcaaaattcacatcttacctgcagaaaccttagcatgcagaaaaatgggtactgcatatattgttatgtcttttctagagttttacatatccaaatctgatctagttctaatcaatctagatgcaacgtcttaaagtctcgtagaattttatatgtggatgggatctagaaagtcatttagttcatcatccttctccttcaagcgtcagcctttccagcagtttctcaatgaaagttgacaacaaaagcagttcaaaccccaatgcataccattccatggaaggatagctctggtaatcaaattcatagtatggtttcttataaaaataaaatgattctatcttctgttctacttctggcttctaatttaccaaagcgtgagactgactttttcactgacacagtagactttgaaaaaccatttgaaaaatcttctcttctgtaattcaaacaggggtagtttagaggtttcatcattgtttttagaagccccctcctcctctgcccacacctttgcattgccctcttgttttccatggcctcttccacaactcaaaacacccaacagtttatatatgatttcacatatggcctaaaagtatcacttttcttacaactttgaaattaaacttccaataatataacttaaggttacagtagctttcttcccattatgaaatagctgctttataggaaacctgaattcaactataaattttttttttctgaacccctgtcaaaccagacttacctacgctacagactcttcagatgataactttgaacctgcagacaaggtgggacatgcatcccaaatttttatttttttatcttatatttttcagcgttttatgttcttcttggaacagaattctgtatcaaacatatgcatattttcttagccctgtgtaacctgcaaattctatagcttgctatgaagatattagtccaagtctttgattatagttttgaatagaaagtacagagctcaatgatttgccacagactctttttcaggttgatagtgatccattaaacagcgtatccaaagggatatataaacatatgtctactatatgtcatcaacatacacagatcagcaaacaccttggattgttttccagcccctagatggattgcactgtgatgtcaacgttatcttattggctccctatctgcagaatctctggtggtgatggactcctttgcaaaccaagagcaatcattcaaaattatataactgtcatctttggttgacccccaactccagtaataatcaagacaggacaaggataaatgtctaagcttcataaattacctatttctcatatctcaggtttcaaatttgattgttaacttccttacaatatgctcagcgatgcagcttagctagtaggggcagcagttgcctctgaagtggggcatgggaaggggaagggacggtttgaacttatgtttaaatgtactgttctctgctttagtttttattatatttttatatcacaaatgttagtacagtagtatttgtatcatgtataaataaatgagcataaaatggatgttcttactcagaagacttttactgaccaaggactgagattaacaaaggatggagaccagtggatgagacacccacacagaataggccacagaatgaagtgagagcccatttctgctcatctggtctgcattacagctacagtataccctaacttggcactgggaagcccctgtatgagagacaataaattcctactcatttggaagggatcatagaattgaagcttttaattttgcagttatggaaactgaagtggagagagattaactgactaaaatgagcagctttaaagcccatttgggacattccagggaaaagaaaatgaaatgaaataaagttcacatcagagtgggacctgattctattccattgttctttctcaaaatatattgccccagttaggaaataaacaaaccaaaaaccaaaacaaagaaagaaaagaaaaacaaggaaatggagaacgaccgtcactgaactacaccttttggcaccacataaatgctggcagatgttctggtgagagcatcaagcacagtgaagtaacagcagtgcattccctgtgccgaatattcaccttgtaacttaaattccgtcagcattcagctttcaaaaattgtgactatccaccttttctaaaataacaccaacacatcatcaaaaaataaaggtttacatatagaaatattcagtcctaatcttgctccagtaaaatattcttctacagatggaagaggaagacaccacacacttcatagacagcatcatatggagcctggaccacagtgataagaaggttgccactgttactctgagaaagttatattaaaaacacatgcatcttttcttagaatcatacaattagaatgcgtcggtgctagcacagaaaacagcctctgaccaccaatctcatattatttcctctacactacaatgaaggggcctatttcatacctggttaaatacactaagaattttggatctcatgaaaactcacgttttctcaaagtttctcaaagacatgaatgctatttttaagcaaggctgataaagtttttctggcttccttctaaaaatgaatgcaaacagtaagctcttacataaaattgacagggatagactcacttgccctccttaggatgggcgtagcctctatgcagccacaatgcaactgagtcaggaagctgcatttataacagttgccctgggaattctgacaccagtaattcacatggtatccaccatcatcctgagctccatgctgatcagtggctcaaaaagtttcttgtaagggaaaagtgcctggagcacctggatggaggtaaatcgtaaaacaaaacagaaggggcgtatgcagtgagagtggtctaagaacaggcagaaatctaggagggttttctaaaatctaagtgagatgcttaaattgagcaatgcccatggatagaagaaggctgaaggagggagggtcagcttcagttaagtacacgtggatacaaaatcctgtgttcatttaattctgtgatctcagaaataccatgtaatggaataattacttagcgtaaattttcacatcaatcatactgagataatgtctaacatgtagggcccttgtgaaagtttaatgcgatattatgggtaaataatcaagagcacactggatgtgcaaaataattttattgatttttatttcagaataataacaaaataaacagagaggtcaggtttataaatttttaaatgaagaaatgtaaatttcctatttaattctacacacccagagataaaataagttcctaaatggaatatgcatgacatctggtcaatatctatgcattctatttgccaaatacatgcccaaaagtaccagcatctacaaactaaagtcagggccagggcagcacctcagggttacgtctgattctacagacacagcctcacaattaactgaaagtctccctttttaattctttttcatctccacctctgtttttacggtttccaatttttggaagaagtactccacgataatgtgggtgcagttaatcccccacctcggcaagtaaatttaattacatttaacatttcaacactgaatatagtatctcttgaagagattccattaatgctgatgaaaattaccagaaattggttcagaagagcatgggggcttgaaatgaactgaggcagataaaattcatgaagaaggaacgtgtgactaatgcgaaagctatgcaataaataaccatcttcagagttgctctccttgtaggaacacgtatgcaaatgttactctatacatgcaaaacagtagtggaggcggaaaggatgcagaaaggctctaataatcgttttgccttgtactaaaacaattagacagttgaccaacacttaaaattagtttttgttctatatatacatatatatatattttttttggggggggggaggaggaagctagtactgtttaaagtcaccgactaactcaatattttttattcctagaggaagaaacgcccataatgttgaaaaatatttacacactggagaagatcacaatgtaattagccacaatgcagtgtttattaaattcctagagattacagagtttatttttaaaatcatatgtgctgagtttaattaaacatatcaaaggtagcatgaacttcatggtatagaagcacgtaatttgattcaaaaataacaaaaatgcacccacttttgctctgttttctaggtaagctagtattagatatggccaaataatatcaccatgcacatgattaacactgattggtaattcttaggaccctaaagatacgttttgtttttttgagcagaacttgatcagagctactgactgaatatgattctgtaaaaaatccaggccactgcatcatttttctcatgctaatagaggatagaaacataaagaaatacatgatttagtattttagaaattatatatacttcttcatgtgttctgtgttgaaaacatactttggagaaaatgcagataaatcacaaaaccctagggagagctgcggcattacaataatggccatgcttttcacagtggaaggaacaggcagagcatacagaagtcaaggcatttgtgacatttccatagctggagggtggtaacaggagaccaccctgtttaaggttgtttcactaagagtctgtctgatatcatataccatgccatagaagggaaatactcaggtcttactctgctccgatgcagagtaagaagggtgttggaacataagcaattgtgaatctgctgcctgtaactgaccacttctctcctacttaagagagaatacggggttgcaagtgataaccttcaatactcactactgtatctgtttcacttttttaatcgggggaaaaagaacactgtatatttgatgttagaaaaaaatgtattttttctaacacactatatttatttatatatataacacactatatttatatattttatctatgtatatctatctatctatctatctatctatctatctatctatatcagattctcatttgtttgttcagtaaatacaccaggcacagcctaagtgctagaaatgcatcaatgaaaaaaatcagacaaaaatccctgccttcatgaagtttacattctaatggagaaaacagacagtgaaccaaataaacagattacatagagctacctgtggtcaaggcaatttaaaaaagcaattcaggaaaataagacgatggggagacaacttaagtagaataattaagaacagcgtcattgacaaggtgacattacagaaaagatggggaagaatgaggaggtgaggcgtgtgtatacctgggctggggggtgaggagaaaggaggggctaggacggtgcttcatgcaaagtcaacagaaaatgcagaatccaagttctaggggcatgttctaggagaggtgaggagtttcctctgcaggagcaaaaagtgagaggaggaaacatcttgggaggcgtgggagggatgggtggctggtggcagagcacagaggcccttgttggccactgcagggacttctgctctgcatagagtagtaacatgataggatttacattttcataggattcctttgcctgctattcgaaaataatctttatattcatttattaaaggttattttgtgtgtcacttaatatttattcatctcagctacatggggaggacctaataaacacatataaatgcatcatataagctatctcactgttcatgctctccttggccacgacaccagcacagcaattactttactacatcccaggtactagttctcacatctggatcccaccagactttttagttcttgatccctagggaatgtctcttccatttttatatgtggcaattcaatatttagaacagaggaatgactcaaaaaacatttgttgaatacaagacatttcgaatgcaaaatataagacttctaaaatagccacaaaactcaactctaaatcagaattcacacgttaataagctacctgtagaaacacaaacataaatctttgttcccacaccattccaactggaacttttgatcagacttattagataggattttccaacttggccattatcatcacataagagttgaaccacatctggaagtgtgtggacaaataaatacatatatatttaacaatgaaaattcttttttcttaattgtgtggataaaatttgtgagtcaaatgggcaaatatatatttttaaacacttgaaactattttttgttaattgtgtggatacaatttatgagtaaaacaccccagaaaagattttgtaacatggcattagaaaattctcacaattttttttattatgtttgactctctgcttttgtttaaaatgccacctaaagggcctacttagtatgttttcagatatatccacataatataaatacctggattaaaaaaaagtaagtgttcaaatttaaaatatttatagtcggaaatataagggaatgggcaaacataatcataacatcaatgagttaacttaattgcgtttttaaactctttatttggatcacatacatatactgtgtcctatagtttgaagacttagtgtcacgtaaatctattagactgatttacaaaaaatgtgagcacccaaacactatattcctgatgtgagacttcatagtcatttacttttatagttcagcaaaattattaaattacagtcaatgtggaaaacacttccaaaggtcaaagttttcttaaatcactttctaaatccatagcattgagattgactttcacgccttaaaaataaaaagatttcctagctttaagacaataaacataaacttttacttttatttaataattagttgaaatgaaatacttagtaagagatgccctcagaataatatctttcttctgatattattctgatattctgatataataagggcctttcttcctcagtttctttaaaataaaaatatccatgggtaggcaattaacatattaaaacatgaaaatatgtttctgataaaattaaatcatttttaagtcaacatggtcattcttcacacttagtttataacttacaaagtcattcaaatttcatataatattaatcaaacataagttttatcttgtgtttgtcaaaattaaggtgaaaatcattttgtatcactattattattcatttgaaaatactttaagtttagagataaatacttaaggacttttttataaagactttataaatactaaagaatctctcaggcattccattttaccgcactcacaattctacaaggtacagccaacttaaatatataacaatctaaaatataattccacagattgtcattttattcaatcactggtttcaaaaaatcaatttgtttctttaatctgttgggtatcacaattttttttttttaactacagtggtggcacaggtgaaatctatgaagccattgtaaattttgggcaacaattttctcaatgagttatttgaataaaagcaatcttgaaacacttggtaaaggttttctataattaaggggtgtgtgcatcttatttacacctgcaccatttagagtgttcaaaacatgtaattattgtattctagttctagtataaacttatcactgagaaccaaataatctctgccaaaaagagaaagctatgcaacaagttagctgcccagtatattaaatttttggctacttcacatggtgactctggttgggtgattttttttcctttactctccatgaataatttctttctggatggggttattcctttaactgcgcatcgaaggaaaaaaaaaaaagacctacaatttccaaattaactcttacttaattctcacagaattgtatgtgattacttacatggataatcataactttcataaaatctaaagtatatatctatgacacaccaagtcttactaaaaacaataattaaatggttataatggttagttaatagggaaatgacccatgaattcttacaaccactttctgtttaatttggttatttggttttacaatttcaatgttcagatgctgaataaattgataactgtgaggtcagaaataaattcttaccatattttctatacagaactttaacctgcagttttaaaactttagttaaaattatcacaaaaacaacattcataatgaaagcattgaaaaaccaaacgcggttagttttcactttttgtcttttacctttactgtaccttttgaaataaatggtccttaaatacttgaaaactgtagtctaggcaaacaagacgactagtcccaaagatgaagggttactcttccctccttccccaggctgtggagcaggcggttcctggcatcctacccacctccctcctccctccctgcaccacggctaaaaggaaccacagagcagctcaaaaaccgagaagggagtgaagaacagcctcgaaaaagtcaggacgctgaattatcctatggtaatttctgctttcactcgcaaacagtttaaaagaaagcaaagcaagacatatcagagataccacaagcccagtggttgctgtcttaaaagagaaaagaatagagttcagccaggcacaaaggtctccatggcaacagtgaatttagacccccattggcattatttatgcaacatttcatcacaaaaggaccctcccactagcctgcctggcaaattctagttttctaatcttccgttcctttgctttgaatgtatctggattcttagctatctgtatgttaacattaaaacacacacacacacacacacacacacacacgacaacaacaacaacaaaaaaacacatcatgaaatgattatcaaactcaaaatagactttatttccttgatgaattcaaaagcaagaggcagattcaagattgtttagagttcatattcaaagccagtccggttttggtttcaaagatgaacagctgttcaacaaataagtttattcaaattatttggttttttgaaatagattacaattcaaagagaatacaaaatggcaaaatcctaccaacccaaaaggctcacaggaaagacagcttgctagatacggactttgaagctaaattttatataatgatatccatccccacccactcctagctattatagtacctcaaacaactcctttgagtcttttacctgattctttctattttagccacagcttccaaaaacataaattcggcaaagtattttaagcactttttattgacctttgtaccaaatggatcccaggtccacattttataattagacgacctgggacaagttatttaaaacagaggtaacgccccagtggaattaggttgctgtgagtattaacaagatgatatctgcagaagtactttcttcaattctaaaacaatatacaaatgtaaatggttaggataatatttgatggcactgaagggaaacactagtcttcatttgaaaagggctgtatttagtattagttcaaataggaactaaacaaggtgacttcttaaaaataagattttgtaaattttttttttttttttgagatggaatcttgctctgttccccaggctggagtgcagtgacgcgatctaagtgcactgcaagctccgcctcctgggttcacaccattctcctgcctcggcctcccgagtagcaggaactacaggcgcccgtcaccaggcccgggtaattttttgtatttttagtagagacggggtttcaccatgttagccaggagtcttgatctcctgacctcgtgatccgcctgccttggcctcccgaagtgctgggattacaggtgtgagccaccaggcctggccctgtaaattattttttaaaaacatacaagcttattattaaaaattcacagtacatactttgataaagtacagggtagtccttattccatacactcccagcatcaaatccattctcctttttgtaaggtcctctaagctggccgcaccatggtcaagccatcatgacatccccctgcccttgtgataatgtactttgtgatattcccccgtccttgtgaatgtactttgtacgatacatcctccccgcccttgtgaatgtaccctgcccttgtgacaatacaccctccctgcccttgtaaatgtactttgtaacaccctccccacccttgtgacaatacaccctcccagcccttgtgaatgtactttgtatgatacatcctccccgctcttgagaatgtactttgtaacatccactccctgcccgcaaaaaaactgctcctaactccaccacctatcccaaacctataaactaatgataatcccaccaccctttgctgacacctttctcagattcagcccactttcacccaagtgaataaacaggcttgttgctcacactaagcctgctcaggtggtctcttatagggacacatttaacactttttatacaattgcttgtctagacctagatgctttattcacctttacttaggtattgattgacactatgttgtctttaaaacaattttgcaagaaagttcatgggtgcctgtctttcctgttaatgcatgtttaagaggattttccattacctgcaaggcagacaaatgtccccattatgtaaccctcagaggcatttttcacctagaatggaatgtttgtggtacctccagaagcacaactcaccatcattctctgtgaaggtgtccctggtattatgccctacttagaaggttatacaactttgggatcacacttttcctcactcacaattctgaagaaatcattcagttacctctgacactgaaaactgcagaatagaattaaaaagccagattgatatatccctcttgtaagaaaattactttcccaggtgagaactattgtaaaaataacaacccatacattagctcctagttatctctcttctacatctattgcctttttttctctcttctgctttatttcttcataccagtcccgtttatttctgcactatttgtctgcttgatgcttctaacatggtttcatttcagcaatagctatttttttcttttttttgaataatctttgccagctcattgttactcctttcatgcctcctgtgtcctatgatttcttctttgatttcatttttgctcataattttaaacttactcaagttacaaaaaaattgttaactttcccttacatcacctgggggtaattttatttttctgtggttatactttctctgccttttgtgtatttgtgtttttgtgttcctttattctctttctgatttctttgtttcttactttttatggacaatgtcaacccactatctttaaacattccagtttattacttatttttgaattatggcaaccttttcttggcctgacttttgcttggtaacagattggggaggggagcaattctaagtatgaaaaaaagtgaaggcagctggtagctgaaaatgtagttcttatgctacccaccccccaacccctgacattattttctcctattgggacttgtccttcatagagcttcatctctcctgtgtcccctcatgtcttcagaactcagtgtttcagttgaggattctggctcaggaacctatctaccttccttccttccttctttcctgccttcctgccttcctgccttcctgcctgcctgccttcctgcctgcctgccttcctgcctgcctgccttcctgcctttcttccagtctgccttcctgcctgcctgccttcctgcctgcttgccttcctgccttcctgtcttccttccttcctttctgccttccttcctttctcccttcctcctgccttccttccttccttcctcttcttttttctaaaatgaaatatgcataatgtatgatatctgggaagatacgtgtaaactcacatatctccttcatgagtttgtgctgatttatttcctagtattattgtaaatggaattttattcgcaatcctcttgtatttttggttcattttagtgtttccaggaaagaagtacaataaaatcaacattgtgagataatcataacagtggtttaagggaaatcccaaagatgcaaaaatgtttactcttgacaaagttcaacagtattcttaagtaaaaaaaaaaaatctttgcagaccagaaatagtgggggaaagccctcaatttgatcaaaacaacaaccaaacatctacctaaaaattataatcaaaacctcagcatgcttttctgggggggtaaggggcctgacttaatggacagtggattctaaaatttatatcgaaatgcacagggctaagaagagcaagcagtcttaaaggaagagaataaatctggaagacagcctaccagataacatggtggactagaaaactgcagtcataaagattgtgtggtatccacataaggagagacaaaaagaacagtggagcagaagagaatccagacatgaagccacacatacacctgatttacaagaaacatgacactgcagtgcagagggaaagatagtgccttcacctgttgaaaaaaaatgcaacgtgaccccagttgcgaaaaaataaaaaaaatcaactccatctggagtgaagggctagatgtgaaagattaaatgaaaatgcttatatgcagcacatgcatgaccttggagtagccaaggctttcttaagcaggacacaaaatgagctaaccataacagaatataaaaaaagttataaattgggccatattaaaattgagaaattctgtttaccaaagaccccatcaggaaagtgaaagtacactaatgggagaagatattttcattctgtctttctctgtatatgtgttaagtctgaaatgcaatgtaatatgacattaataggcaacccaatagaaaaagggtaaaatacttaacaagcactgcacaaaagaaaacaaccacatgacccatgtggccaataaataaattggcaaacgattgatatagtttggctgtgccccacccaaatctcatcttgaattgtagctcccgtaattcccaggtgtcatgggagggacctggtgggaggtaactgaatcatgggggcaggtttttcccgtgctgttctcatgatagtgaataagtctcaggagatctgctggttttataaagggcagttcccctgcatatgctctctggccttctgccatgtaagacgtgtctttgttcctccttcactttccatcatgattgtgaggcctccccacccatgtggaattgtgagtccattacaccttttttccttttaaatcacccagtctccagtatttcttcataacagtatgaaaatggactaatacgacaatcaacttcactactcaccagggtacaaaattttaaccactatagggtgccactaagtactcattagaatgattaaaattcagagagacagataatgcccaaattggcaagtattgggtgttattggaactttcataaaactgtaagtgggaatataaaatgttaaaataaatgtgacagttgtgaatttcttctaaaattcttgataaacatactctgtttctcagcaattctactcgataatgccacaaactaaaaaatgtgcacataagcacaccagaagacatctcctataatgctgtcagtcccaactgaacactacagaaatgctcagtcactagaatgaatatagtatagtacacgtacacagtgaaatactattcagcaaagtaaataaatcatgtataaccaggcacactattatgactgagtctcacacacataacagtgagcaagctgcatttgctggaatatattaggctggtgcaaaagtaattgcagtttttgccattatagcaaaaaccaaaatttttctgtatgtatattctacttttgaaaaggttctaaattattttaaatcctagatttttgaaagctataacaggcatgcatgtatgaaaacaggaatattatttacttactaaatgttcttgattttaaaaaatcaatttcaaaggtttctagcaatattgttgccaatttcctttttaaagaaaatgaaggatttttactttttacaaaataaaagtagaactaaagtataaaggaatcactatttgctgtggtatcattaactttaaaataattgactatgctgtggccctttggacaaataatccaatcttttggacaaaaaacaaacaaatatacacacacaaacaaaacctacatgttcatgatgtccatgtcctggcaatttttatctacttatatggacagaggggtggaagaataagtagcattaacacagaaaagctttaacatgaaataggtgacttggtagtgatttacaaataagttaaagttaacatttaaaatgtttatgctaacaaaacttgatatttaggagagactttaaaagacatgactcctgaaattttggcttcttattttctgataatcagcatttcagtgtaaaactgtgtaattctatttattatccttccagacgctaaggtataaaattacacacaattgacagccaaattactgcgtctgccttccaagggacacggggaagctccaacacagattcttttgcaattaaatccttgcaaggagtaagatttttagggccagctcagcttttatctgtaatccagcagttatcgctgctgaaatggattgcaggaggtggtaaggaaaaaaatgggaaaacaggatgaggaaggaagtcaaacaaacaatgctggacttttgcctaggggccttgtagtgacaagtactcagatgcaactgaaaccccagtgctgcctgctgctgcactaaactcttgaaaccaagtgtcagacagactcaaaaatagaaccattggtactaagagactagatgtatatgttatcacacactagctaatatccctgaatccagtgtaaattcgaagtctgtactagcagtgtagggtatattaaatctattaataatatatattctggcagggtataaacctcttatttgagacctcacaagcctttcttcaatctgtgcctcaaactaaagctcatgcaatgacagatgaagaagacaaaatcatttcagaagtagctctctaccctggcatgaaattaatttcactgtattcaaagcagggtttctcaaatggaatgtatagttgaccatctcggtaatagttcagctttaaacccattggcatacctgatgttgtaaattatcaatccatgaaattcacatgcttttacatttttgggattaaaaagcttgaagacagcaatttccatccagttatcaaatacacaacgacaacgattgccagaaaattaacttagaacacactttttaaaacacattaattaattagaggtaaagaaacacatctgctatatggaatcagcaccactgcctcctaaaatgccacaatgcaccagttttactataaatatatattctttccaaataatatcaataataacaaaggcaggatctcatttttaaagtaatctctttctccaagacacatacagacatgcacacacgcaagcgcaactttgcagaatgcaaaattttcaattaacaaattgggagtctctttatggcagaactgggagtattttttgtttattaccagatggaaagcatctatcatattttatccttttctagacctcaggcataaatttaaggcactgtcttctaagaaataactcgacttgtttgactactaagaatactgcatcctaatcacccagcattaagagtggcatttgtttcaattttttgcataattagctcatgtctttacttgatatcctttaacatttatgtaaagtggtgatcatgaataatactctgtcaagacagagtgggccctgtttctttggctgggcttaggtattatgtcattgcccttggctgaggcacctaaggaataccaataagaaaaaggcacatgactaagcattttaagttcttcccacaatgtgcttggctaaggcactagccaaagagactactttaaaaatatttatttgcaaagagaaataaaacaaatgagtaatttcttgaagatatatcacatttcaatacatcaaagcgtaactatatacatgtttttgtataaccattccctgtaggatatatttgcctttggtattataaaaatcctttacatttaggctggaacattttgtcctttaaatagttaacttcctacagccttgggaagttcagatgcgtagagggtagtggttaaaggtgctgccttggaggtgagggttacaggtggacaaacaggctgaacatgactggcattcccctatgtctaggactctagtgttctctttgtgctttttgtttgcttatcggcatttttttaactgatagcagtatttaaatatttggcaatcaatctttcatgaattctagtatatttgttccatttcttcttgactgcctgagaacaagctctcatttgttctttgtactatggtgaggtttggtttgtgtggagcaggacaggcagcgaacccaaacaagtccagcggaatctctgacgataaaaggatgctgctcacagatatggcagcactgtatattaaaccgatgtgaatcacaacaggctccgtgacttatcatttgtagaaacagcacattgttcttctagaattttgaagacttttctgtaagacttgttgaatatacctctatttccgaacagtgcctatacattggtatcttaaaaatggggcccttccgtgtatgttacagcttaagttcgttctagaactgatattgcattatttgaaatcaatgtttaggtgtccacaggctttgcttacagctttgtaaaggtcttaaatactgagtttgctccctttattacccagtcaatctggaatgagatgattccttggtatttcaaagctgctgacatatctgatggactggatgaaaatttaaggctcatttagctctacagatttatgttatgttctctatttcttgctctaagcttacaatttgccttagccaataatgtgcttttcttaattcatcaatgagcagtccgaattagggaatattcttttttttttttgaaacagagtgtcagtcacccaggcttgtgtgcagtggtgtgatcactgcttactgcagccttaacctctcagactcaggtgatcctcccactgtagccttccaagtagatgggactacaggtgtggtccaccatgcccagctaatttttgtattatttgtagaaaaggatttagccatgttgcccaagctgatctcaaacacctgggctcaagtgattcgtctgctccgtactgagactatgggcatgagccacgaagcctggcttggaatagtctttgaaaatataataataacaatgaagataagtagagctggtattttattgagaagtcaactcaccactggataatgaggacaactcatttcctatatcactgaaattacccttttccatattctcatgtgataaaaatagctgtatttttgttgttgttgtatccaaaaagcagtttagccttaaagtaaaatgttatcattgtttctgtgtacatccaatgaggcaagttattattatctcattttataaatgaggaaacagattcagagaggttaaataatttgtccaaaatcatgtttgtgttcttaaccactagacagacctatctataatcatttatagttttaagtttgtcttctaggagccatggctaacaaccaccacatcatgttcttattgggtttgtataataatgataaatcagattctccatccctctacaccacaaccaagggggatacgtgctgatgaggagaaattccagcttcctcagaatcaggtaagtttctaggtgtgccaggactccaggggggtctcctacccagtaatcccactaagcgattctttaccaccatggttttgtcaaccattctaaaggtaatcaaggttgatattgtatacacattttaaaatcctttatctgattacatttaaatggtatagtgttgtgcctccttaaataagaggaaacacctatcacctttcttttcattaagcctcctatgagagggtttacaagttgagggaaaggaggaagtgtctatttcttatagtcttaatatacgaattgaagatgaagagctgggaaaatatatcttctccatgaaaactgatgaaaaatatgagacttaaccaaaagatttcacaaacaactgtaagtataaaactttaatatttattatagtgaaactcattaacagctgggtcagaaaacatgaaaaggaagtaagcatcttgtattagtgcattctcacgctgctatcaagaactacctgagactgggtaatctattaaaaaaaagatgattaatggactcacagatatgcatggctggggagcctcaggaaactcacaattacgtcagaaggcgaaggggaagcaaggcatgccttacatggcagcaggagaaagagagtgagcaagcagggaactgccacacacttttaaaccatcagatctcatcagatgtcaagagaactctatcacaagacagcaccagggagatggtgctaaggcatttgaaaccacccccatgatccagtcatctcctactaagccccaccttcaacacttggaaattacaattccacatgagatatgagtggggacacagatccaaatcataacacatctagagcaacatcaaaaatgtatgggacaatctacttaggcagttcatgataacatagcaatatttcctggaaaactaaaaaaaattaataataagggttaaaggaggaaagttaactattctagtaaacttcatcttgaacaggtatttcatttctaatagatgtttttggaagcttgtgtcttctagaacttttctgtagttataaatacatttacacatatttaatgaccatttttggagttttgaaaaagtaactccttttgtgtatgaaattttgaagttgcccgcaatagttcttgccatatatagcatttcttctcaaacatgacatccatgactggcaaaggatttgggtttttttgcttgtttgtttgcttttgctagttcttaaaatcccaaacaagtagaacttgtacttattcatgaggtccacgtagatcaaaggttagatttatacccgtgagtacaattcagtgaaaagtcaggaaaatagaaaagtgattgcgaaaatggagtttagactttcccttggggttctcagaccaggaagcttgctattctggtgatgagaaatggcacactgatttggctatctaatttcttgagagtcttattgcatgcccaggaaccataaaagtggaagtttcttctgctcttctgtcggcattctatggccatagagttaatacttgggttacactcaggaatccgagttaagaagtgcctccaaaatgcatcaaggtacctacttttagcaagtcccaaatattgagaccacaaatggtctttatccaattctaaagcaaaactataaatatggatctgaatttaaattgtctatgattaaaatatgtgacttaaatttccattcctccatctaccatctagagttttcctcagctgacactgtcagtgttggaggcaatcactgaagtatttacctgcttacagaattacatacctatgctaatacagcaagtgtgtggacacactgttttgtcaagtatgggaaaaacatttgctgacacctaaattctaagcagtatgtgaagtacactaaaactaaaaaaacaaaacaacaaaaaaaattttgtattatatgtatcaactattttccacagatatattaagtatattgtgtgttataggtgaacaattgtaccaacatgtgtgcaaattttttatatgaagattaggccaggcatagtggctcacgcctgtaatcccagcactttgggagcctgaggcaggtggaccacttgaagtcaggagttcgagaccagtttgaccaacatagtgaaaccccatctctactaaaaatagaaaaatcagcccagtgtggtggtgcatgcctgtaatcccagctacttgggaggctgagacaagagaattgcttgaacctgggaggcagaggttccaataagccaagatcacaccaatgcactccagcctgggcaacagagcaagattctgtctcaaaaaaaaaaaaaaaaaaaaaatgaagactagcccaggaaattgtatttcaaaattattgggcagaacactcccagacaacgatgttagtaaattagcttagtagtaataaatagcacagaaatcagaaggtaatgagagcattggtggtaaaaatgtggtgggaagaaggtaccagtagacattgtgaagtcatccatgagtgcttgcctcccagtgagaaggcaagctcacaggtaaagagctaaactaaatgaaatgaatccaaagaattctaaatctgacaaatattctaatttgacttgcataaaacagcaaggttttttttttatacatgatactctattttagtaacactatatatatagatgtagaaatatcttagaatgccatatctctgaatgtataactaaggactatgcgaataacgtgtttgtatccatagatgtataaacgagaacatgcatatgcatatttcacataaacataatgttgagcagcaaaatatttgagaacaacaggaaagctggtatcacattgtttctgtttcccatagcattattttcactttttttctctttatgacctaattggaatgatcagattccattcttctccattttgcatagactctttcttgcaattctatggaaaatgatgtattgctctgtaagaattttatttttttgtgaaaaaaatgaaaggaaggcacatcatattaagtgataaataattggaacagatttaattccagttattaaaaataaaatttagatctctaaattttaatgtggtctatttgaaaacccttaatcattttaaatttattcaaattattttattagatgtaattgttaatatttaattgttcacttctcacaactcattaagattttaataacatatttttctaaatgagaatatgtcataataatacataaatatatctgctgccttatagtttataaaatggatttacataaattatcacttttgatcttcttaataatcttttaagtagctattaaaatctaaaaccaaagagagattatgaatttaataacagaaagctaatttagatcaaaattcttatttgggaagttaaattaccaagctaattactgaaaatactcaggcacacattcaaatatgcttcggtacttaggtactgctcattaaagaaagcacctagatagtagtactatgtctcagaacattcaccagaacctgttcaactcaaatctgcccccgccaaacactctagaagatttcgccaggtggggaaaagtgccctcctccctactaccctgtgtttccaaggctcaggcaggcattcctccaagagggtgttaattaagttcccttaataataaagggatgtaaagcactatgggatacaatttctccccttaagaaagttaataatataatttccttaaaaatatattttattattataaaatactccatcataatttaatttttaacattgtaagtggctcataacaatgcagtagcatcatcgcttcaatatcaatataatcataattaggaaattacagatagaaatctattagagttttacaccgctggtaccaagaactcaatgatttttgtcatctgggaagatctgagaatccaaagaacacaaatgaatatttcttttcaggcaagttccccatggacatgtgtcagtatgcataataaacacgatgacattagatagtgctattcaaacaccctcttggcagttgaagcaagaaacaagggcactgccctttggccacagagaccagagcgtctcttccagtagtctgtccagatgggagagtgacacactgaaccactgggggcactaatggaataaccttacaatattcatgttcgaaaaagacagaaaccaagagacagctttgctttctctctctctctagatatatgtaaaatatatatattatatataatatatattatagaaaattatatatagtatatatttcatatattatattatatattttatatgtaatataaatattatatataatagatatattattaatagatataaattaatagatataaatataatatatattaatatatatttatatattatttaaatcatctgtctggaatactactttccatttttcaagctaatattgaagtatgatgatagaatgaagcaaactttgtcctataattctcctgtgcctaaaattgatgagggaaaaaatccagcacattacaacataatacgtaataatgatttacttaaatattttgataagtataacagaaacaaataggttggtaatttaaaagtaaaaatgcttctcagattattctctaacctattagaaagaggcatttaggagagggtacttcacaatgggcatcttaacagtaacaatcacaacaaactgttgaccctttatgcctctgcttccaaaatgcaacccatactcatcattgggatagaagtataaatgccattgcttcgtaaatctactgaacagattccatgtatacttagtatattaaaatgttgcccacctacttttgcagtatgaacatcaacagttctggtttccaaaatagatcccacaatgaaccatcccatgaaacaaacacaattagtttatccacattataattttaatgtcacagttgcagtggctctcaattttcaactttgctgcccattgctggtgtcaccgtcaggacctcacgtgctgcaccaggactctcaaaacatcttgcctgtctgtaagtatccaagattaccctgccacattcctgctttgacagtgaaatagactagaggcctcaaaggaattcagagtaaatggctaattatagagtttgctacattcagccttattatcatattattttaatgtaaaatgcaaaactcaggatgattattttccctaaaaataaaaggcaaggctatatgacagagcttgagataatgataataaacagttcagagaagtctattatacagtccaacaaattactagaagaatctcatttttattatcattctacaaatagttattaaatacctattttgttccaggaactcttctgaagggcaacgacagatgtggtcccaccctcacacagcttaccatccagttttattttggaaacactccatatttgatatctgcttctctttcttccaaaagctcaattttatctcttttaaacaaatcagcatatttattcctagagttacttgcatatagcaaacatttaatcattgccttacagattgaattggtattttcctttttaattaataagcgtataatattaaggcataactgaaacttcaatattattggctacttcagtgtcacagagggtaaaaataagaacacagaaatttactatttcatgttttgtgaatattcatattcacaggcttcttctccttttagtgttgaagtttcagtttctggaatgtggtttatggggagtgagactttggaataaaaacagtgtttcatttatgcagcaatgagctgaggcaacctgtgacccatgtcttcacagccatacagttggcatgaaaaatttacaaactctctacttgctgccgtgagttggacagtgtccatgatctagacatagtacaaaattctttacatataccatcaaaaacattcaccgtggaaaggaaagcactattgatctctttcaaagatgagggagattcaagaatgggagtgactcatgtcaagccccgaagctgatgtcttgtggagcatgggtctgcgcacagctccgcctccaaagccttgagcttcctcccacaacatgtgaaccccaagctttgcaagtccccttgcctttgtgtatacagtccatattcttctgccatctacctgtgtcctctggcttttcacatcttagttcttcctctcgctcctagaaagtctaattctcaccttccccagatgattctaaggctctgatattacctggactcaattaatcacccatgtcccaagatctcaaaaaatattctgttaaaacatttgctttggtattttcagaagcatttataataccaagtacatcagtggaggaatgagggagatattcatgggcatttgtgtcagcttttggttttagagatggaagacctacttgtgcatttgaccagttacatttgtgcaatttatttatctgtgctttaagaatgttgagaataattacaagtttggtatgttgcagaaaggtatttggagcaaggaacaacagctctgagttttagttatagcaccaggattccttggagaggttgctgaactcatcttaaataaagttcctttatttatgaaatgggaaaaactcttgtaccgtacagttcaagagaagattataggaatacaatgagatgaaactacaagttctttggggtcaagggctcagtgagatgcacattcattctcctaacagtgccaagagggactctgagaagaggcacagcagtgcccacacaacagacatgcttactaaatgaacatacacatatgaaagcaacttaaattatacacaatgaccacgtttatgtcaatgtgctgaacatctgagctgtagcaaacagacaagggtcttacattctaatgaagcatcacagacaaatttatcatacacactaaatgaagaagatggtttctcaaggtggtaagtcctataaagaaagtcaaacagtctggtaaaaagatagagcctttgcaagaataaaaagccccttatagaccatattaaggtttggattttattctaagtactaaagaaagccattagaggtatctaagtgacatgatcttgcaggtgctgtttttaaaaaagatccacttaatgtattatgctatatttaatgtgaccctatctagaataataggagtcataaagaaatagccttgtttggatctgaaatgccatggttcataaagatcacataagggaacagtgaggagtcttttgtaactatgcaggaacggtggtcactggaaatctggtggtagtgatggagggagagaagaaaagtgtgctaaaatacagctaagaggacatggcagttgtgagaggaagaattctaaagatgtcccccgcccaagtccctggtcctgtaattactcagtcaaacattcactgaggttctactgtgaaggactaaagatagacttaaggttacaagtcagttgacctaaaatagggaggctaacctggattatccaggttaacccaatctaatcacatgagctggtaaaagcagagaattctccagctgtacccagtactgtatgtcagaagaggcaagagacgagacagaataggaggtaagagagatgcaaagccaaagatggaggaatgaagccacgagccaaggaatacaagtggactccggaagtcaagaatgattcttagccaccagccagtaaggaaatggagacttcaacacaaggatggcatggaactgaatttggccaagaacctagatgcagatacttccctagaacctccagaaagaaatgcaggcctgaagacaatctgatttcagcccagtgaaacctacatcggacttctgaggcagtgagatacataaactggtgttgtcttaagccactaagtttgtaccaattcactttggcagaagcaatacaaaactaacacagcagtggaaagtatcagaaggcagtaagggaaagagacacattgggatggctcggctctttggacagagtttgagggaatggagggatcatttactgagatagaaaaacatgctggaagaacatttggggagaaaaatggaaaacaaacactttgttttgaacacgtgaagcttgagatatcttatcattcatccagctggaggtgacaggaaggcaggtaccaacacaagtttgcaactgaatgaagaggtgagggctggaggcatcagtcagctttataagtgtgtcataaacatatcaatgatgtttttaaatatgggactatatatgtgttcccaggatacctatatggacagataaacagagaatgtcttcaggatttgttcatcaacaatgtctaaggaaaatcaggaacattaagaagcacaggagattacaccttgttatgggtggaattgtattccctccagaacatatgttagcatcccaatccccagaacacatgaatgtgattatatttgaaaataaggtctttatagacgtaatcaagttaaaataatatcaataggataggccctaatccaatatgaccagcatccttgtaaaaaggagaaatttagagacaggcacacaggaagaatgttatatgaagatgaagtcagaggtcaggaacctgcttctgtaagccagggaacaccaaagacttccagcaaaccagcaggagctaggggagtgaccggggacagattctcccttgcagccctcagaacaaactgatctgatggcaccttgatcttggacttctggccttgagaactgtgaaacaatcatcttctgttgttgaagccacttggtttctggtagcttttaatagcagccctaacaaactaattcacgcacataatactgtgaagtcgatacctaagacaggcgtacagatatattttgagtggtatggtctctgtatctgacatatataatattatctccatctttaaaattaaaaaagatgaaaatatggcaagaaaaaaataattttattaaaatgattacaacagtaatcatatagttttgattactgagttttaagaaacagcaaacatttatttctcaagcacaaattactcagaagttagtttctttcattagatgatcttaagatctatggcaattcaattgacacaaatgattgttatttgaatattaatcctccattcaaaattatggaagggaagttgctcaatagtcttagttatgaatccacttctgcaagatattccttgcatttattcaaatattatattacttaacttagacctgttaataatgtcaaactgtcaacatccccaatgaaagaaactcaaaacttgggctgaaagtctgtgaacacggcaggtatcaaaccacatccaactttaaaaggaccacaccttctgctatgagcagaaattgatacctaattaggccccatgcaaggaatgtgtttcacgttgacactgtgcattagaagaaattctcaagttcattatcaaccataaaaaacccaggggaaaatcctcttataaaatacaacatctctgaattttatcaacagttcccaacaaatctagaaatagatgctgctgtcttaagatattatgctgtgatgattaatactgtcaattttgaccctcaagagaaccctgatgaacacacataccagatgcaatgtgaacctacccacagcagtggaagctatgaagagtcctgttagattctgaaacactatgattcatagaaacccagaaaacacatagttgaaagtagaaaattaatgcagtgttttctcagcctggcctaaggctttaaacatcatctatatgctgatgatttccaaggctttcatctccaactctgccctccccactgagcactagattaatctaggcaattgcctacttcccatctccactgggtatttacttactagacttctctaagttcacacacccagaataaaatctggcatttctcccattattcccattccaccactctccacctttcctctctcccaggtggccttatctttgtaaatggtaccaccagcaacccagttgtagggaacatacagaaaagattctagaacagcctctttccccctaccccacacaaatacatcagcaagtttctgttggttctgcctacaaaatatatgctgagctcctccacttcacataatctctactgctgccaactagcccatcatctctattctaaatttctgcaacagcaccttacttggtttctctgcttcccatcttgcaccccctgacacccacccaccacctccagagtcttattttccacagagcaagcagagttttccaactgtttaatcacatcattttactcttttgcctaaaatgttcaaatgccttcccatgaaatcatcatcagcagcagcagcaccatcatcattccaagggtatctgaggcttctggatttgataggactctgcctacctctctgatttaatttactttcatccttcccactttttactaagccccagccatatggcattttttcttcctcagatccatgaagcaattcctgcagcctggaccacgttttcgtcacatggcttcctctactagtcctgtgaatctgagcacaggtgtcgctcatcagagacaccttcccctcagccagcactgcccaagtctctctggttcactcatagtttttttctccgtgtattttgtttccttcatccattcatccctatctgaaactgtacatattacttgcatattttttcattttttgttgcttatgttgtttctgcctacataattatcacatgtctcccagtaagtcatgtggtttaagaactatgccttcctatctactgtccactaaatctgagagtgttttatttattttttctttttgatgaattatgaatagttgatcgaaagtttcagcttttggtttctagtgaacacagaaaatgtgccctctttaaacgtatgaaatttctttccaaatcagtgactctcaatggaccctctgtcactgcaatggtcagtcttacctgacagagaattattaatcactcaatgacactctcatggagagaatgatatttcttgaacttttgggaggacaatagtctattttataatactattatattaaataatagtattggacaatgaacataattccaatacttattttttggcccagtatagactgataaggcccaacactgacaagtgaaacaacacaaaggaatgccttgtccatgtgtctgagtgtgctccagccctgggaggatgtgtcttggcaaagcctggctgggacccaggtgggtttgaagccacctgccccaggggaggcttgaacctgggagccttctgcatctgcagctgtgggatcttgacctcatgaccaagtgacaatgaacttcttccacttagtcaggctctactaaccttttaccattatagtttgtccctaacagaatcacactgagaatcttttaacttacacaatgacctcctttaaacatgaggagaaatttagtcttgatttatttgacagcaattcggtttgagtcctagtatttgttatgttgatttatgacaacaatataagtgccgatgacaaagagttttatgacttgttccagacacaaagttccactttagctccccatacactgagttctctctacatgcacagatcaaagccgcttggctgttccctgggaatggagcccagtaagacctggccagcccaattatagcagtgaccttcataaatggatcctaagcaaaaacccagtgccttctcttggccggtatcaatgtcatcaaggaaataacattgaaaagcttcatctcgcctcatacactgtagcttgaaatacccaacatttcaaactctttagctgaaaagatgtcaaataatttatttgtgagaatagccgattttcacaaccctgtaaggcatgcaattcacaaaaggcagcaataatatccccgtttcagtggtgagaaattgaggcctagagaagtgatgtgactggcatggatctataaattactatgttttaatgccagaaggctgcctcaattttcaccctcagcccagggaacccaccgtccaataagacactctcctccacctgcctatctttgggttctagttggtagtttacaagttttaagtaatagaatgttatttcaatgaatgttgcctgaacggatcatagcaaaaatataatgaccccaaaatatccagagagttctatttatctctaagcagtgtgatcaattcatatttcagctatcaatgacatattagaggtttgtctacactgttgtcttgatggatgaattgtagctgcatatttgctcaggtagaaaacaatattttttacaagtgatcaaaggaagctcttgttcacttgaatgagaagatattatactttactgaggtcaaaaagcttagaaatagatggtaatctggagtcaagatttaggataaaatctaaagtctaagtcagtagatgatatggtttggctgtgtccccacccaaatctcatcttgaattgtagttcccatattctccatgtgtcatgggagggacctggtgggaggtaatttaatcatgcggacagttacccctcatgctattctcatgatagtgagtgagttctcatgagatctgatggttttataaggggctcttccccctttagctgggcacttctccttgctgacaccatgtgaagaatgatgtgtttgcttccccttctgccatgactgtaagtttccggaggcctcgtagccaagctgaagtgtgagtcaattaacctctttcctttataaattacccagtcttgggcatgtctttattagcaatatgagaacagactaatactgtagaaatattctaacagcaaaacctgtcaagtctgcagccttcaaagcttgctttaagcaagatttaagactatcatggtttgttgtcacttaatcacgaagtctacatatcttccctttatcaggatgcaatgacaaaggtttatcttgggccaggtgcagtggctcatgcctgtaatcctagcgctttaggaggcagaggcaggtggattacatgaggttaggagttcgagaccagcctggaaaacatggtgaaaccccgactctaatacaaatacaaaaattagccaggcatggtggcatgtgcttataatctcagcttcttgggaggctgaggcaggagaatcgctggaacccgggaggccgaggctgcagtgagccgagatcgcgccaatgcactccagcctggacaacagagtgcagactggactccatctcaaaaaaataaaagttttttcttgaactcaaaacagattagataagcacactatctagatatttccttctcttctgcatctctcactacaatgtattatcaacttttgtctctctgacaaccagctccctccagactctgagctctttgagggcaatgattctatttcatttctagttgtgttcctaatacaaataagtgatcaagaaatatttgacattaaaagcaaaacatatcatattcatttctatttacagaaatcctaatatcaggggttcaccaagcctacgtaatggaaagtcacaaaagttcgagaatatagcaccttaaaactaacaatgtatatatatgatcaggctgatagataggaaatcccaaataccagaaagtagacactcctttctgtcatttaaatgttgttgacttggggaattaagagatgtgactttacaaaaggaacatttgaagtgaaaagttttgcttaattataattcctatcagtaagtcattactcatgccttctgacttgggaattttgtctttaaagaaaccaaagtgttgcagaagtaagagttaattatttttaaagactagtactaagtagttcaatatccctgaattatatttaaattactaatggcctaaataagcagatttatgctaagatacatgggatcttagctatgtaccttcttcgttcttcatggtatacacattaagtaaatttgattgtgaagtgaaaactattcactgaaaacatagctgaaagcaacagcattaaaaaggtatattgcttactaatactacgatgcttactatttctaaaatcaaaaataggttgggtacagtggctcatgcctataattccagcattttgaagggccaaggtgggaggattgcttgagcccaggagtttgagaccggcctgggcaacatactgagatccccacctctacaaaaaataaaaaattagtcaagtgtgggagtgcatgctcgtagtcccatcaacttgggaggttaaggcgggaggatcacttgagccctagaggttgaggctgcaatgagctatgatagttccactgcactccagcctaggtgaaaaagggagaccctgcctcaatataaataaataaataaaataaaatataaaaacacagactttcatcattctccaggagtaattaacaatagcttaaattaatttccataattaatagagtcgcagaatttgtctccttgatagtggtatttatttcttgagtgcatactcttgtgctttggttgaataatgctgccaatgagatacatgggcaatacaaaacagcttctttgtgacattttctaagaagtttttgccaatgtcaagacttcttaatcaaaatccattttgctttggggtttttattttaatgtcaagatggtattcatatggcaattattctgttgcaagtagcttggataagtaatgaaattgtggcttacctggcttcttctccataattttgtagataaacgtgtgtgtatatgtgtatgacacttattgaagcttaaattaaaataatctttttaaagtgcttcttattaaaaccactgatgacatttatgagagatgtaagcaaaccctgatgcttccttcaaaatgataagagaaaaatgtcacaagaaccatcattttatggtattcagaattcatgaaaaaccaccactagaagctaaggaactagccaaagctgctgtccaatcaggcattcaaagacattaatggacgcctctgaattgaatttgtatgtattaacctatgttttcttcttccagcaatatattgcttcagggctgaattaaacgctggtgtggactcatttcctggagataaccaatgtaactagcccatggaattagagcctgttgcctgctaaagtctcagctcttgggtcatctctttcttaccagctctcttactgtcctcaagctgggtaaagctaggattagaattaggccttaatctgtgtttccatgatggttagtacatgtctgtagcttaatatcaccctaccagggactgacaacttttgctcccctgtctctacatctgactcccgaacaaaaccccatgtccccttcattcaatgcatcaattgctttaagtcctttaagtcttgtttattttttcatctataatgacatgacagaactgtatttaaaatatacatgcatttatgtagtgaagagtaaaatgtctgccaattgaaaaagtttgaatactttcaataaaaaattttgaaaattcttccttgacaatggacatttttcctatacttctttttttaaaatagtgtgattattttgaaggtaacttgcttcttactaagagtacaattatgcttctggtttatctgcatgccctttacattttcagttaacttatactgatcaccttttatgtagagactatgtttagcaggttaaataaaatatctttaatttacaaagttacataatgatgttcagacaggttaaaaaatgtgcctgaggtctgacttgtggtaagtctgaagaaacaagatttctgcctccccttttcccacctgatgtattatttctgcttcattctaccaagattaaaaactccaagtgatgcaaaaaaatgtgaatctacagaatcacttccactgctgatgggaaaacaattagacaaccattttggaaaataatttggcattagcgtattaagatgaattttaactcttgggcgtttaacaaagagaaactcctgaaaaatgtaaaggcagagacatgtacaaggctgttcatggcagaaatgtttgtaacagcagaaactcagaagcagtccaaatgctcattgaggaaagaatggatgaattgtgggtatagtcacatgacggaatattctagggcagtgatgaactacagtggagcacagcatacaggcatatcaaactgtgtttcatcactgagtggggtggcataacatacacttgagagtccagacaggggagccagacctgctgtagcaccaatatcagtgtggccctggacaattctggaacctctttcatcctcatttccacatctctggagtggggacaatagtacctacctgataaggtccttgtgagaactaaatgaatatacatatagcaattaaaatgggcaatgatgcaaaatatgtgttttgtctcaccatttaaacatcatttagtagaatctagtagaatttgagtagatattcaaactacttatgtttcatattcattaagcaatgtagaagagatcatttctatatcttacagtagaactatatttgctgtatttaacatacgaaaaattttgacacatttattaggttggtgcaaaggtaattgcaaaagtaactacttacttcctgagacatctcttctttcctatttaattgcaaaagaaatcaccattacctttaatggcaaaaaccgcaattacttttgcaatggcctaataactgaaaccatgaaaaacagtggttataactttgaaggacaatattcataattatttgtatacagtcccttaaagaaacacgtatacacttaatataaagtattttcccctattaattgaatttatacttaaaaaattatgttcttaaaaataatgtaaggccattcatcaaataagcattttagcatgactatacatttttaagtactgaaattagaaatgatggagatagataatcttagaaacacaaataaaaaaatccaaattgaagtagtagatctttgaaatcatctactcaaaacccttgatttttcaaatgaggaaaactgagaaccagagaagttaacaaataatcaaaaaatcacatgagttggaggacaggacaatacgtagaaactctatattctggctgttagttctctctccagtgtgtcacataagtgtattttaaataaatgtaccccatgacacaagagctatgcatgtgataagaccataggcatttattctatggcctgggactatgtagtggaccatcagaagtcccaagatcatcaaggatggccaagtggctactgaaaaatcacatgcatgacaatggtattctcttttacacaaatattcctgtgtggtggaccatcagaagtctcaaggtcattttagcaccatgagatggtcctctatctccatgatggccaagtggttactaaaaatcatacacataacaatgatttttcttccttagacaaatgcttctatttctgacttctctctcttggtttatgacattacatttttcctgttacccaagtttgaaacggtgatattggctttaagctctcatgctcctttgccaactacatttgcctacttactcgctgagacagcttttctttccaatttaatctccttctctcctctgggccattttctcgctacaaaaatgatcactttttacagttttcttcaactcttttttgtcaaggcatgatctactatgactttgtcaagcacctaaaaatatttccttttatttttctcatgcatttacattttagtccactgcaaaagagtttctatcattcccactctacagaaatgccttgtcacacatgaccaatagtttcctatttactttcacatctgcagtatctgatggttaactacacatccttcttaatgtggttcacatactttggccttggtgttaataatattctaatttctacctgtttttccttccttccttgcttccttccttccttgcttcctttctccctccctccctccttcccttccctttccttccccttccttccttccttcctccttccttccttcttttttttttgatgtagtctcattctgtcatccaggctggagtgagtggcgtgatcttggctcactgcaccctccacctcccaggttcaagcaattcttctgcctcagcctcctgagtagctgggattacaggcatgtgctaccacgcccggctaagttttgtatttttagcagagacagcgtttcgccatgtcagccagtcttgtctcaaattcctggcctcaagtgacccacatatctctgcctcccaaagtgttgggattacagccgtgagccactgcgcccagccctgtttgctgtttctttttgccaatctctttgttcagttttgtttccctcaaaatgcagcctttctcctaggtattgcctgtaaggatttattcctttgcatacattttcttccattatttggtctgttcttaaagcatcatccatcatatctactcgtatcagacctgtggctatgcatgtgccaaggtttccagaaaattccaggaatacatttctaattgtccattacctccgaggatggccaagtggttactaaaaaccatacacataatagtgtttttctcccttacacaaatgctcctatttctgaattctctatcttgggttacgacactgatgttggctttgagtcattgacctctactgacatcatcttcataacttctcacccctggaaggaaattccttggacattcctcagtagctggatctctgataccccatttcattctcacctcatctaacactatttgatatcacttgatgtcatagtttctagatctggtttatgttttgccttctatgttgccatattttagctcatccatcattcattcatcatatattaactatgtatactataacaggtacacacattagaagtttttcttcacctggttacttaacaaacatttactgagcagctattattctaagctcattgttaggtcagaagcacattcatacaaaaatgaatattaaatggctcttgatcttagttctgtgtcatattggtatatagaggaatatgagccagtttgcaaaatgtcttcaagggaacaatatttccacaagtgttacagagaaataaataagggcacacactgggtcaaagttaaacaagcatctttattatggaattctcagagccacttatatgtgaattcacattctcaatttcccagaaagggaagggaatacagaactgccaaattattataccacaggcttttgcctcttttctcagtctgataaagtaggtgtgtttgactgcccacattttatggatggaaaagggaattcaagtaaatatagtaatagatggtacactgatggctaatatctatccttcaagggctgctaaaagttttggctcctttatttttcacgtatttaggactttaacaacatgccctataccttcatcattctctgcctcctctacctaaccctatcaggctttttttttttaataccattcatatctaaccataccagctacttgtgtcatgatgtccatttcatgtcatttgaaaaatctcaaaggaaactctccatcaattactgacccacaatcccctacacaaaacacttggagctagacgtatttctgaattcagaatgtttgaatacaaatatattactataactacactgtggaatcaaagagaagcacttaggatcaacacgttaaagtttctgcaaaaatatgcgcaattttgctcacagttagtgagattaataaaactataaagagctgcatgctagttcaggtcaggtttggacccaaaaaggaaaaaacttctggccacttgtgtccttaacatcttgcttagaacaagctgctaattgctcctaggaaacgtcttcacaacattcactacacactcataaacccacatacatgtccacacaggtgcatgcacatatatcttatagattttggagtcaaatgataataaatgtaatttggtaaaaatactacttaagcctcttatttttccacacctctgactatccgaaattttaccaagaaataattaccactgcatggtacagtttaccataaattgatttttttcacagtcatgtcactttattctactcaaagcaaacacttatgattattacccaatcaatctttcaggaattaggcgagcttaattttacatatattgagtatcatttgtatactcattttatatgattttatccgattattgtatctatcagatattcattctcagctaaatgtaaaatacatttgaggaaacataattaagtaactagaaaccatattctgtttacctccatttttaaaaaattatgcaactttggaacttgtgtgaattcaagaaatatattttgcaaaattaatcgacaatcatttttaaaagttattatgttatttctgaagttttgtggtgtatgacttttatttacatgcactaaaaacataaaagtcctaaaaataaaaacaactcaaaattattctcaggccaggcacagtggctcatgcctgtaaccctagcactttgggaggccaagacgggaggatcacctgaggtatggagttcgagaccagcctggccaacatgatgaaaacccatctctactaaaaatacaaaaagtagccaggtgtggtagtgcatgcctgtgatcccagctactccggaggctgaggcatgagaatcacttgaacccggcaggcagaggttgcattgagctgagatcatgccactgcacttcagcctaggtgacagagtgagactgtgtctcaaaaacaaaaaacaaaaaccccaaaaccaaaatttattctcagtattttttctttcctttatctggcactgcatgcagtctgagagtacagttgatatgtagtcctagtgggttactcattaattagtctttttaaatcctatgtacaggagtctctgttgatcagaagccatatgcactctctacatgggttgtaataaatatattttaaatttctgaacttgtttgcatgatggcatagaaagaagtttagataaacattccaaacagaaggcatatgcattttggcttggctgagtttataaaaatgacatgatctaaaatatctcagtttcttaatgctgcacaagtagctggaaatttctctcactgtactcatcccagctagagtcgtaacccttctccattaactactggtgccatctgttggtatgaaatgaatgggcatccagattggtgggtatttaaatcactcacagaagaaaaatcatgtgattcaccttattatctgacctgtgaagtttccatcatactttagtgattagatattttcaaatatgttttcaataaatgtttaaaataatgtatgaaatgcatttcaatatcaacaaaaagcattttaatcgatgatattttgcatttcttgattttaaaatataaatcttaaataaaaactttgaaaacagtagcttcatcattatttttggtattctttccaagaaatgaataatggctaataggtatcctaatcatccttttttattttctgtaatgctgatgttttgacatcttgggacctggctgacctggaagggacagctcctgccagtgcttgtgtacccctaaagagagtaaatgaccagcccaacagcctacctttcatatgcaaggtaaccaatccagtgcccaatcacatcactgcctcctctacagggctgtcacattcaggaccaatattcccctgcctagtcatcccaggggcagagagcacacaatccaggacagcgcctacagcccacagcctgctgaaattattcaaactatccaaacctaaacctgtttacccagccttattcttccttcatacagaaagccaaataaaggcgcttgcccacatttcccctttgctccctctgcctcctgactggcccagtgcttgtccgtatagcctggaatatcatggggtgcccctcattttgggaactatgagtaaagaactatcttttaatagcagttgtctcctggtctgttggtctcacaatgcctgagttataataaaacttacctttcaaaacaataggtcactgggtctattatctgttttgaagtccccatgattataacctgtgacatcctgggctctttatatctggaggctggagttgttcttcctagttccaggcaaaagtgccaggtgacacttagcctagtggctcggaagcctattcccagaatttctggatgtcgaatacctgaatagtctatttagtgctcagggcatatgaacctcaacatggccctgatggaacacatgacttattagccaaaatgtggtctgcttgaccctgtctgtctcatgccagagatcaagaatagttgtaggtcctggctcactgctgtttactcagccattctcaggagtctcctgaaagaacggtgtatatgtgagtggatgagtatctgcatgtgtgtacacacacacacatgcatccatctaaaataattctgccatattcaaacatataaaaccaatatttaaaacattatggaaaataagtatcagattttagactaccacatttatacttcttaaaaagtaattttgtaatatggatacattggtggataattactggtaatattctggcaatgcaaaaaaatctgttcagtgtaaatttcatgttgattacattaatcattatattttatttgtaagtaggtttgaattatcaaacataaaaattttatatttccagtagcatctttgctgatttcactattgaaaattaatgcagagttgattccagatttttcatttatattatattagaggtttttgttagatcacagatttaactttggaatttgtatttttggttgagaaaaaatcgtgtaaatggcatgcatttgtagcttatagaaatacatttaaatcatttaaaaacatgaaagaaatcaaatataaatacataacaaatacaatatggtacagtttattttatttagatgtttatagataatatatcaaaatgcacttagcttccttcatgcaacaaaagagaatgttgtaaaaaggtgactctgggtaggaagcagctttactcccaacctttagcattaatatcttgggaagagtaaattatctttgttatatgtttcccatctgaaaattttaaacatctaagctgtctcctaatgctaaggattgcctcattaagcatatgtaggcggggctgtcatagttggctgattctataagctgtcttgaagcactttccttcccttgtcccaaactctttgcatcttgcaaatataatacacaaacaaaatacagtatttttagatgaaatattcagcatcacttaaaattaaaactaaactcaaatttgtcaaatggatgcttaaaaatccaaaaagatctaagtatgagtaactgggacctgataccaggtttatcataatgctcactaagaaataagacagaagaacatcaccccatgccttctttgggatttacaaacaattacccaacataaatttctggtaaaaaatcatgcaagttgttcctcaaggtctaaaaataccttaaaattaggatttttctgtagaagtttataatgaatagattctgtttcctaagctaagatttaatttaaatgaagaccaaaaagtaaatgaacttattttcttgccagcataaaacaagatgactgtacccttgattgagggtaagaaactagccagcttaatattaaacatcaattgcatgcaactacatataataggttttgcaataaacacaataataatgtaagtgttttgactatttgctgtaagagttcttatcagaaatggacatctcagttatattcatatgggttcataaactgaagagtttttgatgatttggtcgtattccaaaccattctaaaaggtgcaattgattgaactggccatgcagttaaaatggctaaaatgatcagattgactatagctctgtcaggtgcttatcagaaaaacacgatcttacagaggcaaatctgcccccacaaaagcatggctcagaagccattcctacctccatacaaacctggaccctcaaaaatatattctgaagtattcatttatatcctgtctacttcaaaatggagttgagacaattatatcaagggagaaagagccctaaaagcaaacacgcaagtaaaactaatatcattcacattaatttcagaatgattaaaacaactgttttaccccttaagcatgtaagatttccacttcttaaatccttcttttattgttgctatttttagtctactatgactatatccttcaaagcaacattaacaacacgactggtttatttttggtaccataagaggacaatttactggcaaactgttcccactgaatgagaatgagaaacttaactacgctgttggtctttgatatttttccagcagaaatagtccttcctccatgtagtacatgagactttcagcctccagacaggctctttattttagaggaaaaacaatatcaaatcggtagaagtgttcataactttgctttattttcattttcttataggctcgttgatatggtttgactgtgtccccacccaaatctcatcttgaattgtagctcccataattcctacttgttacgagagggacttggtgggagataattgaactatgggagtggtttcccccatactgttctcatggcagtgactaaatctcacaagatctgattattttataaagggtttcccctttctcttggccctcattctctcttgtttgccgccgtgtaagatgtgccttttgccttgtgtcatgattgtgagactccccagccacatgaaactgtgagtccattaaacctctttttctttataaattacccagtcttgggtttgcctttatcagcagtgtgaaaatggactaatacacccatctcacatgcaacgacacccataggctaaaagtaaaaggatgcagaaaaatcttcaaagcaaatggaaaacagaaaaaagtagtggttaatattttaatttcagacaaaacagactttaaaccaacatagatccaaaaaatacaaagggtattacacaatggtaaagggttcaattcaagaagaagacctaactatcgtaaatatatatatgtgtgtatgtatatatatatatatatatatatatatatatatatatatatatatgcaccaaaaaaggagcagccagattcataaaagcaagttcttagaggcctacaaagaaacttggataaccacacaataataatgagagatttcaacaccccactgacattattagatcaatcatcgaagcagaaatgtagcaaagatattcaggacccaaacttgacacctgaccatatagacttctttttgtttataaatcacctagcctctggtatgtctttattcgcaatgtaggaacagactaatacactcgttaataagtgaaaagttaagggcatgtaaactcccatgcattgagtatttctgtgttagaaagaacacaaaggttttaaggtaaaatctcattggatccttgggacaaatctattgttctctcaattttagagataaagataccaaagcgtgttaaatttacatgtcttgaccaatactgaacagtagtcacataagaactctcaggtcatctcctttattctaaagaaatagtttacatcaattggcttgttgagaagaaagaggaacatgtgaaatgtgagtatctctatttatgaataaaaatgttgaataaccttgctgttttcatttacaaaagagcgcacagaattcctttaatacttgacaatggtgttattgtattcatggacaatgatcagtcaaaatgtactctgtaggttgtattttattaaacagttttaattttagatgtaattttgttaaacagatgtaatttcaagtacaaaattaaaaggagacctgaatagagcagtaacattcagaaaaattaacttttatcaagagtatcttctcttaaaagtggcttttgtgattttgttttataagaggttagaaaaataaaacaaaatgattctgctcctgttaaggaaaattaacagttggaacccacacagggatagttcctttccctcccccaacattaaggaattccaaatttttaccaaacaaccacaactgctaaaactgtacctacctatacatttattccatatatatttatttagcatctactgtatgccaggtactatgcttgaagttgcatgtagcctaatgtaacttgtggtttatattttagaggcagctatctgtaaaaccaaaacaaacaaaaatccattgacaacaacaaccaaaaaaaaacaaagtatttttgaaaaactaaacacccttcaacaatatgcactgtaagtagcatacaaagatatgaccacatggctgaaactgtcagagcacaatagcagataaaagtatttaaacaacgacgttacatgaaattgctatgaatcagtgtaccttttgtttcttgcttctaatcttcataggaaaatgacttggtcctcaaaaattcactccactaactctcttgttagaatgattggggaaaaatattttgtctaaaagtttgaatatgacatacatgcaaaaactgattttaaacaaagaggtcaaccaatctcatagggaaagaacaatgttttcaacaactgatgctggaacaactgggtaatgcaaacagaaaaatctctctctctctctctctctctctctctctctcgctctctagcctactcttacttcacatcatttacaaaaaataacttaaactaggtcatagactgaagtgtaggatgtaaaattataaaacctctataaggaaataagggaacaaaatctttgcaatcatggattaaacatttctttaaaatgacatgaaaacacaaaataaaaatggatatacagtattgcaattcatcaaaattacaaagttatgctcttcaaataacagttggaaaaattaaaagggaaccacagactggatgaaactagtttcaaaacacctgtctgatacaggacttgtctccaatatacatgaagaactttcatgactcaacactaaaaagagaacccaattaaaaagataggtaaattatttgaatgaactcttcaatcaataagatatgagggtgacaaataagtatcttaaaattggtcagtattacaatttgtaaatttaccttaataatgccaacaaaaatttaatgccatcggtgtttgctacagtttacagattataaataaatttaacttcaactgaaattatgaatatattcatttcactccaaatatataacgtttctgctgacaagtatagaatggtattgtcagcctatttcaaagactgaatataaaatagtaggtgtctcagatgcctaatgtgaaataaaacatgaggccataatgtaaaggcaacccaactcaaatgccagaactcatttggtcacagagatttccattgtaacctcagcaaaaggacaattttcttccactcgaagtcttttgttgcacattgatgccaacttgtctaccttccccttaatgctcaggagttttgccttcgactccatttcattgcatatgtaaggctgattgcttgttgtgcttactgattacctcatttaaagttttaaattgcattgtcttaaaaatgaacactatactatatgtgatatttagtaatgacgtaaaacctaaaacataaacttgcaggtaggaaagatttgcataattcattgagattctatgaaacactatcatattaggaatgtacacattgctaattgtaaaattatattccatcaaccatcacaaattgaagagtcagagtgtttaagtcacttaagttgttaagtggttgagtcctggaatgtgttttcagttttgctagacactctgactttgtctctggtggctgccactgtgtaattatgttccttctccttagagaagcaaagacagcaaaattaacactctcagatataggaagctatgacactgcacatcacatccacagaaatatacctactcatgctttttctaaaatgaaatatttgctccatacaaagcattaaacttcacacgcaaatcggaaaagtacaagaagagttttacaagtgcatgagcacacacattcacacacaaattgaagaacccattagtgttttaattctaagttttaaaaattgtgccaaattgttcttatttcttctttttttggtgtgctggaggctctctcactctttctgctaaaagtgagagccttatttcatctattttcgcctgccaggtagaggatagatgatgaataaaatttgagttaatttgcagaggtgttaggaaagtgtttgaaaaattgctggtgatcactatgctccaaaattgggtcatgaggagcaagtcccataagacagctcttttgccttttggatagatttattaacactggaagaactagggaattctgtaaaaaataatgtttctggactttggccaaacatctgagagggctagtggtagtgcactgaaatgcccttctaattctcatcacttctgataattcttcaagacctatccagatgtccccagttctgcaaagcagaccctacataatccaggtggagttaccagcagttcttcagtggctccacagaacagatgctctctattgtgcccttttattggctgtgtaccatgatgtttttaacaattggttttaacacagcctcatctactggaccatgattctatagtataacaaaatgttcagactccatgcaggcatcaatagatatttgatgaaagctatggttgaaatcctgcagacaaaatgaaaaaaaattactatgggtaacagtagatataaatagatagtcacaatgtggaaatagtatttgctatttcaaatgatgaggagtacccttacagcagtggtccccaaccttttcagcaccagggaccagtttcatggaagacaatttttccaggctgggtgtgggggagggcaatggtttcgggatgattcaagtgtgttacatttattgtgcactttatttgtagtattacatgctcatcacaatgtacaatcagtgagaaccctgagcctgttttctggcaactagatgatcccatctgggggtgatgggagacaatgacagatcatcaggcattacattctcataaggagcgcacaacctagatccctcacatgtgaagttcacaatagggttcacgttcttataagaatcccttgctgcagctcatctgacaggaggtgaagctcagcttggctcgctcacccacaactcatctcttgctgtgcggccaggtacctaacaggccatggagtagtgccaatccatggcccaggggttggggacccttgctttatagaatacaactttttaatcaaatttgtgatttggatagggatagctattatacagattccacacgttttcaccatgcggaacaatgggtaaatccaaaaagacagaatttaaacaggataaattaaaaagtcttaattttagattaaaatatttaatggtccaggatcaagacactgaggcttaaaaatcataatatgcatataagaccacaaaataatggataatgttcactaagctcttcttctgcattagcttaagtgagaagtgcttgccaagtgtcaggtaactcaattctcaaaacagtacaatgtagcaatatcagaatctgcatgtaaaagatgaggcaattgaaactcagagggcagaagtaacctgcccaaggtcacacaaagagtatgtgacacaacatgagtgtgatcctcagctctctggggttgaaattccctatgctcttttccagttaatcactgcttccaacctcagctataagcaccatgatctactgattcccaaagccgtctgggagttacttggcctctaaaaaattataagactctatgctacattaatagatgtattacggccagactaagagggctgattgttcttcaccactttttgtactttttgtaaaattatatttgtctcaattatagtatccccaggatgggaaagtgtccaaaaaaaaaaagagtggttaaagcttttgagaagactcggaaaaacacaaaacacaatggccatcttggaatgcacagagaacggcagatgcaaatggcacttttactttttgcatgcctcttggtgatgggacaaaagctggcaggaaaaactttttagcaattagaaatgtctaaaaataaatagactaatttgtgagataataaattcctctctacgggaaaccatttttgtggaaggtggatgacacataattgggagtgctatgaggctagcagatttgactaggtgactgcaagttcctttcctactctagggatccacacctttagtgatcaatgacctaggtagcagaacaaatgaaaatgttagagctatgcttaaataactaatttccatgccaatatttttgagtaatgtatatcaagcatttcttagttactgaccattagccttgttgccactgcctaacccggaaaagttaaacaacaacaacaacaacaacaacaactcatgcaagagacaataagcctcttaaataaagacaaaagatacacaggaggtagaacagatctatctggtgtctgatatgacagctgttttctacaggtggttcataaaccccattccctacccctggcatctcgttaaaattctccaggtcactaaaagtgataatagtatttgtttagaaagaatgtatttccacccccgaaacataagagtttgaacatatcaaataaaaactaccagcaattggaggagagatcacgacataaacagccaaagatggagtaacaccagtggtgagttttcagcatttacagttgtatacattttatgtttcatttgtaggcacatgttgtttatatctgaacacaagttcatttcttattttattttatgttttttagagacatggtcttgctctgttgcctaggctggagtgcagtagtgccatcatagctcactgcatccttgaactcctgggctcaagcaatcctcccacctcagcctcccaagtgctggaattacaggcatgaaccaccacatctggcctcactcattattttaacataccattggtctccaaatcaaataggctatgatacgtcatgctttaattgttgaaaaaaatgctaattaaaattaattgaaacttaaaatgcctcattttataggggaaaaaagtaaactttttttcccccaaatagtaataaactctagcatatttaatatatgtttcttaaatgttccatatggttttctacttatacgtgcatttttgaaaaagacatactgtgacttttatttctcattctatttcctatttttctcactcaacattgtgcttcttagtcctggcatctgcagagagacataactcattaccttgggccaatgcatagttcaccatgtgctacactttattccttgagggatctcctagctctttcaacccatacagtgctgtgacaaatgtctgctacacacatctccttgtgatctgcaggaggatgtctctaataatgcacaccagggtggactgcaggacactgggcaacatgcagactgaatctcatcaattcagtccactagcttccggagggactgatcagcaaacactgcaaccaggggtgcaggtgtgtttctatttccccaattcttgacagcacctggtatctttcgacttttggcaaaccaattggtgtaaagaggtcatctttttcttaaactgcatgtagaaattactaagaagaattctactttggtttggtaacttacccatttatgtgctttgctcagttttccattaggataagtttttcctttttcctttattgatattgtttccttatatatcctacttcttaggatatcttgctgtcaaataaccctactgtcaataatcacacctgtaatcccagcactttgggaggccgaggcaggtggatcacctgaggtcaggagtttgagaccagcctggtcaacatggtgaaatgccgtctctactaaaaatataaaaacattagccaggcgtggtggtgggtgtctgtaatcctagctactcaggaggctgaggcaggagaatcacttgaacttgggaggtggaggctgcagtgagccaaggtcatgccactgcaccccagcatgggcaacaagagcgaaactccatctcaaaaaaaaaaaaatacataaacaatcatatcttctcccagtcacctgtttcatacatctcttaactcttcagattgtccttcactaaatagagagatcaattttgatgtagtaatataatgtcactttttccccttaggattttccttagtgggggaaaagaaagtccattcaataaagcttttcctatcttgctgtcattaagatattctccaatatgttattctagacattttataagactacttttcacatttaggtctccaaaatattgaaagttttaaaggatctttccatgataagccaggtttctgtacaaggttatgctacctttatcacacatcaagtaaacatatattcatggggatactttctggactcctctatagcaaggatctatgtcttatcgtgaagactatacacacactttactactataaaaattttcttattatttggtaaggaaaggccctatttactcaagataaccaacttaatcttggagggaagagagtctgtggcatttgtgccacagcacactcctctttttgctaatcaatgtgagagaagctgtactctactttgagtggttggttcaagaagacagggctcactcgctcaccacctccaagtatagagctacgcagtgtttccaggaggggaaaaccaccagagtttctcatcctccacagctccatgttgtagaagctccctttcagacaaatatgattgagaggtatagggcacccttctttcacccaggccctatgtatggtggaagatctcccctgctgcagcatgctgagactaatgactctgattggccttgccccagcttgctcctcaggagaagattctatgctgggaggaggaagtttaccatccagccccatcgcccacttacagagcaagagtgccaatccaaaagacatggggcatgtcccggaccccacctccagagaagtggtataaatgtgttgcctgggaggacaggcaaggcatatgaacagagagttccagtgctctccttaatgggaatggctatatttaaaatagagcgtacagaactgaagaccaagtgtttgtttaaaacaatgaagctcttggtgttgaacaattaagagaagaatggcagctccttgatagcaataaatgaaatgacagatgatttagaagttagaagttttccagaaggactctaagaaagagatagctaagatgatccctcctgtagttggaacaattctcagagactagcagttagtgaaggttaagtgagtgtgatatcaacagacgtataccagcaggaagattcatagggggatgaaaaataaaaagagacagtgagacagcctagctaaaaccagtcaacctggggtcctgcggtgaggaggaggacattaaggaaaactgtgtacctgactaaggatgcaaactctgaggagtgacagcagaaactgaacagagaaaacagacctcaataaactattccagtcaagttaccaaataaataaacaacagaaacaacaagcactggttggagggtggtcagtattcagagtagcttcaatacattatctaaaatgtgcagctttcaaccaaaaaagttatgagtcacccaatgaaacatgaaagtgtgacccatataaaggaaaaacaacaacaacaaaccagacattagaaactgcctctgaaggagcctagatggtagatttaggagatggaagatttcaaagcagctattttaaatatgttccaagaactaaaggaaaccatgctttaaaccatgaattaaaggaatatattatgatgactcaccaaatacaggatgttaataaaaacagaaattattaaaaaataaatcaaaggaaaattctggagttaagaagtacaatagctgagatgaagagctcactagagggaatccacagtaaagttaagctggaagaagaaaatctcagcgtacttgaagaaagaccagtagagattatgcaacatgaacaatagacagaagaaaataaattgaacagagcctcagagaagtgcaggacactatttggcacactaacacgcatgtaatggaagcgccagagagacaggagagatagagagaaggcatgaaaatatcaaatgaataatagttgtaaacttcccatattcaatgggaaacattaaccttcacatccaagaagctcaataactaaaaatagaatgaacacagagatccatatccagacacatcagagttaacacgttgaaagtgaaagacaatgaaaaatgtgaaggcagcaagagaaaaattactcttccttaacaagagaatgccaacaaaattaacaattgacttctcatcaacaacaatgaaggcaaggaggcagtgggatgaaatattcaaaagaaacatacctgaaactaactacggagccccaaattagatgaagaaaaaatgagaaaattgaaggaagaaacagaaaattcagcaatgttagttgaaattcagcaatattagttgatttaaatatcccatttaaaatattagataggccaggcacggtggctcatgccggtaatccctgcactttgggaggccagagtgggtggttcacaacgtcaggagttcgagacaaccatggccaacatagtgaaaccccatctctactaaaaatacaaaaattagccaggcatagtggtgggtgcctgtaatcccagcttctatggaggctaaggcaggagaatttcttgaacctgagaggcagagtttgcagtaagccacaaatgtgccaatgtactccagtctgggtgacagaatgaggcactgtctcaaaaaaaaaaaaaaaattagtacaacttgatagaaacgtagatcagtaggctacactggaaggtccagaaataaacctggacatctttcttcttccaatgtgaagtagtattttaggcttcagtggtttggaatggatagtggtacagtccatcttcttatgcctgatgttttttcttgggtgatttcccccctcatgacatctgtttctattttctgtccaatacccagtcaacagaatcaggctcatgcttctcctgcacacagctctctgccccatgagttggcactgcccatttatccagccaccccaatttcacctatccttttccccaactcttgagcatttggccacaatcagtcaagtcttctctacattcaaccgactatatactcatcagaaagagagaactttacccttttctttgtctggttgtacataatgccatattttccccatattctttttcagcacccagggaacctgagcaagaccataggcacacacacagccatggagaagggtggcttctccccttccttgaaagcacctcaatttcagaactgattctcttggggattcacagttgagaatttgagagagcagaagccagaaaaataccttctgctccacggggatatgaagggcatggatgggatctggactttctcctcaatctcaatcccgtgcacgatttctccagttctgcctctagttcttgctcttgaggatgaggaggttacaaaccaggagtctctcatttaaaaaccggggttctcaataggttgctctttctatgcaatcccacactgagttttgaaagtcagatcaggaaagttgaatattttactgttttgagtaggtggcagttgcacaaaatataagatgaaatggcccagaaagtatgtaaaaagcaatgagaagattccagcacattgtaatatttaagggaaaggtggaagaaaatgagtcaatgatggaaagcagaagaatcttagaaaagagggagcacagaaaacatgatgctagaaaatctagagtgaaaaaccatttcctaaaggtgcagcttgtggtatcagatggtgtgaataagtcaagtagcttcagaaatgaaaatagtccattatttttggcaacctggagattaggaacctttagagcaattttaatgtcatctagtgggcagaagatataggcaataggttgaaagatcaatataaaatgagaaattagaggtagggattatacagcactcttttaggacatctgatgttaaggcaagggaaggatagcttcataaaatataagcaaagattttttttttcctctgtaaacttaggaaggaagaaatgacttgggcatgtttttaggtaaagaacatggggcagtgcaaagagagtttttaaaaatttgagaaacaagatggaatataaagcaagatttagaagaatatggaacaaaaatgagtgtgggagtttgtgtggttaaatgttatctttagaaagaagaaggcatcacccataagagaggggtaatgatcagagagaacagtgagaaactggagtcctactactaagcatgaggaagcaaaaaagagtggaagcttaaaaggaagaagatgaaggaggagaaacggagctccttaggagcaaggatgtaatttcacaggagttttaagagcagataagactcgaatggatgaacattgataatttctgaagggaagttagggataaggcatttccatttctgttactgacttctagggctcttcaaattgccccaaattctttttcagaattgccacaacttctcaaccacatctggatattctaacgaaatatgcatgttttattcctaacattctaacattgtttcctctgcccttctatttctgtactatagtaaatcagtcctgaacattctacataggaaagaatatcttttttttcttataacatagatgggctattctttaaccccttgttttcaggccccctttcagacttgccttgcagacacattgcctgaggaacctgaaacctttacgggttctactagcagatcagctcccacccctactccttaataccagcttccactcctactctttaatgccagcatgtattttggagtatcttttttttctactttatatcacaactgaaaactcttacactaatttccagtctaatagaaattgttcaaatgtcttatcttctgaggccctccaagcatcaatggtttaatccccccccacccccgccacacacacattcatgattctacagtaacttgaatggaattttagagagaagaaaactgaggaaaacccacccccttaaataagcaccataaacaatcctaggagacatgagctgtttattttgtatattgtacttctaatgagcattaaacaagcacacacccacttaagctgtttctcagttggctataggatatagctataactattgccaatctcaaacctctgcccgctccagaatcattgttcagtagctgtacctggaaatcatcttgtcttctctttcctctcattccagaataaaatatctattaaagtaagaagtaaatgcatgaaagaatacagcgctttgttatacctatccagatcctgaatgtaacagatttcatgtcctttgtaattatggaaataaaacttttactagaaataaaatataaaataagggtgggggaagtcatccaaacggctaatatacactaacaacaaggaagttatgacagtgcaggcaactgaagtgagcatttctatcccctcctgatgattttccaacctctggtacaattggcaagttaactctgactgaaaaagtttttttcaggtattgctgttaatcaaaggaaatcaggtccaatgttcatgtcttgaaggcacttctgaaacattagaaagtgtgtcatcttggcagccagctgaagtgcaaccatttggagcagatctatttatcaatacgcacagagagcaagtttaagacttgcacactggagctgaatggagcatgaagaaggggcagtggagaacacataaatattgagcaatgaccttctatttggaagttggaggcaatcccacacatgggcttttatgcatttagaatttatttctctgagttccaaggtgcaggtggattgtattaggaataaataatatcatgatccaggaaaccataggaaaaaaaaggttaccagcatgaaaaggagttattacctcaagtagatggcaatttcagaatggcaattataatttctttacaagaaaaaagcaaaacagccatttcatttagtaattatagaagtttatatattttttaagaaaaaaaccttcaaaaaacaatcattaccttggaaaatgtttacttaaatttgtctatttctaaacgcccactgagcacttaaatactaatagagggaatgtgtatctccaaaataaactgagttcttgccaatgaaccgtttggacaaaacacacaactcagaagtatagagatatattaaaagactgtcttgctaagagctccctttaaaaaataagtacatatgccacaatgccagttgagaagttggcatctacaaccacaaaatgtaagttaaaaataatttcatcttgtgaatatggaaaataataccttgcacttaatttccctccaattacttctactgcaaaattttatatgacaaagttacttttttaaattgcttatctatttattacaatcttagtacagaattccacctctttagcctcagaacaatgccagcgaaaattagactagcacacacattctgcagtatcgattcctaactcattctgaaaatcataataatgacatttatattttagtaacataaaaaacagagaccttaaaaacctgagcaacatcaatcttctcaacaaataatggtttgaaaaatacatacatttatgttttttaaattatttattatttatttttcaaatccaatttgatttctactacctccactcaaaacctattatgtctagtgaaaggggaggaggttttagacatcaactaatctaagactcactttatagattaagacatttgagttctagagaagtgatactaattgaatataggataaatccccttaagaaaacgaataccgtatcagtcatcagtaaaatctaatgtaaagaaccggtctctaaagtctttgattttaatgggaaaagataacagcctctcttttttcatcacgtaaattagcttcagatttattagttttgttaatatattcttagtactttaaattagtcacaccagctgagggggcagtgtttccctgttactagctgcccctctgggtaattaatggcttgtgcccatgcctgtgttacctctcttctccactgatctgtaatgcatttgccaccggactgtgttatccattcccaaacattccgcccatggttctctggttaaataattcagctcctcagaaagccagtaacacttatttttggtatcttattctatgtttgccaattttttacttatggtataattctacttttattgctttataaaaaaatagcaagaagcactagcattagtctaagaaataactggtactgcagtaatagatgagatgtcttaattctccttatctctgcaagggcccttaaattctctgcaacatatttcattctctggttctagaaattccccttaaattaaaaatatgtttcccgcacaaaagttgctaagtgctcactagctatccttataactgtacagaaccatggactcccacccactactcttgctctgtcacccaggctgaagtgcagtggtgccatcttggctcaatgcaccctctgcctcctaggttcaagagattctcccacctcagcctccccagtagctggaactacaggtgcctgccaccacaccaggctattttttgtatttatagtagagacatggtttcactatgttgaccaggctggtctcaaacttctgacttcaagtgatccacccacctcagccccgcaaagtgctaggattataggcatgagccactgcaccccggccataacctcaattttagaacaaggcaggtttcttatttctttatacgcaaaaagatttccatgatctgtgacaatttaaagaattccggttttggcccatcttttccatcagaactgagaaggaacacttgagaaaatcaaagaaataagacattgtgatgcaaactatctacattggtagtctccaaaagggggtgattttgccctccaggagacatttgacaatatctggagacatttgagtttgttacaatggggatgagaaggtgctacaatcatctagtcatctagtgggcagagggcagaaaggctgctaaatatcctacaacgtgcaggacaccaagcacaacaaggaattcgcaagtccacaatgtcaataatgcaaaggatgagaaccttgatttcagttctggctatttaaaatgctgtctccataccagcagctttggcctttcctaggagcttgttggaaactcggaacccaccacagacctactgaatcaatccacagttagcaagatccccaggtgactcatatggatagtccaatttgagaagcactgattatacaacacttaggcaattcttacatattctaaaagagcatctgtcttatagcacacaagaatacccttaacttaaataacagactattacagtatcctgtctctaatacgatattaacattagttccactgtgtagcatatgaaaaaattccattgcttagtaaatacggaaaattctggttagggaaaacaaacatactagaacctctaagaggctaatgcatcttaagaatctccaagaaagggatatcatagataccatttctcaaaattatataactctagaatctatttgtttcagagcttttaataagtctaagttttcatagaacaaatttccttttctcagcatggaaactaaacatacactgattaaggttgagatcactctcaacagagccttgaatgaattattacctatgatgcatgttgcttcaatgaaagacaaaactcaaggcctgtcttaacaatgaaagtctggctggaatcccacagaacctcaacaagagaaaacctttctcaagtgttaaccatgcctaagtagaaacttgcagaggaaaatttcttacatataaaaatccaggtgaaaaaaaatatcttgggtattgttgcatgttgaaagaacaaagcttatgactggagatgaattctcttcattcagaaatcatattaaaaagacatatgctttcatcacattatctgactactttagtgataaaacattttctttattatgtaatagaaaaactctgttaacaagcaactcttgggaacaactgcaaaatagaaggaaatacatatgagtaattcaatgtcaatggtgactttattatgcacataaattacatggagttgcagactgtctcttttcatcactaattgcattacagcttatgcaaggttcactgaatgaatagaatcgccttggtatggacagctttgcaaaactgtgaacatttccttagcaattaagaattccctaaggttgccacacactgggtacaaatccttggcatgtaatgttgatatgtggacatctataaataggtatgttacactatctagaaaaaaccaacaacaataacaaatagcatatctttgtaagtatgattaattagtaagacaacgggactggtgtcacacatacctaggttcaaacctgcacgtgccctatgccctggctgtctagcagcatcaagggaaggcctgcattttcctcaacaagcacttgagtggaatgtggcatgagtcacatgacacgcaaaaacagagaacacaaggtcttggcatcactctgttagcagtcacctttgttatatttaagatttccattcttaggactgcttagctattcagacatccttggatgagaaagagtcattttggtccaccagaatcattatcttggacagagcttctgaagacatactgaaccctatcaactctgctgaccaatgggagtggtatatcccagatggcattaggaacatactctaaagtatttgacttttactgagtatatcgttcattcccctaacgaacaatatgttcgttaataaaacccaaaataaaacccaacatgtcagtgtttactgtgagacacatggtgggttccaggtgtcaggaaggtttctacaaagatagccatgcgtgtattcaaggtcgttctgagcacaggattttaaaaaggtgagctctcctcactttttattattacatgtgaaattgttaaataactttgttcatttaacagtgattgaactgttaaattcaaagaatcaaatatgaacatagaagcatcaaatatgaacactttaactctctcagacattctgctttaaagtgtgcaatgtgagcgttccatgaacacagtagaaacatctatcccaggaaccggataaaccacactctaatctcagttttactaggagtatccacttcccactggaaaagacatttaatctctttgagcatctatttccttctcagaacaggagtaaaaggatatatatatatatatatatccttttatgtatgtatatgtacatgcacacatatacacgtatatgtacatgcacacatatacacgtatatgtatatgcatacatatgggatatgtacatacatatacgtgtgtatgtatatacatatacgtgtgtgtatatacatatacgtgtgtgtatacatatacgtgtgtgtatatacatatacgtgtgtatatacatatacgtgtgtatatacatatacgtgtgtgtatatacatatacgtgtgtgtatacatatacgtgtgtgtatatacatatacgtgtgtatgtacatacatatacgtatatgtatgtacatacatacacgtgtacatacacgtgtatgtacatacatatacgtatatgtgtatgtatgtatgtatatacatatacatatatattttgccacactcacaaggttattaaaaggattctttaggtaatacaaaacaatttacatgtttaaaattgataaagctgttcattgattccattcccttttctttacggtgcataacaattgcagctttctctcattaaggtttagggtaattgtttttctcagtgaatattacattgcatgagcttggcaggtaaaaatagcaacattgtttcttaaaagtgaaaaaagaaaacccacggagttttgagaacaattttgtgccccaatttacacctactaaatattgaggtagatccattctatcaatatatattgaccacctatttatgtctcaggtacagcccaggtgtttgaaacgtatccgtaatgaaaacacataaagatccctgtccttgtggagcttcaattctagcagcaggaggcagaacataaataatattataataaatcatcaaattatgtattttgttggaagatggcaatcacatattttaaaaaggaatcatagaacaagggggttgcaatttgaagcagctgagtcaaagtaggtgctttgagagggtggcgctgcgaaaagaattggaggagatgatgaagccagcagcacaaactctgatggatgaagtttccaggcagaggaagagaagggcaaaggccctggcaaactgctgtattcaaggcacaggaagcagcagtggagttggtcaaagtgagttgagggtggggctgcgagatgagggccaagaggtgacaggaagccctcaaaggaagaagcaggttgcccacaaatgtgacgttggggccacagatcctgggcacaggcaataagggtgaccttgtgaggaatttaattataataagaaaccaactggcattcagtctgcttttcttatcattatgtgccagcaattctaagcaatgtcacagataaaatactcctcaacccctgaattctttttagtctaaatgctaaataattgccgtggttactgtgaagttctaattgcgtgtaatatatggaacttcctgctatgtggtcaatccctaaaacatggagactcatgctgcatgcatttgggtcagttagaagtctgtagcggtccagaattgtgcgagtgctgtctgtgtctccaatccctgtgtcactagagtcctgaatttagattcaaaataacaaaactcagtaattataacagcaaagaaacagatcttcagttataatctatgtaagcacttggcagttgaattctatttcaaatttaaaacagtaaaatagatcgcaaactgtaaggtgtaatattttatgtgtgtatgcttgcacgttttagttcatacatttaatattttattttttatttttgtttttttaattttattattattatacttaaagttttagggtacatgtacataatgtgcaggtttgttacatatgtatacatgtgccatgttggtgtgctgcacccattaactcgtcatttagcattaggtatatctcctaatgctatccctcccccctccccccaccccacaacagttcccggtgtgtggtgtttcccttcctgtgtccacgtgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtattatgtgccacattttcttaatccagtctatcattgtacagctttataacagaaacttgttactgtgaaattattcttacataactgtaatttattaaactttaatgggattacttattattgtgagagaccaaaaaataattataatgttttttctattttttcccaaaaaaatgcactaatgtaattaaaaaatgttacatcattacttatttccttttatgtattgtaacatttgtttttattgctctgcatacatgaagtaaaacgaaagaatttcattttttcactttttgttcccagtcattactattattcatttgacttcatatttattaatgaaaataactttttgaataggagaagaaatgttaaaaaaaggacccactccagctgttgaatacataaagcagaccaatgattggaaggaactcattgatcttatttcttaaatatttagtgcatgaagtacaataaaatcacttagtctagcggccgactttattacttttggctgttcttctccacagtgggagagtttcattaatagttgaatcaataaatgaatcaataagaaaaagtgaaaaaaaacctagataatagtatttgaaaggctgacaggaatgtgtcaggccagatataggacacaggtaccaacgtggcactttatgtaggatgtttcacattaaagtagcttattttcttgctttaaacatctagaaattacaacagtaattgttatgtccaactactataagagttaagtcctgtaaatgataccaagcggctgtgccgggtgcagtggctcacacctgtaatctcagcaccctgggaggccaagacgggtggatcaggaggtcaggagatcaagaccatcctggttaacacagtgaaaccctgtctctactaaaaatacaaaaaattagctgggtgtggtggcgggcgcctgtagtcccagctactcgggaggctgaggcaggagaatggtgtgaacctgggagccggagcttgcagtgagccaagatcacgccactgcactctggcatgggcgaaagaacaagactccatctcaaaaaaaaaaaaaaaatgataccaagcaatatatgttatttaatcctgctggttttacaaaaacataacagcaaaggaaatctgtcatgactgcccactatatggtcataaaattgaacaattgatgcttgtcacccataagtcaaactgtggataactatgaaaataaacctattttaattgatttttttatctgttagagaattagagatatgaagaattcagtttgatggcaaaaaagcagatgtattctgaaatcatcaaatagttatatatatgtatatactttcacagtatttttttgtaagagacggggtctcactctgtcacccaggctagactagagctgcataaccatcatagctcactgcaggctcaaactcctgggctcaagggatccttctgcctcagtatctcagatggctgggactataagcgtgcaccaccatgcccagctaattttttaactttttctagagacggggtttcactgtgttacccaagttggtcttgaactcccggcctcaatcaatcctcccacctcagtcttcccaaaatattgggattacaggcatgagccaccatgcccagtctaattttttgatatacaatttcaaactgcaagctagaatggttccctcccccacatttattatattatgactcaacagaatgtgaaacaggtccatataacacagaatgatatcccagaaattgtgctcatcttcacaacactatttttaaaaagttacattaaaaacactttgtatttgcctaaaaaggttaaaataaaccacttcttcctatagttatgtatactaaattcaattatacgtgaatgattccttatctagattttttaattttccttttttaaaaatttctttttatccagatatttgaatatatcaataatcattatagcctttcaacaactgagaaccactgttagtgcaataattaagaaaggattaatagcacttccagatacttctactgtatttttgtgcacttgtaactgtttcatttttagaccagggaaataaaaatatcttgtccttactgcttatctaagtttacatccttatcataaaatgcttaggaaaacaaacagcataaagaataaaataacaatcacattacctgtgaaaaagtacagtaggaaatttcatctatattaatatttattttatgaaaataatgttcaacttttaaacataaacagtacattatttatctagctttattgttttattttttttaaatttaaaatcctatcttccaccatagttcttgtcaatatgcataaatattcaatatgcataaaacatatgattccattttatgtatttatctcagcagtcctctgtgaatcttctttctttccttttctttttctttctgtccttttttcttctctgtccttttttcttcttctgctcttctctctgctctctcagtccatgagcccatgggccctccctctagccttgttttttgtttttccttctttattactgtggataaaatatgctgaatatttaccatgttatgttccagctgctgtgcttagagtcttatgtgtatcatcctagcttccctcacaagtttctgaatagccattactggtggtattcattttataatgaggcaaaaatgaggcttagagagattaaggagttgcccaaagtcatcaagacggcagacagcaaagctgggattcatattcaacagggtctgtttccagtgccagagcctttcacaataatagacacggaaacacacattctcaaggatgtgccagtgtactcttgcctgaacgtttccttggaatacatttccatcagtggaacaattcacaggctaacttaaaatgttggatacatacttccaaattatcttcaagaaatattttaccaatgatgcatggaaaagtcctggcttcctatttcttaggaaatatcaagtaaatttcgtttacttgatattttaaaatattttttgttcaatttgtctttttgttcctatctgctaaggcagaagcttttcttcccttcctctctaagaccctgttcttcctgatcatggcacaggagcaggccaaatggcccagcctcctgcagaacgtctgcagatcgtgagtttcctcaagttgcctgacctccttctgcaaccaggtggaaaggtgcaccctggtctctcactgctcaggaagctgctgacacttggggcatcttcagtctccctgcacacacagtgcttccaggacatcaaaacagccacacattctcattggcatccttctaaaactgacctttatttttctgtcttctattctgattcagcctcctccccttccagcactttcagtacataactagtaaaattcttgcacctgcagagtactcggtcaccactgtccctgtctccatcaccctttctgctcattgagcaaactctactgttctttgctctcttcctctttcagctggactccatggtgtatttaaaaactcagccagctttcctcaaacactgccccaccccaattcttttgtcaattttctggtcattgctagtccggcaaaaagtccaagcctggatcaataaagctgtctgccttctccatgtctaagttccaacaaaataacttcagctgcaaaaagagcacaactggacaggatgctgttcaggagaatccacgctgtgtggaatccaacatcagctggtcctccttcagtgttccccacagcatttcttattccctaccaacctgtccctgtcatctccaccagtcactccagccactgaagggtggcttccatgcaagccactttgctgatagtgccccccgcaagccccttctatctgcttgtcagtgaaattgtacttcacctctcttctataattgaaataattttctgctagtttctatgacaactcacacccctaatgttctcacaaacaattcctgcaccccacacaattctttctgggcttctccacctgtctgataaccattggcgaccttctcaaggttgcatcaggacctgtgctaactctacactctgtcccttgacaattctcaccttctcacgggcatcccatcactaactgctttcctaacgatacctccacatccagccatgatcttgctctagagtccaagcttatgcatctaattgtgtatttgcctgtttccttagaaatccaggtttctgtcctcaccacctggataaagtatagtcatgttcacggacagagtcacggacagacatagacaaaggagcaggcttgcttggctaaatcttacttaactttcaagttttagcctagatattgccttctatatatgttaaatctggatttagtacatttctattctattgcatcctgaacttttatcatatcacttagcacatataatttcttatataattttctgtctctctgtcatctgtaaactggctccatcaatgagggcagagagaacagtgactttttttttttttttttttactattatattcccagctttatacagtacacccagcaggtgttcatgctaccaagataaactgaactcaatggaatttaattctgcctgggaatatgggccaccagacctaggctacttggtcctgccctgttaatagctatgtctcagctgtcactttctaggaatggtgatgcagacattttcctcaaaagcccctttctccaaccttatcaactcttgctaagagatgccaagtaagctactgacctatccattcttcagggaagaggaatctacagacccacttgggttcagctttacaccttgctgcacttggaaagtcctccccaaaattatttttcccccaaattaatttatattttttaacatgccataatctttaatctacctgatgcctgttttgctataaagttacatttttttccaattagtaagttatcttagcactatttatttaattctttattctctcatgatctataatttcaactctgtaactagcaaaatcttctagcaccatggcaaagaatatagaccctagagccagctgcctagatccaattccaccatgacactcaatagactttgagcagatcacttaatctcactggattaatttataagtaaaatgcttaaaatggtactgatagagagaagatctttatgcgttactgtgtattgttactgtaatctgatttcatattttattttcagctccatttactttattgttgaacttgtgccacattaattgctgtagatggataacacatttttgcgtctaagagaatattaattcccatccctttcagaaaaaaactacttttatattcttatgtaattattcctatagtaaaattctttgtcctccaaatattaatttaaaaagtcaactaccacttctgtatttatttttatgggtcaaagcattgtattaacagctttatttacataggtaatcaaatttactcatatgagatatgctttattattacatttgctttatgaattaggagaataaaggttgcaaacattaagtaacccaggttgtctaagtccaaaatttgtaccctatataactgtaacataccactttcattaaagaaacaaacttattttgttatttttatttttatttttttaagacagagtctcgctctgtcacccaggctggagtgcagtggtgttatcttggatcactgcaacctttgcctcccaagttaaagtgattctcctgcctcagcctccagagtagctgggattacaggtgtgcaccaccacactcagctaattttgcatttttagtagagatggggtttcaccatgttggccaggctggtctcaaacaactgacctcgtgatccacctgcctcagcctcccaaagtgcagagattacaggcgtgagccactgcacctggccataaagaaacaaactcttgatgagattgggataggatttgggttaaacacagacaaatttggggggaactgacactgttgaatactgtcttcttgttcaatattgcggttactgttttatccaatcatttatgctcttcattaaggttttatattattaatatagctaaggtttacagtttttactgtattgtaggcactatcagaatgctttacaacaattaattcttctaagtctcacgatgaccatatgactttggcattattattatttttataattattataatcatttcacagaaaaccaagacacagagaggtccctttaaattaaatgactgaatgacttaatatcacctagccagtgagtgacaaaactagtatttttgttatacactcttggttccagaacccatgactttagtcagtgatatgatttgaatttgtgtccccacccaaatctcttgttgaattgtaatccccaatgttggaggaggggcctggtggaacatgattggatcgtgggggtgatttcccccttgcagttttcatgatagtgagtaaaatcccatgagatctggttgtttaaaagtgtgcaacccctcctccttcactctctcttcctactgctccagccacagaagacatgcctgcttcaccttcaccttcagccatgatagtgagtttcctgaggtctctgcaaccatgcttcctgtacagcctgcagaactgtgagtcctttaaacttcttttctttatacattacacaatctcagtagtcctttatagcaatgcaagaatggactaatacagaaaattggtactgagaagtggggcattgctataaagaaacttgaaaatgtggaagtgactttggaactggataatgggcagaggttggactagtttgaaggggtcagaaggagacaggaagatgtggtaaagtgttgaactttctagagatttgttatattgttgtgaccaaaatgatgatagtgatatggacaatgaagttcaggctgaggtggtctcagatgaagatgaggaacttactgggaactgaagtgaaagtcactcttgctatgctttagcaaagagactggtggcactgtgtttctgccctaaagagctgcagaactttgaacttgggagtgatgatttaaggtatctggtggaagaaattcctaagcagcaaagtgtccaaggtgtggcctggctgcttctatcagcatatggttatatgcatgagcaaatagatgatctgaaactggaacttatatttaataggagagcagagtaaaaaagttcagaaaacttgcagcctaaccatgtggtagaaaagaaaaacccattttctggggagaaattcaagccagctgcagaaatttgcataagtaaagagaagccaaatgttaatagccaaaacaatggggaaaataccttgaaggcatttcacagaactttgcagtagcccatcccattacaggcctggaggcataggcaggaataatggttttaaggcaggcccagggccccaccactctgtgcgacctcaggacactgctccctgtgtcccagccactccagctctagccatggctaaaagggtcccagatacatctcaggctgctgctccagaggttgcaaaacagaagccatggcagtttccacatggtatgaagcctgcaggtgcagagaggacaagaattgaggctttggagcctctgtatagatttcagaagatgtatgaaaatgcctggatatgcaggcaaaagtctgctgcaggcgcacagccatcatagagaacttctactaggggagtgtggaggggaaatgtgaggttggatcccccagacagagtccccactggggcactgcttagtggagctgtgagataagggctaccacctttcagaaccagaatggtagatccactgacagcttgcactgtatgccttgaaaagccataggcatgtggcccatgaaagcagccacagaagctgtaacctgcaaagccacaggggtggagatgcccaaggcattaggagcccagcccttgtatcaccatggcctggatgtgagcaatggagtcaaagcagattattttggagctttaagattaaatgactgacctgctgggtttcagacttgcatgaggcctgtagcctctttgttttggctgatttctcccttttggaataggggtctttacccaatgcctgttcccccattgttatcttggaagtcaataatttgtttttattttatttattttttttattttacaggctcaaaggtagaagggtcttgactagtctcagatgcgactttggaccgtgaacttctgagttaatgcttaaatgagttcagacttgggggactgttgagaagggatgattgtattttgcaatgtgagaaggacatgagatttgggaggggccaggggcagaatgatatagcttggatttatgtccctgcacaaatcttatgtcaaattgtaatccccaatgttggaggtgggtcttggttgggggtaactggatcttggagatggacttcccccgtgctatttttgtgatagtgagtgagttatcacgagatctggttgtttaaaagcgtgtagcacctccccgtttgctttcttcctcctcctacggccacgtaagacacacctgcttcccttttgccttctgtcataattataagtttcatgaggcctccccagccatacttcttgtacagcctgcagaagtgtgaatcaattaaacctctttttgttatataaataactcagtctcaggtggttctttagagcaatgtaagaatggactaatacagtcagtgagctttcagactgactctcaaataatttataaatttccagctatttatattgtattgacatttgtgaatggcaccttttctcactatattgttattgctagtctataggaaagcattgtttctttattttcctttttaaattttattttcaagatgtagagcaaaaatttatgttactgggtttttgattgttctgatacacagacattgtgaagtaatcaccacaattaagctaattaacatatccattacttcatgtatgaagttgtgtgtgtgatgggaagacttatgacctactctttcagcaagtttcaaatatacattattaactatggttaccatgctgtacatttaatctcaagaatttgttaatcttataaatgaaagtttttactctttgacctatatcttcccattgcccccacactcaaacccatagcaatcatctttctactctttttctaagggtccaatttctttaaattacacatataaaagagatcatgcagcatttttctttctgtgtctagcttattttacttggcataatgtcctccatctatgtttttgcagatggcagaatttccttcttttttaaggctgaacaaaattcgtgtgtgtgtgtgtgtgtgtgtgtgtgtgtgtgtgtgtgtgtgtaacctacaatttctttatccattcatccactgacagacatttaggttgtttccatatcttgactattattaacaatgccacaaggaatatgggaatgcagatatctctttggcatactgattttaattccttttttaatagtcccacatatacccattatagtgcgattgctgtgtggtagttctgtttttcgttttttgagaaaatgccatgccctaatgtctctaccaattttcagtctcatgatgagggttctcttttctcctcacctcagtaacacttgttatcatttggcttttttataacagcaatactaacagatgtgaggtggtatctcatcatggttttgatttgcagttccctgatgattagtgttatttagccctttttatatacctgttggtcatttgtatgtcttccttggaaaaatatctatgcagttactttggtcatttttaaattgggttatgtgtgttttttgtaaatattgaattatatgagctctgttatatattttggatattagccttctagcagatacatggtgtgcaattattttctctcattccataggttgccttttcattttgttgtttcttatgctgtgtcaaaactttttagtttgatgtaggcttgtttggtttttttttttcccttttggttgcctgtgatttgggagtcatattcacaaaatcactgccaagatcaatgttaaggagcttttttgttatgtgttcttccagaattgttacattttcagggctcacatttaattcttattccattttaagttgatttttatgtatggtttaagattaagggttcaatttcattattttgcatgtggatatccaattttcccaacaccatttattgatgactgtccttttccctttgtttggtcttgatgcctttgtcaaagactagttgaccgtatgtaggtgagtttatttctgggatctctattctgttccattagtctttgtgtctgtttttatgccagtaccatattattttaattattatcatagctcttcagtacacttaaaaatcaggtagtatgatgcctccagctttgttcttttgctcaagattgctttgctcttcctggtaccataaaattttagaattatttttctatttctgtaaagaatgtcattgggattttggtgcagattacagtcattcaacctgtagatcactttgggtagtgtggacattttaacaatactaattattccaatccatgagcatgggttatctctcaatttgtgtcatcttcaatgtctttcatcaatgttttatacttctcagagtatagatctttctcctctttaaatttattcataagcatttttattttttttgatgttattgtaaatgagatttttaaaagattttcattaaagaaactcactgttaattcaatattagtgtatagaaacatgagtgatttttgtatgctgattttgtagcctacaacttcactgaatgcattagttctaactgttcttttggtggcattttttggtggcgtctttagggtttttttttttacatacaggaccatgtcatctacaaatttcacttcttcctttccaatatggatgtcttttgtttccttctcttgactaattgctctggctaggacttctagccctctatgctgaatagaagtggtaagaatgggcatccttgtcttgtgtctgattttagaggaaaagcttttagcttagttccatccactgtcaaggatgatgttagttgcagccttgtcatatatggcctttattatgattaggtacatttctctacctaattggttgggagtttttaatcatgaaaagatgtttcatggtgagacagataaaaaattgtcaacggtggggagcactggtttatgtatattatcttgctgccctgttggaagattattaattctaatcgtttatcagtcagttatactgggttaaataaatcatttagtttttcaacattcaaaatttatcattttatattgttttaaagaatgttttgattagcacttactgaacaattttaaatagatttagcactaaatacagttgtccatactgaaccttagtgggaatgcctctagtttttcacatgtaagagagacttaactatttttttttttaggcagataatatttaacctgttaaggaaacattggggattaaggttcttatattaagtcagttactattatttcctggatctttcattatttaaggtgcaaccaccacccccattctgcaaaacacagccatatatttcgtcaagacagcattacatcaaccagtaggactctgctctccacaacatggatatctcacaattggcattcgtaaagtaaaagaacaggattgaaaagaaactcattattcttattcttgtcatgatcaatccttccaagtttacttaagatcattccagaataaattatattaatagataatttttaaggaagaagtccatacattgttcagctcaaggtcatgtgtttttagctgaaataaaacacaatacaaatggcaaaaagctttgcttatattgattgattattttcattcagagcgtaggaatcaaataagatcaatccatatgtactagaagcaaccctaagaagctttcatacatttcatgtatggttacccaggaagtaaacatcacacacactgtggtttcagtaattgaaatggctgctaatgtggctccaggtttcccaagttgctactttttttttctttcaatgatgacacacactcatttggtttctaatacgggacgtactgagtcagcgatctttgacttatttccataatggtgtcataaatgttgcacctgcagcagattattctttgattcagtaaaaaaaaaaattattttagttttaaagtagctctgaatatttccattccaaatctgtttcaggattttagaattcagacatggttacataaaaagagaaccataaattggcatgagactataaattacagtcaaagaagacccacgtttcaagcaagatgaatctggatttttaaaatttttatgcatgctttttcagttttaattcatatatacgttacctagaaatacaatcaataagtggttttatgtctctcctctttaattctgtgtgaaatgttaccctttgcaatggtcttgttaaacactctagaaaaaaagagcagtctaagctgactttataaaacctctacctttgttcagcccaaccctataccatccctgcttctatacccctgctgaacactcccagaaaaaaaaaaaatatactaatgtgaaccagagtcactatgcaacctcatttttgccctcagtgtattaggtaaaggttctttgttttccagattctctctgtcagtcacggcacaagttattccaaacacacattgcactgttaccaccaatgaccccaccacccaccaatttcaaaagataactcatgctcctactgatccacgaacagtggaaactcattgacaggaaagtcttcaccctctctcttatcgcaggtgagtgttaatgcagagccacaaaagatgcacaactaccagctttgtaactatgcaagctccgtaacagtgaggaaaggaagtcaatgataaaacagtccatcccaaaaattctgagatgcacatttcttcaattttaatggttctgaaatcagtataaagaagacaggcagtgtcttcttacaatcactttcggccagatggtggccatggcagaattctcaaacctagcacaggtgagaacttggccctctgcgtatcattcaacaaacgctctaagggctttgagttaggaatatcagttagggctgttgtctgaaaacattccagtgacatattctgatgagaccaagaaaataaaacttgaagaatgtgtctcaacagcttgtaagtcaagcacagaaggcaatcgtgaaacacttcttaaaaatgtcctgcagcctcaccacttttcatgtcacagagggtggcagtgtggggaaaatgaagacactgatggctcagcatcaaaagtgattcagaagagaaagacagtggaatattttttgggaattctcagtcaccttactgaactcgtattttcattttttaaagaatgtgcaacaataatataatcatacatgataaaaatttatatctagataagtctaaaccagcttttccaaaaggtataaaataaacacgtgaagtaataaaaaagcattgtgtcctacttttcatgctaacatctttgtatttagctatctctctctctgtttccttccttcttctttctctctcctgtttctctctccttcctgccttcatttcttcctcccttcattcttttcttcctttcttagtacataaaataaccgtatgtattaaattcaaagtgtctcaggttttatgagttggcaaagatttaaatagtgctagttaattctgaccattagtcaaacaattagtgacaatcacactaaagactgacaatacaaattgcaatttttcagattagtatgctatttaagaagtacattttgaataacttcaatgggcacatcaatcaaaataatttttaaaaatcattttgataaacctattgtgcataaaactcaaatacctttaaacttaaccccaagtctcagtatcacacaatatatgcatgtaacaaagttgtacatgtacccccgaaattagaagttgaaattataaaaaggagaaaaagaaaaaacgtaaacaatgcttcatattttgaatgatacaaaaacctaagctgcttcttaactttatgacttttgttatacagatggttataattctatttaaagtggttgaaaatcattttctccaaatcatcatccagaagaacactttatttttattactaaagcaaatttttatttttcaaaaattaattgctatattcatattttaatctattacacaagtatttcctgaaaacctatattcaaattatagtaagcttcctcttcaagttttatgaagattgtgaaacttacttacattattacatctttttaaccaagtaagaataaaaaaaaattcttgaaaatatcttgtatgcatgtgtgtgtgttcctgttgactcatgatccattgccttcattacataaacctcgtccaagtaacctttcacaggtgaggaaaatataattgctagcaggtgagaagcaagagcaagatgaagaactaaatctgtattaatttccctaatacatgtcagagatattgtgaatagctcggtgacagtggtgcattctgaatctatctgttgttctccagcagatcagatgcagtcaagtcaaattactgacaaccaaggaataaacagaatccattatgggaaagctcttatttcctggcttcctgtgctatctgtattgttgtattccgtggaaactcactaaactgaaaaaaactgacatccctcatctttgtcaaggccataaaaacattacagtcaatgtcttgaactcacttaagccccctggcttcacgcactcagcttgtaagctttccataaacgacagctgattgctgaggggaggaagtgacaaattagtgaattaaaaatttacactgcgctatatgaatacatttcctgacaatcagcattactggctgctaaaatgagtttcaaaaagatgtacagaccttgaaattttcaatcatagttttatctaataacacaaatcacgtttttatttagtttacaaaggactactgaaaagaatttagagatcaattatgaattaaatattatcataaaacagagcttataaccagatcacatttagcaatcatttgatagtttaataaaaacttttaaaaattcatttcagtcaattgtgttttaatggtagattatttacttgcaaatgtggttcaccctttgtattcacggttcctcatccacagattcaaccaacggcagatcaaaattatttggaaaaaaattttaaaaataaaacaatacaaataatacaagtaagaaacaatacattataacaactattttcatagtatttacattgtattaggtattataagtaatatagagatgatctgatgtatacaggagaatgtgcataggttatatgcaaataccacatcattttacataagaaacttgggcatctgtgaattttggtatctgcaggtcctggaaccaatcctcctcaaataccaagggcgtataccagcaagactgtattcttaatatagtatatgcaattaaaatgaatccttaactcctatagaagaataagttcacgtgtggactgtagacttgaaggcatcattctcttgtctggtgcattatagctttcaagtgttagcatgcacattgatgcaaggacatagagctgatccatggctctatacccagaactagaacaaggaaacatggaacaaggactcctgatgcctgctcaatagactctccctacacaggtgcagtggctgctccataccatccagcatatgacacgttaaggccaaatgcaactatgatcagggccactgtttcctgcattagggcctcgtgttttaatgctctttttctccttgtctcttcaaggactctcttcagtggtccaaagcctgagaacagttgcttcatatatttgtctagttttataactatttatgtcatgagtgtacatcagctaccagtaacgtctttatgaccagaagcagaattccaggcaaacacatgttaagaagggttcttactgtagtagtaatagtatataccactttgaagagaattgtaaacacttaacgggctagaatattggatacttatcctgaagtagtgagaagacaggatgaaatcagattttgaacttctttagctgtcaataaagagtctttattagattagcaatggagaagctttaaagaaatttgagctggtgggatgagctcagcagtttgtgcttgaagaagtttaatctggctgaatttatcaggcaatagtaatagaatgagatgtccataggcagaccaggcaagaagctgctacctgaggtcacaaggccatgaaaaaggatgggggaaggagaaatttaatgaaagaataggaacaagctacttcatgaaggtctgctatttgatgagtatggtacgagaaaagtataagttaaagtactatcaaaagtgttgagcttgcctgatttaaggagaaagagaacaatcaccggacagaagggatatctgactctgggaacaattacattaatgatatcattttgactttgaggctggtaagatgcctaatgttgaaagaggagatgtccagatggaaatgaccagtagatgcctaaaaatacgggtcttcagcctctggagtaggctcagtttcccaaaaatctgaggatttcatatacaggtaggcaatgagtgagttacagaaggaaacaaatgggtcattggtataaaatagaatttgggaggaaaaacaagttgagaaagagaagatggtgacattgaacgtgtttcaattattgatagtggtacccttaaaaaagtcacgtatttaaaatattagtctagtttgcatgtgtgtgcatgtgggcatgtgttgcaagctgatataataaccttaaaaatgtcttagttctaatggcataaattatccagatgataaagtaaaataaagttaaagtacacaaatctatgtaggatcaatataattaaaagtaacatttaatttaaaaatcttgagaaaaataacaaatggaaacttttaaagaagaatgtgagagttgaaaatgtggcttgatttctgaaacatggctactcagttgctagatcagagaattatttgagtaatatttatcaaaaaacaatgataatacttgcttttaatgaaaataggcctctttccatttttggtagccacagtgagtggctttccgaatggcctaacatagatacaacttatcacccactttagatgtgtactgttataaagctctcttgtttacataattttaaaactttattaaattaattttgagataatctaattaggtttcaggaaaataaatgttgagaaatacaaacttcttaaaagatcagattaaggaaagtcacagacttgaaaaaggtgtcatttcaagagatatgtaggctatggattccacaagacatggtgcctcatttaacaaatcaggaaactaagttactagaaggtcccataagctacttattaagaaagtattactatttcagttctgttacttttttattgcaaacttttgcaacatctacttaaccttctgaacttgtttctcatctctagaataagcgatctaagatgtcttccaaataacatcataggacctatgtgacgaaatggcttttgtgcctttgtctagcactcttcccaaacctacaggttcatgcttacatctaactccttactatcattaatacagatctttaaaaaaaaatcatcaatttcctagtaacttttgtaacaactgctttatttgggtttagctagaaaaagaaataagcaatcatcatacatgtctatttctgttccctaaggattatttgctttttaaatttttttccgataagctgaataaatttttctttttatgtctttcttggttttatatatgtcacggactggtaccggctggtagcctgttaggaactgagtggcacagaggaggtgagcggcaggcaaatgagcattaccgttcaaactctgcctcctgtcagatcagcagcggcattagattctgtattagggttctctagagggacagaactaataggatacatgtatatatacacacacacacaaacacacacatatatacacacacacatatatacacacacacacacatatatatacatatttctgaaacatggatacatagttcatatatacatatatacacatatttatgtgtgtgtgtatatatatatacatatatgtatatatacacatatatatgtgtatatatgtgtatatatacatatatgtgtatatatgtgtatatatgtatatatatacatatatgtgtatatatgtatatatatacatatatgtgtgtatatatgtgtgtgtgtgtatatatatatatatatagacagagagagagagggtttattaagtagtattaactcacacaatcacgatcacaagatcccacaataggccgtctgcaagctgaggagcaaggaagccagtctgagtcccaaagctgaagaacttggagtccaatgtttgagggcaggaagtatccagcactggagaaagatgtaagctgggaggctaagccagtctagacttttcacgattttctgcctgctttatagtctagccatgttggcagctgataaaatggtgtccacccagattaagggtgggtctgtctttcccagcccactgactcaaatgttaatctccttcggcaacaccctcacagactcactcaggatcaataccttacatccttcgatccaaccaagttgacactcagtattagccatcacagatggatgcataaactctactgtgaactgcgcatgcaagagatctaggttgtgcaccctctatgagatgggacagtttgggcagtttcatccccaaaacatccccctgcctccccatcccaaaaccccgtccatggaaaaactgtcttccgcaaaactgggccatggtgtcgaaaaggctggagatttctggtctacatgaaagctgccagtaaacaaataaagtggataaaatatttctagtctgtactcacttgagaaggagcacatcagagcattatgtcaagaccaggatggtattaagccatgtgttgtgagaatgagaagtgaggaaggcaccaaatgattcctagctatttttaagatttttgttttaagaaatgcctctagtcagggtctaaggaaatgcaagactccaacacagcacccacaaagtcactgcagatggcctgccatacatttgtactttctgtaaagtggtcgtggcatcataaaaaatgtgtctgcataattgatttgaaatataagactgataaaaattagatcaccctaatgttctccacttgtcattagattgatctatattaaaaagacaatcaaattttcccattaaagagaagatattcaatcatgaaattgagttttccattcctatctgcaatcaacattttaatatatacagcctgtcaataagtacagcggaaaatagagttatataactattaaggtgcttaatgagtagaacagagatattcctggaagaaaaagatgtctattcctggaaaacaatgaggaaaaccattaaaatatgatgtcttcctaacagcatgaattaaactacatatgtgtgtataaaatgcagtgatttcaattaacatgataaattcttttcttaattaccatccccaaatactctattccacagcagtatttagaaacaagagactaataaagccaaactttaaacttgtaaaaaccttaaaatgctttcccaatacaaagactgtataaatcaaagattattataattaaaataatccagaatacagtcataatttgacctaggaagaataagaaaataagtacaataaggtgtttgatatgtattataatatttaaagatatcctttatcattgtattcatagctaatagcattaagtaacttattatgcttctaaattatattagtttgtgaaattaaatttaatgatactaaaagggatctgattggcaacactccaaattagcatttcttagcaagccaagaaggtagaaaccatctcaagactagatgctatttcttcttcaaattccattagttgccaacatatttcaaagctacagggaacttaacacaaaaggtttagtctagaaattcattcagacctgaatgcctcagataaagctgctaatgaaaatgttattccataataatataaattggttgctaaccttgatacctttattcaaaatatctaccaaataattatgtacatactatattgttatcaatagaacattttttaaaagttcacttctgtgtcataccttgacaaacattaagagttttcagggctgactgtattaagacgacttaaaaattaaaatacaagctgggtgcggtggctcactcctgtaatcccaacactttgggaggccaaggccagcggatcacgaggtcaggagattgagaccatcctggccaacatggtgaaaccccatcgctactaaaaatacacaaattagttgggtgtggtggctggtgcctgtaatcccaactactcagcaggagaatcacttgaaccagggagtgggaggttgcagtgagctgaggaagtgccactgcactccagcctggtgacagagtgaaactatatctcaaataaaataaaatatataacttactttaaagtttgtaacataaactcatgaaagtaccaaaataatttatcatagaaaaaacatttgctcatttcctaagtttcagatggccttcgggttgagatccttttcatctaaattattacctccaattcatttcactcactatttcctccatggatacttatcagggaaagctagaattgataacttagtcttccatcctccacagaatgaagtgctccatcaggtcttgttcagggaatgaagtatgaagtcctctttattgttggattaagtatataattgtaaaatgaaagcaaattaattgtattgtgaaatcactgctttgaagaaagaatcctagtgaaaggaatgcctccccggaatgaaaattcatgaaatgttaatatttggtgtcacggggtttccattactcgagttgccagccttcttttgatggtgagcatcaaaagatgctgatggtgaattgaaattcaatttcccaaccagatttcctatgaataaataaactcacgcttgagtttacagataactgggttaatatttgctattggtgaatagtgcatctccgttcagagcttaatagagaaattgtgtagctcttgtatatgtggtgaatccgtgggctagctgggaaccttgcctgtgactttcagctccactacttaccagctatgagatagtgagcaagttattccatccagctgcttcactgaaagaatgcagatagtgatacctacattacagagttgtggtactggtttatataagtggttctgaataacatctagctttaccatatagcaagatagttcctgaaaacagaatgcctgaacccgtgtataaatcttactacattttcacaaccacaatgttatcatctttagggatttcacttgaggagaaaatagactaagtgacacaaggattttctcttgtttcattagtaatttggttttacaattcaatgctatacggaatatcatcttcaagcatggctacttcccagggagttttccagaatgacagatttatataatgtcttatatattcaatagaaaatatcaacttgctcttcttctctctatcttaatattgatgtgaaactgaaaacaaagtgaggtgtgtattcaggggccagttgaatcacaggaaagagaggcagtgaagaccctaaccctttcctgtctcacattgtttaaacacatttgctttgtccttccaagtggaccacaagggttatcctcctgtttcataaatatagtgttatgcttaagatatgacagcagaaatatgtaggggaaaacaaaatgcatcatatttttccttgataatcatcaatcaggaatcatatatattatgagcaaagaaatacactttccaaagatctaagcatgtactagatttgcatgcagtgaccatatgattattaaattttttaaacaagatgaatgtgtactacagaatgatagccaagaaggatgacacttaagccccaaacctaacattcagtggaatcaaggcatgtacacaaattgcaacctgaaataaactcatagcctgtgacataactgcaaagtttgtgcactgccaaaaagcacctggagaaagaggtaattcgaggctgtagttggactctcataggattgtctaagctatgcaccttggtctaaggctgtgtcttccaggaggaagaaacatcccaagtcagcagacttatatcaacccagaggggaaaccaaaccttagaagtccagaatgaaataaatacattaagaatgaaacacagataaatgaaagaattattttcccttgaaagattattgcactcttcagagaagctttaaagagttttcatagatgggattgtttcaatagtcacattacaaaatgtaaaacaaagttttcacagatcaagttgaaggaatatgtttggataaaagtaaaagtgtgctgtaatgcgatcataaaatggaactaagtctgcctgatcattggaattgttctctttatgccactgagtcttagagttggagcttgtgcttggcctgtttctgtaacgtatgagggaaggaaaccatttgagatttttaactactcttttgtaatgtaaagtgaatgaattcttctatacttcaaattgagagaatctgatttcttattttttctttttttaaaattatactttaagttctggggcacatgtgcagaatgtacaggtttgttaaataggtatacatgtgccatggtggtttactgcaccatcaactcatcatctacattagatatttctcataatgctatacttcccccagcccccaccccctgacaggccccagtgtgtgatgttcccctccctgtgtccatgtgttctcattgttcaatgcccacttaggagtgagaacatgcagtgtttggttttctgttcttgtgttagtttactgagaatgatggtttccagcttcatccatatccctaaaaaggacatgaaatcatcctttttatggctccataatattccatggtgtctatgtgccacattttctttgtccagtctatcactgatgggcatttgagtcagttccaagtcattgctattgtgaacagtgccgcaataaacatacgtgtgtgtgtgtctttatagtagaatgatttataatcctttgggtatatacccactaatgggactgctgggtcaaatgttatttctagtcctagatccttgaggaattgccacactgtcttccccaatggttgaactaatttacactcccaacaacagtgtaaaagtgttcctatttctccacatcctctccagtatctgttgtttcctgactttttaatgataaccattctaactggcgtgaaatggtatctcattgtggttttgattgcatttctctaatgaccagtgatgatgagcattttttcatatgtctgttggctgcataaaaatcttcttttgaaaagtatctgttcatatccttgcccactttttgatggggttgtttctttacttcttgtaaacttgtttaagttctttgtagattctgaatattagccctttgtcagatggatggattgcaaaaattttctcccattctgtagattgtctgttcactctgttgatagtttattttgctgtgtggaggctctttagtttaattagatcccatttttctattttggcttttgttgccactgcttttagtgttttagtcatgaagtctttgaccatgcctatgtccagaatggtattgcctaggttttattctaggtttttatggttttaggtcttacctttaaggctttaatccatcttgacttaatttttgtataaggtgtaaggaagggatccagttccagctttctgcatatggctacccagttttcccaacaccatttattaaatagggaatcctttccccattgcttgattttgtcaggtttgtcaaagatcagatggttgtagatatgtggtgttatttctgaggcctctgttctgttccattggtctatatatctgttttggtaccagtaccatgctgttttggttactgtagccttgtaatatagtttgaagtcaggtagcatgatgccctagctttgttctttttgcttaggattgtcttggctatgtgggctcttttttggttccatatgaaatttaaagaagttttttccaattctgtgaagaaagtcaatggtagcttgatggggatagcattgaatctatcaattactttgggcagtatgcccattttcacgatattgattcttcctatccacgagcatggaatgtttatccatttgtttgtgtcctctcttatttccttgagcagtggtttgtagttctccttgaagaggtccttcatatcccttgtaagctgaattcctaggtatttcattctctttgcagcaattgtgaatgggagttcactcatgatttggctctctgtttgtctgttaatggtgtataggaatgcctgtgatttttgcacattgattttgtatcctgagactttgctaaagttgcatatcagcttaaggagatttgggcttgagatgatggggttttctaaatatacaatcatgtcatctgcaaacggggacaatatgacttcctcatatcctaactggataccctgtatttatttgtgttgcctgactgccctggccagaacttccaatactatgttgaacaggaatggtaagagatgacatccttgtcttgtgctggttttctaagggaatgcttccagtttttgaccattcagtatgatagtggctgtcggattaccataaatagctcttattattttgagatacgttccatcaatacctagtttattgagagttttagtaggaagggctgtggaattgtgtcgaaagccctttctgcatctcttgagataatcatgtggtttttgtcattagttctgtttacgtgatggattatgtttattgatttacatatattgaagcagccttgaatcccagggatgaagccgacttgatcgtggtggataagctttttgatgtgctgctggattcagtctgccagtattttattgaggattttcgcagtgatgttcatcagggatattggcctaaaattttcttttttggtgtgtctctgccaggttttgatatcaggatgctgctggcctataaaatgagttagggaggattccctctttttctattgtttggaatagtttcagaaggaatggtaccttccgctctttgtacctctggtagaattcagctgtgaatccatctggtcctggactttttgtgattggtaggctattaattgctgcctcaatttcagaacttgttattgatctgttcagagattcgttttcttcctggtttagtctttggagggtatatgggtccaggaatttatccatttcttctagattttctagtttatttgcgtacaggtgtttataatactattctctgatggtagtttgtatttctgtgggatcggtgctgatatcccctttatcattttttattgtgtctatttgattcttctctcttttctcattagtcctattttgttgatctttttaaaaaaccagctgctggattcattgatttttttttgaagggtattttgtgtctctatctccttcaggtcttctctgattttagttatttcttgtcttctgctagcttgtgaatttgtttgctctggtttctctagttcttgtaattgtgatgttagggagttgattttagatctttcctgctttctcttgtgggcatttagtgctttaagttttccgctacaaactgctttaaatgtgtcccagagattccagtacattatgtctttgttctcactggtttcaaagaacatctttatttatgccttcatttcattaattgctcagtagttagtcaggagcaggttgttcagtttccatgtagttacgtggttttgagtgagtttcttaatcctgagttctaatttgattgcactgcggtctgagtaacagtttgttatgatttccattcttttgcatttgctgaggtgtgttttacttccaattatgtgtcaattttagaataagtgtgatgtggtgctgagaacaatgtatatactgttgatttggggtggagagctctgtagatgtttattaggtctacttggtgcagagctgagttcaagtcctgaatatccttgtaaattttctgtctcattgatctgtccaatactgacagtcggctgttaaagtcttccattattattgtgtgggagtctaagtctctttttaggtctctaaggacttgctttattaatctgggtgctcctgcattgggtgcatatatatttaggatagttagctcttcttgttgcattgatccctttatcattatataatgtcctcctttgtctcttttgatctttgtggtttaaagtctattttatcagagacaagactaggattgcaagctctgctttcttttgctttccatttgtttagtaaatcttcctccatccctttattttgaaccttccatccctttattttgaacctatgtgtgtctttccatatgagatggtctcctgaatacagcacacagatgggtcttgactctttatccaatttgccagtctgtgtctttaaattgggggcatttatctcgtttatatttaatgttaatattgttatgtatgaatttgatcctgtcattatgatattagctggttattttgccccttagttgatgaagtttcttcatagtgtcaatggtctttacaatttggtatgtttttgtagtggttggtactggttattcttttccatgtttagtgcttccttcaggagctcctgtaaggcaggtctggtggtgacaaaatctctcagcatttgcttgtctgtaaaggattttatttctccttcgtttatgaaacttagtttggctgcatatgaaattctggtttgaaaattcttttctgtaagaatgttgaatactggccccccatctcttctggcttgtagagtttctgctgagagatccgctgttagtctgatgggcattcctttgtgggtaacctgacctttctctctggctgcccttaacattttttccttcatttcaaccttggtgaatctgacgattatgtgtcatggggttgctcttcttgaggaacatctttgtggtgttctctgtatttcctgaatttgaatgttggcctgccttgctaggttgggtaagttctcctggaaaatatccagaacagtgttttctgacttggttccattatccctgtcactttcaggtacaccaatcaaatgtagatttggtcttttcacatagtctcctatttcttggaggctttgttcatttcctttcactcttttttctctaatcttgtcttctcactttatttcattgaaatgatcttcaatctctgatatcctttcttctgcttgattgatttggctactgatatttgtatatgcttcatgaagttctcatgctgttttcttcagctccatcaagtcatttatgttcttctctaaactggatattctagttagcaattcgtctaaccttttttcaaggttcttagcttccttgcattgggttagaacatgctcctttagcttggaggagtttgttattacccaccttctgaagcctacttctgtcagttcatcaaactcattctccatccagttttgttcccttgctggcgaggagctgtgatcctttggaggaaaagaggtgttctggtttttggaattttcagcatttttgcaatggtttctccccatgttcgtggatttatctacctttggtctctgaagtcagtgacctatggagggggtctctgagtagatgtccttttagttgatgttggtactattcctttctctttgttagttttccttctaacagtgaagccgctctgaggcaggtctgctggaatttgctggaggtccactccagaccctgtttgcctgggtatcaccggcagaggctgcagatcagcaaagattcctgcctgttcctccctctggaagcttcgtcccagagggacacctgccagatgccagccagagctctcctgtatgaggtatctgttggcccctactgggaggtgtctcccagtcaggatacacaagggtcagggacccacttgaggaggcagtctgtcccttatcagagctcaaatgctgtgctgggagaactgctgctctcttcagagctgtcaggcagggacatttaagtctgctaaagctgtgcctgtagccaccccttcccccaggtgatccgtcccagggagatgggggttttatctataagtccctgactggggctgctcactttttttcagagatgccttgcccagcaaggagaaatctagacatgtggttcaccttgctgagctatggagggctccacctggttcaaacttcctggcaggcttgtttacactgtgagggtaaaaatcacccattcaagcctcagcaatggcggacgcccctcccccaaccaagcttgagcatcccaggtagagctcagactgctatgctagcagtgagaatttcaagccagtggatcttagcttgctgggctccataggggtgggacccaccgagccaggtactggagggagtctcctggtctgcaggttgtgaagaccttgggaaaagggcagtatctgggccagagtgttccgttcctcccagtacagtctctcacagcttcccttggctagagaagggaaatcccctgaccccttgcacttcctgggtgaagcaacaccccaccctgcttcggctcaccctccgtgagctgcaccctgtccaaccagtcacaatgagatgaaccaggtacctcagttggaaatgcagaaatcacccaccttttgcatcgatcttgctgggagctgcagaccggagctgatctatgaaactaatataaagtccacaaacttgtacacgtaaggccaaatttcttctcattttccagtttatcactttaatactcatgggttttacaatcagaaaatgcagggcctctattctgagaacacatcactctcaaatctttcagaaattctggaacttacacagtctttttatatgagataaatcacattttcccacccaagcagggagtagtagagaagacagaaagcaattgctgtagattttcacttcctatagttctttctctaaatagttctctctcaattaatttatagatatagctattattacgcagatgaatatccagatttaaatcccaatatgttataaatgcatttttgtgggttttgtggtctttttatttttatttgtttagaaaatctgctttaatggttaagcaaagacttatctgaaattgcagtaaatgattatgcataagttttgggttttatgagttaaaattaatttgtgacatggttgctttacatatggaaattcagtctaatctttttctcatactttaaaatcttattctgaaggctgggttttattgttttgtaagttttgtaatggcctcaagcccaaagcaccataaatttgaattggcattaccatgctgatttattcaatattagaaaggtagctaatttttacatgaaaagtgaaaagggaatttatgcaagacatttataacttcagataaaaaagaaaaataaatataaaactgataaatagcgttatctaaatgtttgtttgaggctctatgatttatcagcatatgagtcttaaatcagagccacagagagagtgaagtgtccaagtgttggcttaggggtgagggttttgatttgtgcatgtcctctatatcataattatgactagattgacaagtcctgggtatattcaacctcagttttaaatatgaagccgaatttattcacagaggtttgggaaacagattaagttaataccagaaaaagtccttcttaaattacaataagtaaatgtagtgagttttttattcccaagcaagtctacagtgtggttactctaagtgttgattctttgaatatcttttgaattccaaatacaagatacaccagtagactttaaagtgaaaccatatctacagcttttcctcctaagaaaataatccattggctttcaaaattatagcaaggttaaaagacagtatatgagataaaaatatatgccacgttccattatggactttctaagctatttaatgaaaacagatttttttcacatatgcatatattttatcacttaacttattaattttagcgtagttttaggttcacagcaaagctaaaaggaaggtaccatgatttcccctatacttcctacccccacacatgtatagcctccctcattatcaacatcccccaccaaagaggtacaattgttataactgatgaatctacagtgacacaacataatcaccaaagttcatagtttaccttagggttcagtcttggtattgtgcattctatgggtttgaagaaacgtataacaacatgcatagataaactcatgtacatgaatttctgtagcgttagagttgtttcattagaagtgggattgcggagtcaaaaggtaaatgcatatgcagtttttttgtttgtttgtttggttggttggttggttggttggttttgagacagagtcttcctctgtcgccaggctggagcgcagtggtgcaatctcagctcactgcaacctctgtcccctgggttcaagcaattctcctgcctcagcctcccgagtagctgggattacaggcacatgccaccatgcctggctaatttttgcattttttaagtagagacagggtttcaccatgctggccgggctggtctcaaattcctgaccatgtgatcctcctgcctcaggcatatgtagttttatcagatattgctatattctttccaatggggttattgcaggttgcattcccccagcagactctaaaggaaggcagaatttttgaggtgcctaaaatatttattcaaactaagattgtcaatgaaagtattctgaaacggacggaactgaagaaaatttaaacatttactcaaaaaagtagaaaaaaaggcatttgatatgcaatattcatactttaaatgggaaataagccaatcaggtaaactaatgtatagcagaacagaaactcactttccatagcaccagcccaatccctgttttaaccgtgatacccaattttcaaacagccactggcactgcccatggagactgatctccatggaacctgtgtttgcctggcaagtgcagacattctgaatccaagtagggatgaatgccatttgttagcaagtgcagtgggagggaggaaaggcaaccagcgccctcagagaaaccagagtggggcagttcttgttcctcacagaaccccatcttctctcaccacctctgtgtaacctgacccccctccaatttttaactctttttaaatttttgccttttgcctctgaattttgcgttcaccagtccttaaaaatcacagaggacccagaagagattttaatgtagcaacatttttttggaatgaaacacttataaatttactaaatataaatgttaaaaaaactgttacagcatatatatataaactattacatcacatatatgtgtgtgtatatatatgtgtgtgtatatatgtgtatgtgtgtgtggaggctttgttcatttcctttcactcttttttctctaatcttgtcttctcactttatttcattgaaatgatcttcaatctctgatatcctttcttctgcttgattgatttggctactgatatttgtatatgcttcatgaagttctcatgctgttttcttcagctccatcaagtcatttatgttcttctctaaactgcatttgagctctgataagggacagactgcctcctcaagtgggtccctgacccttgtgtatcctgactgggagacacctcccagtaggggccaacagatacctcatacaggagagctctggctggcatctggcaggtgtccctacacacacacacatatataacattttcaattgcttagatactgttttcctaactttactaccttttaggtataaaaacagctttacagaacagccttccttctgaagagacaaccattattaggttaggtacttaagtccatattacagcttcatattgtctccctttctatgtcacactcaactctgtcccaaatactaaaaaaagaggtgagaaattcttagcatcctggtagtgatttacacgtatcatatatctttagtattgtcaatctagggtttttagcacccaatttatgggggcaggggttaaggaggaggccagtggggtgaaagtccgtgagttaatataatgaggaagagctcgcaaaagagatgagcatttatgagtgacataaatctctgaagtttaagaacagcacttagcatactaaactgtccaaatagtccttgaatgctgacaaacggttcgtaaaaagttaaaaaaaaaaaaaaagacatacattcttcagagctattttttcaatacctgaaaaaaatcctgtaatcccatattggtttgtgatacatgttatcattcctttatggagttttcaactcaaggtcagaaggttcttgagtcattcctctttggtgcagataagttgtattttacgttctactgcagttctctgccattcttcttgacttccaaatctcaagcttagaacatttcttatgaaatctatgacttccattaatatcaaacctgtttcccttttgtgtaaattaatatattaccattcaattatatttaagtttaccaaacatttctcaaaattatctcattctctttaaaagataatccaaaacttggtcctcaattagtttcttccattgtaaaccaatctttcctttctgaactggcttgcttaactgattgtatgcttactttttgattctgttaaatgaacttaaatttggcctaattctgctgctgtatgtagttaactgcaacctaacctagcgtgtcaaccaagagcaaaccaacttaagagtctattcttgcaataaatagctgtgtctcagccaatcacagtagccaagcttcaaccaatcacaagttgccaactgataagatcatgttcatataaggcaaatgcctcatcatatcttgcccaaatagggcaaacactgagctgtaaccaatcaggctgtttctacacctcctgtgcttttctggtctagaaatactatctgcccctgagtagagctcctggaacctctcctggttctgagagctgcccaatttataaactacttttgctcagataaactatgctaaatttgatttgtctgaagttttctttcaacagatctgactggttttccagtaaggtgataccagatagactactatagcgattatgattccttagaaatgaattaatataaagactaatgtgaagtagaggaaccggctttaagcaaaaatacttaaaacactgatagataataatgtgtttatgaaatgtgaacaacacacggttatgaaacccttgagttaaaaagggtacacaatgaaagcccatgtattcgagttttgctttaagtcattcaaaaaccgtgaaagggaacactacaagtaagttctattttgatcacagttgtgtgtggtttccacataaaacacctagatttcatcagtgcttgtccaatatcattaccaatgcttctaacaagtggtccagaatttgtggcaaaggtgatgtgaatctgattcaggaagtatcaagcagaacactgcaggagttccactcatattggaaatgtatttttggccttattttctactgggccaaaaatatcattctggttaacatcccataaacaggtagtgaaccaaaaagagggtgagagacttccttcctgatagtaggaaaaatattcactctaccacagaccgtggatgggtacaggtgtcagacagaactctgacaataagcagttaaacattacttggcattgacaatacaagaaaaaaaagtcagaattcccttcactatcaggaaaataatctagataggtattttagaaaactaatgtatcagatcaatccacttcctgccaactgaagttacctcctactctgatagaaatgtgtacttatttattattcaaatggttgcagcttaacaaatccgatatctatcaggaggagactaggttttctgaagcagtgacttcagaacccctgactggtattttacattaataaaattggctagagctctagacctgctgagtcaagagttaaaataaaactccccaaccagcaatccatcacctagatagtgcaagcggccacaatgctgacgatggagtctttgataggtgtccattgaaataaggaggactaattaatgctctgacaatcatcagccttcaataggaaattaaatgttattaagacgaagccctctagcactattgatcattgatatgagcagggaactgagcttaacatgaggtgctatgtccatctcacacaaattaatctagctaaaatactgcaaatcatgcagatcacgaacaaaattaaggttaatcttcctttagtaaagagtaacaaaccttattttaaagtactatattaagagtatggcaagttacagataagtttaaggaaaaaagtaaaatgttccggcctatatacgtgaaaaatccagagtactggagtttttggctcattggctccaggaacaaaggacaggtgtgtgtatgatcttttgccacccactccacatctcttacttccatttctttacttgcctctgcttggtcatattgatagatatacttattctacatggtgctgggatggacaccgatggttctggaattacattactctcaaacattgcaatctcagaggagggaaaagacttttgtttttcagcatccctttcgttctcatgggggactctgactggcccttcctgaaacgatgcctatccaggaaccaatcagtgtgatcagggagataagatcctagatgggccagtcatgaggcacacccctatcctggagaactgaaatgaaccattccaatagaatcacacagaatgactagttacctaaaggaaagggactgccaaaacctataactctactacacacacattatgtactcaatccattcaggtggtatttactgagtacctatatgggccaggccttgtgctaaaccctacaatgccagaaatatggagattaaaactgatgcttgtatctctatcagaattaaaatgctgtaattcattgaagtctcagttttataccatctttaggcccgttatgctggaccatcttattagcaggtttctctgaaacaaagtatgtaatatagtctaggaattgtcagccaggctgcttctcactccctcaggtgttaataactttcaccacaactcaaagctttagagttagtctttggattactgcttcattggctgcaatcaagtgggctcatttggtggtccctgtctttcccgacactcatgtgtctctttactttctgcacccaaatatgttaaagtctctacctaattaaacatgccaaccaacagcataatggtttgttgaattcaaccaaagagtacaatctcaccagtggctgctaatgatattagtaacgtatcctgttgtaggcactcataaaactgaggaatgacaacaaccagctccctgacctcatggaggcggcatcccagtgagggagacacaaaccaaacagctagtaacacattccttcgttattgtggtgattgtgatgaatgttctaaagcacaatcacaggaattacagaagaatagaatccaagcacataacttatcctgggagactagagattatgtttctcgagaaagggactttggaagtgtaacatgaaggaaagtcaagaattaactaggggacgtgggtggcaggagtgagggagaacgttccagacaaatggggcattttaaggaaaaactgtgaggtgtaaagaccacaggatgctgagaaacagggagaaggccagagcagggaaaagtgagaacagcaggtggatatcaccaacccctaaggcagctcttagataacgcaggaacacagacttacaataatgctaaggaattggctctttatccctagagcagtggtttccacactcaacaattttgccccccacccacacccccacatttggcattgaatggagacattttggttgtcatattgccacaactgtggtggtaggagtggggagggagtgttactgacacatttagtggaaagagaccagggcagctgctaaacaccccaccacgcacaggacatccccctacaacaaatggaatcatgctggcctgaatgggaagaatgctgaggttaaaaccctgtcttaaaacagcacaaggacctagaaaggttttcagcgagaaattatcatactaaaatgtgcattacgtgcacttaaaacaaccaaaatatcgttcctatcaggaaatgaataggaggaggagagtgagtagatgcgtgtgggctgaaaaaagaaagaacccaggaagtcagggcagaaataacagcacagagcagcaggtggactgcagaggaggtcaggatgaacagaggcaagacatgtcatggacaacaaaccaacaggcttgttcatcaccagccatgggagcaaggaaagggaaaggctccaagaaccactcttgtcattgtggccattaggtaaatagagctccaccactcactcacaacaggaatgctagtggagagaaagccacacactcagttctggacatgtcgagctttagctgtctgggatacaggagggtggagatctagaggatgagatggagggctgggctgctgatgccaatttagagatgtctgccatggccatgagtggtctcaatcaggaaggacagaatgagatgcgaagaagatctccagctgagcctggaggaattctacccccagttgtgtaaggaagaataaactggctaagaaaacagaagaacagtcagaatggtaagaggaaaaccaaaggagaataacattttgtacccaagaaaaatgtatttcaagaaggatggagtgttcaacagtttagaagagagcccagagataaatgagaactgaaccgtgtccacagctgacactccagaagtactcggatgaatctaaaggatgcagattaaagtctcctgaacataataaaagcattcaaaagaacatgaagtcaaaagcttgtgtctgcactgacatgtgccctgacttttcaggttccctttctctttcttggtttgtcttcttcagcagccctgatcttgctatttattccacatggcttctattgtgcatgtgctgaagtctctaagaaatcctgctcttgaggaaaaaaaaaattctttttccagtcccaacagggaagttaatgaagggataatgaatgcaatagaaagcataaagatccatttatttgtatatgccaacaatttttataatggcacaataatcttaattacagttatttatcacaacgtaattcctactgaccatgccacattgacacaattaataatttgatgtgtacttcctaaaacaaattggtttacacctatcagaaaggctgtgcttgccagctacctgcaagtttactaattacctgctttgaaaatctactgacctatcaggaaagggttaatttttctcagtagcattcctgtggtcaccatttgaagtaattatcacaacatagtaagaaacagacaagaaacagacaagctgtctacacatgagatgactggccttctgacacatgacacatgacacatgacacatgacacacagcatgctggccttctgtgcaggtaagtgcctgcttgtttttccccaggtaactgactgggagcagcaactggcctatctgtaacgtcctgccattgagacacagtgcagagtcatagagcatttgaattatctctggtttctacaaagaagacatgcatcggcggcacactggtttaacgtatcacagtttcatatgctcttcctagactctcagatctttatatgaaagttattctctgtgcctgaagccttgggcatttctactgggctggggacaatattttttagaaaccaacagatggaagcaagatgacagagaaagccgaggtgttgaaaattgcccttgcagcttaacatccaatattccacaggcgttccaaacacaacttattcagtagcatttgcacattatcacaacatccggatagattcctaaaaatgtgaaaatgtctactttggtcagcgaatgtgttctaaataaaagaattataccaaatgtatactggaaggatatttctttgtgtaaatttagagaaaaaaggttcctcctttaatttctttcttaacggatttttgctgtatctataaagatgcaacagatttggagctacataaatcataatacatttcatgatacatggaaggtgaacagtagaagagacacagttattattcttaattgcaatacagaaaattactgaacaccaaaaatgtacccagaactgtgtgaagggcaagtaatacaagggtccttgctcttggatggaaacacaatgcataaccaaaccaagaggcttcttagattggcatgtggtctgctgttctgataggatgaaaaacagaaacaatgaaattcaaaaaccctaccactgaaaatattacagaaatatgcaactatgaatgaggaggaaaaggtggaggaattagaatttgcaaactcactgtgtagaaaacataattaaataaagataattactaaatttattggaacagaatacatagccccacaatttaaatcacattttctacatcacttatttgccagtcaatgatgcatcgatttgtaatctcttctgtattttctgatggttcagtttgcactgctaatttatcgtgcacttctggggtttatccatctaactagtttctaacgcattttacccttcacttggaaatccacagacatgtaatggagactcaagacatttaaatattcttttaaaagcagtgtattagatagaatattaagcttccatgtcagaatgtaaactctaatgaggtgataaaaatttcactgaaagaattttaagtattctgagcaatgcacagactatttatcaaacagcagcagaaaataaataggcttcattactccaaacatttaacctctcttaagtcacatttttacacctcaattcatagtccataataaagccattaatagaatactcatgatccagtataaagacaatgatttctttttccgaaatacaaattaatcattttaaacaatccatagcacaacctaagttggcaatcctgtaactgttgaagaccgtctttgcacttacatggtactttgccaataattagtattcttcatttattttctactgaactgctctttataaagtactcaaagagaaaactaatgcatatcttcttgaacttttaagtgaaggcaaatattctctggaaagtgagtttctcatctctctccttcaaaaagccacttggaatcatataaacaagaaacctctgttgacaccctatggagaaacaacatataaagctgcaggcagcattaccatgtctttccattatgatgactggcagactctaggtcagagccctgagtcctggagcgctgcccatgtttcatttcctcactgtaacatgaagggttttgaggaaataaactctaagctcccaatagtcctaacatgttatgacagtaaaagtgctaggattgcatgattccagggaagagaataaaaagggtgtagacctaataatataccattatgatgtcgatccacttttaatcaagacagacagctactattaggttttttacacattatttatttttatttttattttttatttttttttttagatggagtctcgctctgtcatccaggctggaatgcagtggcacaatctcggctcactgcaagctctgcctcctgggttcatgccattctcctgcctcagcctcccgagtagctgggactacaggcgctcgccaccacgcctggctaatttttttgtatttttagtggagacggggtttcaccatgttagccaggatggtcttgatcccctgacctcatgatccacccgcctcggcctcccaaagtgctgggattacaggcgtgagccaccgcagccggcctacatgttatttttaatagaagagaaatagtgtaaatatttaatgagacatattttaaaggatattgtttcattgaaaaaaatgattattttaaattagggtagaacattcaatacactttattttaaatgcagatttccttctccaaactctatttcttccaataagatcaagtatattaagtcatatatccagtcagcaagttggtcatggcacagttagtacatgtactgtgcctcccaccttcttaattcctaacatgagtgtgaatgagtttgaagtttgaatgctgtagtgcttttttactatagtactctgttaggtgatctggtgattgttcctatagttgctatgtgcttggtcaaccactttgctaagtcatctcagctgtactactcgaggattttatgcaaatcagctccttcttcaactgccttaaaacaggaagcttttctctatttctgaaactccttgaacttccttccttagaatacttcccactatagtcaaacaagtaggaacaaagagaatggtccaatccttcttccctctacctgataatatagtaatcattgccgtgaaatcattaggctgatgcttcacagcttataaccttcatcttattcatagtgcaacctaataaaagggctattttgtcatctaaaacagtgtagtatcttcaattcctcatagtttagtataagtgcattgttactttagaaagtagattaccacaaaaagaaaaacagtactatgttgaccctaagacattttctttgtccatacctagagttacaagttcacatgaggggcagcagatgaagtgtatgtgtgaaggtgctgggcataagagctaagggagtcttggagaaaaaggtgaacacatattcagtcaaaacttgtccaatgtctttaaaaatgaaagcaaagtgtcagccatcatattaacctacaggtagttcacaatctcacctctcatgaattccttacaacaaatacataattacttgagctttctggttatttgagtgccaggtaatatttgattgtatgtgaactaggatcataatggtctactagttactacaacatagatttagggattgggatataacaattcattcaagtaaaacaaattcttctaacaatggcttacttttccaaacataaggattatattattaaactcaaccttttactctcttaatatggaaactctaaagactttgcatatatccactgaaaattctttaagttaaattccatcaacaaatcattcagatgctaacccaatcctactactacgaattgcaatttaatgaatacttgcaatattattgatctctacaaagagtatctcaggtaattccctcacagtaaacctatgtgagaattatttcccagtctagaggtgaggaaatgaagaccagaagttgtttatccttaatctttacattctctaagaataagtccccttagcattcaaatctatcacataaataagcgtaaagattcaaggaaggcctggcacagtggcttatgccagtaatcccagcactttgggaggccaaggcaggccaatagctttgagctcaggaattcaagaccagcctgggcaacatggcgaaaccccatctctacaaaaaatataaaaattagctgggtatggtgacatgtgcctgtagtcccagatactcaggaggcagaggctggaggactgcttgagctcaggaagtggagggtgcagtgaaccaagatcgtgccactgcataccagcctgggtgacaaagtgagaccatgtctcagaaaaaaaaaaagaaagaaaaaatatatatttaaggaaaaactcatgtgaagcactgcactttggaaaattctatagtacaaaagaggaggccatgggtaactctgtgaggcattacaagagccctgccaatgccaggccactccatttgctattagccataactgaccttaattttcagtcttgtccagcagcactaggaaggcaatcaatcttttgtcagagtgaactttttagggaagacatgtgctattcaattgtataataacaatgataatactatttctagtgaataaattatatttgttttttatatttgccacattcaaagacctctcccagaagtatgtgtgagctccaaaaaggggttctcagtagtcactaccttaggctccacatcaaagtataggtcttgctgatgaatagtagaaggagaagaaatgtaataaatttctaaatgtgagcatgttaaaatatttaacaatatactttattaatggaagtaatgcatatataattttttaacatcatgttaaatatattattcttatatagaaatatatgtatatacaatacacaaatataatacacataatataaatatatatttatatactatatgtatctaatatactatattatactataaacatatatacatactacatatactatatatttatataaatatattatctatgttttaaaatatagacaaaaatagaaaatgcagttaagaaggtaagaaaatggtatttttcatttcccatccctcccagggacgtgccctttataactacttgtgctatgattcagtccattttgccttcccagagtcttttaaactcaccctctctccccattttcaatataattcacctggttaagttctttgtcaatttgttgcctggactactccaataacctccaaactggcttcccaaacatactgattctcttcaatttattcttcatgcgatttccggagtgatctggctaaaacacaggtctgatcatgtcatacaatctcatccctgacctttgacattcttcaatgactgtcacatgtacccaactgcattgcaaaggcaacaaggggccgtgatcattggcctcctgcccacctcactggcctcaattccttgcactgcctcccacagtcatttccagggccccagataaagcatgttctctttcctacctagattctagggtatggattaagtatgtgggttccagctgcagtccacccagattcaaaacctgctgcccccacttagtcaccaaggtgtgggcaagctactacacctgttgaaactgcagcttctgctgtgatatggaggaggtagctggacctaaaacatggcttaggtgtgaggatcatcaagtgtatgaaatcattcctgcagagttttccatacagtacttggctcacacacagataatatctgtaggcctcctttccagagctaaaaatgcacacacttcacaagaggggaaaaatcttagccctcatggagcacgtgttctagtggagacagacactgacaagtataatacacagtgtgttggaagtaaaaactcccatgaagaaactaaagctggccaggactgccattttcagtaggatgggcagaaaaaacattaatgggaaagtggcattggaccaaagatttgtaagaggtgagaaggtgagccacacagaaatctgagaaagaaacatctcaggcagagaaaaccataaggcaaggaccctgaggtggggttgtgcctggagagtttggagaatagaaaggagatcaatgactggaaccgaattttgcctgggcgagtgataatgaaatcaaagagaaaagtggtggtggagcagatcatagtggtttgggggccatttgaagggtactggcttttactgagtgaagtggaaaagtatatgactgccactggctattactacttattaacgtttctgggaagtttcaagccaatcttccaagctggctcaagagcttcatgtctctgcccccagaggacatctgaaacctctattatggcacagcagtcccccacctgaactcccggaagacaaggctcaggtgttcatcttggtgtccccagcactctgtgggttactcagcaggcaggaatggcttaattaagaatgactttgagaagaccccaaaaaagtgtctgttccatagtgcactaaatatactctgtatgatcctaaaaatagtgatgggaaataagcatatgccttccgctgacatcatgtttgaattctcagcactttcagcaatacgatacagtgatgctggactattttgctaagattctttcattttacaattttgaaaaattcttgcatgggttatctaaatctgtttcaaaaataaccctgtgctttttacattttagtaactccattttccaaataaggaaactgaagcccaaaatatcaagtgacgagtggaagtctcagtcctataattcagaaacccaccacccaggagaagggccctgatgcttgtaaagaatgcaagaatgcatggctgcttatgacacagagagcatccctattaaaacggctgcagcacagcgagctgaagcaaggcagaaagagggagaaaacagactgagataatgcagcagcacttggtggtgaaaggaaacaaccaaagcaggaagaattccattctgcattcactgatcacagacggagttgcccttttgatgaatgacacagcgagggccacaaaataagaggtgctgccaagagacaccaagatgactgggaacgaacagtatcgatatcaaagttactactggtagtgcctattctctgtactgctgttttattctattgcatttttgttggattctaattccacagtagctgtagtatctctgatatggagcatagggcagctgtagcaccaatccaaaactaaccagcactgtacctgcacccagttaagactcagcatctactactgatgaagtcttagtcttattttttgttttcttacttctgggatctggtttcttaatctgcaaaaatgggaatgatggtgtctattttacagatttgttacagaataaataatgtggtagagtattaaaaatgatgaactgttctatgatggtaaaacataattaaaatctctcttctctccacatacatttgtgaattagttgtgttgccctcaaattaaataatactttactttataatcattctaaaatacatattaatttttctgccatctaaacaattatcaacacctaaaaacagaatcatactgcatacccatttcttagtgtcacttttcagtaaataaatcaatttgtgaatgctgttgtacagaatattgtcacttactttttttcacatatactgtatcatagtttcatgaagctaataatcactgtactgcagaaatagtctaataggtcttttattcaccacactgcttctgtattttattatggtgatattttgacacttgagaagcaaaagtggtgagacagtatcttcataaaaaaaaagggatcaattacattgaattaccttgaaaactaaagtaatgaaaatgatttccttcaacttaatatgagactgctgatcccatcatctctttccaatagtgcacatcgtaacacagcagaagctattttgttacagcagcatcaccacccatagccttgagtctaggacagtaaatgagcaacatgaatgaatcgccattcttcttccttcctacacagtactgtgaagaatacagagcaatagtcaaacatcaggggaaatctatcttgttctttcaaaaataataacctgagtttatattttaaaagattatcattccaagtttggagactttcaaattgcctcaattataaaacgacttaaatgaaagtgacaaagtcaaagaaaattgcactgtgatggggaaataaaatcagtgccaggaatgtgatggaagagaatagaatccaatgtatccaccgactggtgcaggaattcaaaatcatgtaactgttgacaaatatttaaacagcaacacatcagcttaaatgtacaactaaaaaataaaaacaaaaaaaactttcaaacgttacaaacaagaaagcatactattgcaaattgtatagtcctcaaatgctgcttcatttttacagtaacacagcgaagtgaagcaaaatgaaaagcacatcaggttctgtaactccttctattcacctacgatattagaggctctcacttaagaaatctatgctttcttgggaggccgaggcgggtggatcatgaggtcatgagatcgagaccatcctggctaacaaggtgaaaccccgtctctactaaaaatacaaaaaaaaattagccgggcgcggtggcgggcgcctgtagtcccagctactcgagaggctgaggcaggagaatggcgtgaacccgggaagtggagcttgcagtgagccgagattgcgccactgcagtccgcagtctggcctgggcgacagagcgagactccgtctcaaaaaaaaaaaaaaaaaaaaaaaaaaaaaaaagaaatctatgctttcagcaatatactcttttacaaaacaaaaaacttgattgcttataattattatataaaatactgctgcatgccctttgggcttaatatgaaattaataactccatgtagaaggatcacagcatattaacctgaaaacacgttgaaaatgaaaagtgaaattttagttaacaaaatgtaatgattgtgaccataatgagagctgcattgttttgtatttgtttttgcagtccatctaacagtgaggctccccaagataagaacaaaaaaatgtgaataatgcaaatatcttaaaagaaataatggccgggcgcggtggctcacacctgtaatcccagcacttcgggaggccgaggcgggtggatcacaaggtcaggagattgagaccatcctggctaacatggggcaactccgtctctactaaaaatacaaaaaattaaccaggcgtggtggtgggtgcctgtagtcccagttactcgggaggctgaggcagaagaatggcgtgaacccaggaggttggagcttgcagtgagccgagattgcgccacttcactccagcctgggcgacagagcgagactctgtctcaaaaaataaaataaaataaaataaaataaaataaaataaaataaaaaataagaaatgatatgtctggctaacagagcatgcaaagtggtctctggtatgttttgaaaattaccattttccccaatatacaagtactcaaccaaagcatcaactttttgaaaaatcagtttcatctaaaagatacacagttcagatacaaattatatatattttaaaagaaactttaaatatataataaagaaaagtaagaagcaagttggggtggctcacacctgtaatctctgttactttgggaggctgaggtgggaggattacttcagctcaggagtttaagaccagccctggcaacacagtcgtcccctctctacgaaaatattagttggatgtggtgttgtgcacatgtagatatatggcagtttgaggtgggaggatcactagagacccaggagttacaggctgcagtaagctatgattgcaccgctgcacttcagtctaaggcaaagtgagaccttgtatcaaaataaagaaaaacttagaaatgttttagttctcaattatgtaactatatttttttcatgtgctcagtgctcatattctatgttaacattttagtttaactggttctataaaatgtaaaggttacatagctaatcaacaaaaactgtatgattgaaactggtttaaaaaaaagttttcctaatatctaagaaacaccatacatctatttttttctgaaagaccatgcaatcatcaaaacactattttgcagcagctgcacatttaatactttgaaagcatggctgcaatgtattttgtgaattttaatcctggttaattctgggcacataactattaggggtttttattttttcccttttatcttaccttctttcagaaatttcaaacaaaaaaaaattttaaaaagtaaaagaatatgattcccaactcattataaaaacataaaaatcaaactggaaaaacattggtaaactatagcttgtgaaaacacaagtggccagatgcacagtgagacaggctgctgtctgtgtttggctttcttgatattacatttcttagaatttgttttatttgttaggcagcaaaacaaagcttggcaagaggataccacgtctgaggagagtctgaggatgtggaatagctcaagaggcagctgggtgtgtgatgagaagataaacgccattaggtggaatttggaaaactaggtcaacattttattttattttatttgagatggagtatcgctctgttgcccaggctggagtgcagtggcacgatctcagttcactgcaatctccatcttctgggttcaagtgattctcctgcctcagcttcctgagtagctgcaatttcaggtggctgccgccatgcctggctaatttttatatttttagtagagacggggtttcgccatgttggccagactggtcttgtactcctgatctcaagtgatctgccggcctcggcctcctaaagtgctgggattacgggcatgggccactgcacccagctgggtcaacatttttaaaagacttagaaagtctcactgaggtatgtgacaaaaatctcttcttatctccccaaaactccagtaagaatttctgtatttcttcaaagtttagtcctaaaacacatctgggttgtcaattttcatatattatacatataaattcagagtccaaaaaccaagaacattttaaaagttactccaatgtcaaactttggagtaatttaaaaattcctcgtaaggtgaaagggagcatgctcactctttccaccagatgaggacgcgggaaaaagacaccatctacgaatcagaaagtggagcctctccagaccctgaatatgccagtaccttgatcaaagatttcccagcccccagaactctgataaataaatttctgttattcataagccacctagcttatgttagtttgttatagcaaaccaaatggacagatacgcagactttagattcaagtcaacttgggtttgaaacccagttttggaagatactgcatttcattttagggaagttatttaaattatttgaatcacagttttttgtttttgtttttattttgttttgttttgttttctttaagaaggagctagaaatacctgtttcaaagcattgttgaaaggattacatggcacacataaaatgcctggaacaggcacttaggaattaacaaatcttcaatgcaatggaatctcaatgaggacagggctgtttgtgtcttttgatcactggtgtatgcctgtcatacagaaatgctccataaatatttggagaatgagagaactagtattatcaataattatttaataatttcccctaagcttaagtagcagcctaaacacagtacgattgattcttgttatgtgtgatagttttgttctataaagtcaatgataacactgaattagagaatactgagctatcgctcctaggagaaataaagggttaagttcctgcaagcctttggtcacaatgttttcatcaactaattaatgcataatcttgttttatggatgtttctctttgaagctatcttatttttatatattgttgattcatgaatatttaattcatggccaacagctctgtaactcatgcagaaacaaagcttattgaacacatatattttctccgtagggcacactgcagctttcttgcacttataaacattagataacaaatcagcattaccattgagggctattttaaacaatgaaatcactaggaaaaaacatgaaaatgggccaggcgcggtggctcatgcctgtaatcccagcactttgggaggccgaggtgggtggatcacgaggtcaggagatcaagaccatcctggctaacacggtgaaaccccgtctctactaaaaatacaaaaaattagctgggtgtggtggtgggcgcctgtagtcccagctactcaggaggctgaggcaggagaatggcgtgaacccgggaggcggagcttgcagtgagccgagattgcagcactgcacctccagcctgggtgacagagtctctcaaaaaaaaaaaagaaaaaaagaaaatgaaaaaaacaaaaccaaactgaaatgtggcaccaactagactatgaaaagggcatttgtttgcagaaggagagctgaaatgagaacgcagagtattatcttctgaggcctcagttaggtacatgtgtgtccatgcacggcacatgactgtgaataccctgtttgttaatttgggggttataaatgcattttaacatacacaagctcacaaacatgaaattctcaaatactgaggatggattgtatatccaacagggaatccatggtactcatgtaaggattacaccttctatttctgcatatctctcctctctccttctgtctctgttcaacactgtcataaatatttcttttcaagcagcaaacacccaatcagtacgtgctgaaaagaaaaaaaatgaacatatgctttgaggattttcattccaatggagactaaatacacaacaggacttggaaccccaatgtgttgtcatcttaaatgtatatggtacagtagtcatccaaaagaatattgcatatagcaggtcattttttaaaaatgttacatacaaacatgtctttcaatgaatgttgttagggttatcgaacagttagaagaaatggaaatatgctagatgaggttaagtaaatagaaagtagatagaaaaccactagcttccatcagggtctagaggagcctataataataaaaaggtcagaccaggaagagacaggctggaagaagagggatcacacaaaggaggaaactggtttgtatagtatgttattaaaaatgctgatttttgtcatatcttgtcacattgcttattgttcaagacaagtatctagcaactggcctgagaggaaattaataccctatcataatctctctgatctattgttcagtggcaagcaatgaggggaaaatctttgtgtcttgagagctgtgtggcttgtgtattggtttactacttctcattccactgaagctcaagagttgaattattctctacagaatcattaagaagtataaacggagtgccctaccacttctcttttcctcggttataatggaatgggtaaataacaaggtattcagagatgttttcctatttgtgtattaaaataatgcttttctatttcttgagaaaaaatggaatatttttattccgtaacaatgtcacattcacatttatttcactaatgaagaacactatgcagagttccttttacttagctttgcgtgagtttgatgttctcatgctgtcttatcattttagtactgaagcaggcttatttagaatagttaggcaataaataaaaacaaaatccataatcccttaatttgtcccatttttatcacactataaacagatgtaatattacatacacatatattacatattaaaattgtgatattatatataaagtcttacactgtttttaatcacttaactatataatgagtattgtccagttccttagacagtcttcaaaaacagtagttcacactgcctgtaatggatgaattatttaaacatttgccacttttattataaatatttgtatactttttacaaatatctataatctactttaaaatagttagcatggatagtgtgatattgccatgcaattatttaactgtcagcacactctttctgcaaggggccagatagtacatatatttggatttgtgagtaatctcatctcttctccaactgttcagcactgccatgttagtgccaaagcagtgataaacaacgtataaaggcatgagtgtgctgtgttccaataaaactttattagtaggcgctggttgaatttcacctaattttcacatgtcatgaaatattcttcttttgaattgtttccaactatttaaaatatgtgaaaaatcattcttagctcataggccatagaaaaacaggcagcagcttggaatcagccttgggctatagtttgcagaccactagttcaagccccactgcagattcagtcaactgccctaatgagaatctcttgctccaagactggccaactcccttccatttagaagcccctttctccagaggagggctaccctaaactgtttagactaattttatatctgatcaacagcagatatttttaataatttgcattagaatgagtttccatgggtgacattaatggcttgttagcataatgtagatgtaagaaatgagcgctcattgttcaaattcatgatacttagagccagcatttacccctctttagtggttttcaggttgagcacctgcagatcctaagggaggtcagggacactctgaaacccagacagtagtcatatatcaacaggtatgaacaaccagtaattagcaactgacatgctgcataatagctgaaaatcagccctgcctaaatgggctttatctgatttcacagatagctggatgaaatcttttgtgctcacttaaagatacatttttgccctttatagaaagagctgctgacccttgccttaaacacctgggcaatatcacactatccatgctattttaaatgatagatattcagaaaaagtttcaaaatgtccataaataaaaggtcaaatgtttaaataattcagccattataggtaatgtgaactgtttttgaagactgtttaaggaaccggacaaatatcattatgtatgtaagtgattaaaaatagtgccagaataaatatgtaaatgtctgcaggcatggtagattttggtgtcagaattgctctcactttcaactgttatacagaggttgttggaaagtgtgcaagctgcccctgattctaaccattggaagctgccattccattgccccccaaaaatttggaccttaacagtatataaaagttggatctcaattcacagttcttccataaaacacttactgagtttcttttatgtgccaggcatagatacagacacagtagtggaataaaggcagatatggtccctgtcttgatattcattgttatggcataagtgggaataaaaaataagcattaaaatgcattaaatattcctttgtattttataagtcagtaacagtatactgtatcaatcactaaaatagggatttccatgagccaggactgtcccaagggcatggcatacatcaatctattcaagaaccccgccttatgaggtgatattatgcccacttttcagatgaggaaactgagggacagaaagattaaggtatctcttgacatatgacaactttaaagctgtggcttgggttttaaccccagcagttcaaactcttagtctatgctcttagtctctgttcttcaaagtttggtgaatgaatttggggtacaaagtgacagtcacttaggcgggcagtcaaggaaggactttcttagcagggataatttaaactgcagcctaaaggacgggaaggcatcaattatgaaaaaaggcaaacagcacatctaacaccctatgtctgggaggagatttctctgttcctgtaagagaaaagaggttgacatgcctagaacctgggaagccacagataggaccttgcttttattctaagctggcagaaagtaggagagttacagtcagatttaattttaaaaatcagtctggttgctgtgcagagattgcataatggggtaaaagtgatactaggtggggtccattgaagatcaagaacaaaggtggcttagaccagagtaaatgctgcagggaaagaaactgatgtagcccatttcagaaacagttcaaaagctcccaaacaatactccccaaccaagccctccatgaaatctatctgatgctgaagataaataattgtatttcttgtattaaagcaacacattattattttttttttttttttttgagacggagtctcgctctgtcgcccaggctggaatgcagtggcgcgatctcggccccctgaaacctccgcctcctgggttcaaaggattctcctgcctcagcctcccgaatagctgggattaaaggcatgcgccaccacgtccagctaatttttgtatttttagtagagacagggtttcaccatgttggccaggatggtctcgatatcctgacctcgtgatccccctgcctcagcctcccaaaatgctgggattacaggtatgagccactgtgtcccgcccaaagaacacattattctaatgtaaattacacacttccttttttgtctccagcttacacctttctctccatgaagtgctggaaataaatcagggactaaattttcatataaagaattttttctctcttatctaactaaaatatacttaatttcatttgaaatgttatgaaagcaatggagctagtaccacaacagagtttaaagtaagaattgtccagttcaatccattaaacaggtgatttatttttggaaaaataaagctttaaataatttataaacaaatttgatcatttattctaaattgtaaatatatattataataattgaaggataattaatatcaataagcatattttcttttcttaatgcatattattttgtgctattattaaaacattaaaatattacaatttatgtattaactatatatcatatatatatacatatatatatatcatatgttcccccacacacacatagttagatttaatctacttatacttttaaaaagagttactttaaaaaaagtgtcactacatatgtcaattctatcgaatgagtagctgtagaacaggtttgccacactcaatcagaatcgtaagcactgggacaaatggtcaggtttacatttcagaatcattgcctggttgttagataggttgggtcaactcaggatagaggccaagagtccacggggagacaaagtggagagtgtggaatcacagaagcatgaatgcaatggaggtaggaatggcctatttcttaggacctgggaggatgactaagtcacctgaggatacgatgaggatgacaaaaagagggaaggattgtgggtgagagggaaataagattatttatgggtatgtggagttcaatttgcttatggggcatgagaaattgaataaaaagtctaaatgactgaagagagaggtgggccagaccttctcaaattttcaacatttaagtgaaaacaagggaggaataatattcctcggggatatcatgaattgcagagaaaagggccgagatgaaaggaatatttaaaggacaagaacataaagagaagcctccaaaaatactgtagcccaactctccttccttcttcttattgccatctctttaaattcttgccacataaaaaagcatatcatccacgggcttcctttcaaagtaaaaatattttctagagctttctaacttgtacctgtcctggaagaactgttctgtaatgaagttagaaattataaaggtaagcatgaaataagtacaacgtgccagggtgtaaattcaatcaaatccccaggtggggtttccctctttggttcagcttcattcttttgtagtagagggagtcggatacttggtagaagctccatttgactgaacattaggcttagttgaaatcatctatattttgggttttaaaatatgtgtgtggggggcactgtgggtaggtagttgtgtttaacatatcaatatgtattgaaaattattttttgattgaaagatttaatcacttggccaggcacagtggctcacatctgtaatcccagtgctttgggagacccaagagggcagatcatttaaggtcaggagttaagagaccagcctggccaacatcgtgaaacccccagctctactaaaaatacaagaaaaattagctgggcttgggggcacactgtagtttcagctacagaggaggctgaggcaggagaattgcatgaacccaggaggcagagggtgcagtgagccaagatcatgcaactgtgctccagcctgggcaacagagtgagactccatctccaaacaaacaaacaaacaacaacaaacacaaagatttaattattgaaggtgagtgttccgaccctgaggagcttacaatttgctgtgggatcaatgacttaaagaatcaaagccctacttggttgtattcagcgtgctgggggagtaagccatggtgagaatgtgcctcggggtgatgcacatttgtgagctcttttcatcggcgctgtgtggttgcattctctgtcatcctcttgggctgccatccttttgtctgtacctattcactcactgaagcctacggtcaatagagcactagttgaatagaagattattttagatggaacactctcagatctcaagaaatttctgaaaaaaagtaacagtgccaggtagctgaggaaaagaagagataagaccttgaaataagaatctgattgaacaactgaactaaagagagagaaaagcctttgaaaagcatgtgatctacttgaaatttgaggatttgggctataatataaatctgtcatgttgaaagaatacttaggaagttggtgaagacagaacccgtgctaattcggggtaactataaaatgattatctttatttcatgagtagcatcagacataatcaaagggcagttattttattaaacagatgctcactttggttaaatattctgggattacctgagacccattctgtacataaatgtcttttatgacgtctaaagaaattgtcaatattctgaaaggaggcttttaacaaaatcatgggccacaggtggagatttctcctctttacttgaggacatagcaggctttctgagtatgtatttctacttcaataagacctaagtccccatgaggaactccccataggaaaaccctagcactaccccatcagcaagggaccttccatgcagagaattccatcggatgtcacagataatggctgcctttcaaccagtctgctggatacccaggacaaacgtgcatgaagtataagtaaatccaaagtgaacttaattgacaacctaataacaatatcaaatttaatcaatagacatctttgaccaagtaatgattcagaccactcaaagaatttctatacattcaatattcgtatttattctattttgagttaaattgctagaattatgaaatacagaattattaatgagttttctacattatatatgatgaatatgtatgaggacacaattttacccacttcatttactataacctagtctatgtattaaaaccccaaaagaacatacttatacatacataagtataagaaagaatgagaaagaagtatggaatactccttaatataagctcctgtagtataagtgcagcatttctgttacaagtcttataaaatatatgaagtatttatttgtataatttttatattagctaggacacaaaaatcatgctgagaaaatagttaaggatttttatcactgaagataggctgagttatgctgcagtaaaaacaaactaaaaatctcagcagctcgagtcaacggaagtttaaagagaacgaattctgcagtgccttcccactgtgtctataaactcagccacataactcatcatgggaagcaggacacaagcaaaggcttggaaagcactcgggcagttgggtttgtcctcttcctcatgcctcaaccatcgctctgagaaaatgccaggtctactgcaggaagaaacacagtgcacagaaccagggggtccagttgctccagatcacatctagttgaaacctagagacatacaggcaaaatcagcagaatggagctgaccaccccagtcctgtgagcaaaaaaatgcttcttgtgtaccacaagggtttgtggttgtttgttacatagcatacttgtagcaaggcacagctgatacagctgtcaaggtcccagtatctgattttagctcccagtttatttttctgttgtgatgaacactgtttaattcagtttcaagtccacatgtacatgttagttttcccaatctattgccctatagttacatggaatacatgaaggaggtgctcagacagttcttgttttattgtatttcctgccaaaaagatgccccatgttcatattagttattccccttgatcagctctgcttctctttttccacaacaattagtgcttctatccagaattactactgtccctcttatctttcttcttctacccagaattgcaaagacaattacaagtcactgactccaagccactctccagcacaaggattgctacaccggatcctagggtggaaatctcaggataatcttttctggctatctgctaatcccttcatatcttgagggcttcccctgggtactcttcaaaaacacagaggttgttagcatgctttagctctctatgcagagactgagctccactttgactgcaatgctttcctccatttctccttgctctaatctctgcaggtgcaaaccaaccctgacatcctggaccccaaactgggtcaaagagccaagctctctacttaatttggaggacaggcttagtacctgatcatgtcaactcttaaccaacatccgcaacactcagatgcttcagtgttactcccaaaacatggcaatgggagaataccaacacagaaaaattctaggatgacgcattcagggatcacaaggcagattcctacaggatcacacatgaatgcagtgggctggctggggttaagagttgggtagagtctgcaggctccatccaaataggctaagagctacccaactgaagtcaattcattccaagaagaatcatgtttcaatttttcaaattttcaaaagaaattaaaaatatatagttggcaattaatttttaaaaacttatattgtcccaatgaaacatacatccagtttacagatatatgtttatatatgctatcaggagatagcaaccaccatagaggtttgatctatttggtggattattccagcaggaaaacagtgttcttacagtcaggatacatgcatggtacctgaattatgttgtttactggaagcaagagggtcttgccttgcctttacctgggttttgcagtcagaatggaacacagagagtagggctacacaggcaaatctccattgctgctgcagagttacaccttctgccaacagcaagtataatatgcaaaagatcttaactttctttctaacatttattcagcaaatgctatgttccaggtacttctttagttattgcaagatttagagtggaataaaatattgtctctgccctcagggagtagacaatttcacagtattactgtatttagtaaacaaacagatgactttcagtcttttgggtctcatagaatggatttttaaaaagggtgaatttgaattacttatctggatatcttgtatatctgccaaataattcgattttggaataaagatacaaaatataatttgatcagacccccgtatctctgatcagaatcacttagtaactaaaatagttaagaaggtgcaaaggaatattatcctggaggaagaaaattaaaagaattatctttttctgagggattctcaaataatcttaaacaagcatatagagtgtcttaacaatacgtgtactggaatcctcatctcaaagcatcctacaatttttttcatctctcattcagaggacagggaaaaagaaaggaaatgatttttcatcaaaaatgtgaacatgctgttttaacatcaatgactagaagactagatgtagtcaagcttatttgaaattaattatctaagaagcctcaatagtgctcatcccatcaatcttgttccggcctgacctcggaggactacctgcaaaggtgtgaagacagctcagacttcagaacaatccaatgcatggccttggctgacattcactacaggaagactaattaagaagacttctcagaatacagatgcctacctaatgagagctgaagtaacacataccatttttcacttcggtcaagaaacagatgacagagagtagcagatggttcactttaacagaggcctgatgaaaatatgaatgagtgcctctcagttgctacctggcagagtgttgaaagcacctcagtcacagagagggatcctgaacccaagtacttagcatcaggaatacagctcaagttccagtttccagaggatgttctagcaaacattagttgaggccacttaggtttggaacggactgtgttggtcctggagggctcctcgaatggatgcatcctaacctttaacccacaataagagaaatgtacttaagcccacctctaaatgaatttgtcttcagcttgttcctctggaggccctatgtccagcccaactatgatatagctgtcacagtttagttgtggctcacagttaggaaaaaggaaaaagctgcctacataaagcatatttacttggctcccttccctgaaacccactgcaatggaggaaaacaacataatcacacgtaataaaaatggaaaatatctacaatacaaatgctaacctagtgaaactaaactaaggacacacaaagtcagtgtgtttctctccagagctcaagcagaaggcagattttgctagaattaaatgagagactcttgagcatctcagctcaaaatgattcattttctgacaattaaattagggaaactgtctgaagataaatccagaagggaaagaaaaaatagccacaagcttttgaagagctgacatctgtcaatggtgcaggcataaatcatctccaaatagccaaccaaatgcctgaacaggacaaataccacactgaccttctgccaggatgatcagcttctctgcccaaagatgtgtctccaacccaaaggatgctacacattgtgtatggagaaacagaatgtgtctgagcactacgccagccagaattcttcccccacccaactccattcctgagcaaatcatgggccacacttgagaataattattagaaagagaaaaagctaatgtaatataagtggaaaaagcaaaaggcagatgacagaagtaattcaataaactgcaaaacagtatatatagccagatcccttatatgaaaatatatgtatatgtgggcatataaataaaataatacctgggatgagacatctgaaaatgtaaatagtatatatctgagtagtgagagaggggttaatgtgacgcttctactctttgctttattcatataggaacattttaaaaatataattttgaaaaaacagctgagttgagcttagcctctgaagagagtgaacatcccttcagggaagtggtataatgctgtcagacttgaaccttgatcctttttcttctatcccttttatctttcccttgactctatggtgaaccactttagagtgtccacacttttatgcagtcctccacatcttgagtgtggataggacccatgacttgctcctaatcaaaagaatatagcacagtgatgggatgtcatacctatgattacactccattatatacacatgcattacgtgagactttatcttgggaatagactcactctagagactcccctggctagctagaggaagcagcagctgtactgggaaattccacatggcaaggaattatgagtaacctttaaggaccacaggtagcctctaagaactgaaagtagcttccagccttgagccagacagtatcccaggccctcagacctggaggtctgaacaaattctgccaacagtctgagtgaacttggaagcagattcttttccagcaaagccttcaacaaaacccaacccagccaacccttgattgcagctgtgtgaggttctgaggagggggcccagctagtctgtgcctggacatctgactcgcagaaactgaactcataaaagtgtgcttttttaggccaaagacaaaacaaaagcaaaactctgaaaccatttccattggtgtgatcactgaatcaaggtggtaaaatatgggccgagcaagggatagggatgaggccttctcaacaccagtgctttccaaatattttttgaaagtcaagtttattgggggaaatcttatagtcagtaaaatttatccttcttaggtataaagtttaacatgttttggcaaatatataaaggcagataagcaccaccaaatcaagatacagagtgcgtcatcacactaaagagtactctctttcccttagttgtcagccacctgccctggcccgcaggcatccactgataggattgtctacagttatgtctttttgtgaatatcacatcagtagaatcacacatagcctcttgtgtcagtctcctttcacttaacatagcatttctgagatttgcacaaattgttgtatgcatcataattagttttttttgatgatgaactttcctaccagggaagctactaaaataaggaagtaaggccagcgcggtggctcaggcctgtaatcccagcactttgggaggctgaggcgggcggatcacgaggtcaggagatcgagaccatcctggctaacgcggtgaaaccccatctctactaaaaaatataaaaaattagcctggcgttgtggcgggcgcctgtagtcccagctactcgggaggctgaggcaggagaatggtgtgaacccaggaggcggagcttgcagtgagccgagatcacgccactgcactccagcctgggagacagagcaatactccatctcaaaaaaaaaaaaaaagaaagtgaaaattaggtgtcccacaactatgacttttgacaacgtgtgactgcagaaacacagcacttctgagatttgcacaaattgttatatgtatcagtaattagttttttttgttgatgaactttcttaccagggaagctactaaaataagaaagtgagaactaggtgtcccacagccatgacttttgacaaggtgtgactgcagaaacagagccggtctgccagtcccatcctcctctcatgcacacagacctaatgatttttctacagaatatacccgttgtctccatgcagaggccgaacaatgacctgcatctcacttctgccttctttttctcatgcaagtaatccaagtggtaagacctcaaacaaattcaggaccctaaatgaaaaggagtctgggaaatatatttgtacctttccagcctctgtagttcaggaagataccacaggaaaaaactacaataggtgatgagtgacagtccaaaatccccaaaaccaggaacacaggacacacaaatgccacagtacatattaaatgctaaattttcaactattttttagagtaaaccaaaatataagtaaaaattgtaatttttcttcctactctctctcttatgaaaatcacttttgtaagccaatattttagacacacaacaatttgcgattacaaagtctgtttaaaaataaaagaagaaaaactacaaaaaagcctcagggtcttcaaacatcatcactgcagacagctctcactgtatgactctaattaatctcttggagcctccatttctacatctttaaagagacaaagttaaatatttctaagaactttccactcctaaatttctgcattttgctaattgtaggatattagctatgatgctaagtggtaactcacatatattcagaagaaatatattgatgattaaaagtatgttttaaagatgatttttttttttttgagatagggtctcactctgtcactcaggttggagttcagtggtgtgttcttggctcactacaacctccccatcccaggctcaagcaaccctcccacttcagcctcccaagtagctgggactacaggtgcatgccaccacacctggctataaagatgattttttaaacttaaatagatttatcagtggtaaaatgtaacaaaacccattgcagagtaataaattgtatttaatttttactataatatataatgtgcgtcagtttgctaaggaaaaaagcaattaaacattaccaaagggggccaagaaatctcctaaagtgaaaagctgtaagtaagaaaagatgaaacctttctttaagggtttaatcatggttctctctagatattggagagatctgagtagttctacgaattataataacactagtaataagtcttttatttacaggatactaatctgctaggatgtatccatttgcacaacctgaataacaatgtctaaaatatacaagtttatttttcttgcttggcgagtctgggattatctagggcgggccttctgcagtgtggctcaagtacgatgaagacacaggctccatcattctggatgcttccccatcctgggagtgttgtttgtcaactcagggccatgagctctgttgcagttccaggcaacaggccacatttaaggcagggtaagcaccacaaaatcaagatacagaatgtttcatcaccctgaagagtaccctccttccctttgttgtcagccccctcccgtgacccacaggcatccactgatgggatctgtctatagttatgtctttgtgaatatcatataagtagaatcatacatagccccttgtgtctgtctcctttcacctaacatagtgcctttgagattcgcacaaattgtcacatgcatcagtagttattggtttatgaactttcttaccagggaagctactatgataacaaagtgaaaactaggtatcctgtaagattgaagaatggcagtgcatcgactgttcccaagagagcaagaactgtttcaaaaaacacagtaggtttctgcgtttatgtgtcagagctatgcctgtgacacacccggctactgaagaggctgggaagataaaatcagctttcccacttctacagcagaagccagaaaaggagaaggcagtttcactcggctaatgggcagtatctggccaagatttacaagatgaaagtctttcatagctgctattctttaggaacattaccagctagagttaactccaggcccagctacacagcagtgtgaatgatctcttattcaatgaccactgactctagaaaaactctcaactatactgtgacatgggtgtgtttgctcaaataatttaatcatgtaaaagcatctcttcttggatctgttaaagcacttgtcaaaatgtcagataaaagaagatgatgaactaaactgtattataaaattgtgtacaataatcccaaacagttagttatttttttctgcttgctaagaatacagcgtgacctgcaaaaacaacataaaaagttaacaattctacagaaagcaataagagcagtgcagagagaattgcttccatcatttaagaaacggtagacaaagtattgagaagccttaaaacaagtgcaaatgatgctgtcagtaagtataaggttggactccttttactatggagagattttgtacaaaacatttctttaatattaaactaatgttttcttagctaaattatcgtatagtgaaattgtcctttaagtacattttaaaaacagaaatcatgctcatttaataaaattaagatattacaaaaaagcatatttgtacattaataatgtaagagttatttagaaaaatgcctttggtgttccacttaagatccatgaatggcatgtattctgtgatatatggaatataaaaatatttttattataagagattaacttaaacccacagagacatttcaatgtagtgagggagaggtgaccacagataactctaatacctgttagagatgactatgcatcccaagagaagggcaggcaaaggaaagatgattgttccttcctcagctttaaggagccaagaaccatttatctggattttgacctgcttccctttgtctccatctcctaaatcaggtgatggtttaaggaacccttcggtccggctgggtgccgtggctcacatctataatcccagcactttgggaggctgaggtgggtggatcacgaggtcaagggatcgagatcatcctggccaacatggtgaaatctgtctctactaaaattacaaaaattagctgggcatggtggcgtgcgcctgtagtcccagctacttgggaggctgaggcaggagagttgcttgaaaccaggaggtggaggttgcagtgagctgagatcacaccaactgcactccagcctgggccaaaggcgagactccatctcaaaaaaaaaaaaaaaaaagacagaaagaaaactgatctcacagcaaaaacagcttgaagaatgtctacactttctccttcgttggcctattagcagaaatccttgaaggcagatctaggaaacaggaactgatgaaaaacaaacatgaactttaactctacaagtctattttttccctaaatgcctcagcctgctgccttcacagcagttacagctgaaggtccgggcagtgcaccactacagtggcattttcaatggaagggaggttagggttgagtttgctatgtgcatcaaagcttttgctacgtttctcttttattttttgtcatagcaaaacaaaataccatgcaatctgatcctttgcctattcagtttaaacataagaaaaacaagttttaaccccttgtcactccacatcatttgtacagataatacatttaatttccttccagtgtgttcttattgactctaattatcaaagagaaatcactgagattcccattcttcttaccaatgattggcttaattttttttttttctttttgagaggaagtctcactctgtcgcccaggctagcatgatcttggctcactgcaacctctgcctcctgggttcaagtgattctcctgcttaagtctctggagtagctgggattacaggcatgtgccaccacgccaggctaatttttgtatttttagcagagacggggtttcaccatgtcggccgggctggtcttggaactcctgacctcaggtgatgcacccgccttggcctcccaaagtgctagaattacaggcatgagccaccacgccgggccgactggcctaatttgatagcatttttttatatatatttaatcggcatagtcctaattttaacatgtagggcatgctcattgcacgccacttacatatagaaatgtacattcaggtttcactattgtcttttatataaaaaaatcaagcagatattcttatgttaatggcacataaaagtaatagctaatggttattttgttattactacatgttatgaactgttttaagctctttagctatattaactttgaaattcttacaattctgcgagataaatactattattaactttaacagataaaactgacgcacagagaggttaaataatgtaacaaaatatatttacaacactcctagttactgttaaaatgaagtatagttttgtctatggataacattcacatcttgatctttcacactttgccacatactagccacacggccttaagtatgctaacttatctcattaagcctcagtttcctcatctttcagatgggcatgggaattgtatatgattctggtaggtgggcagattataagataatgtgtgtgaggcatggtgcctggatcacagtaagtcctcattgataattagttaacattattattagtaggagttcaaacactgacttctagtcttggattgggagtttataatttgtgtaatgttggataaaagacttaagatctttgctttccctatttctttgcctgtggagtgagaactaaatgtccccagccagctccatcatgtagcataaggtcaagtcaaacaatgtttgcagaagcagtcggtaaactgtaaagaactagacacatacaaactacttcttttattaactcaacagggagaaaaaggctttaaccttttattccacaatgactacttccaaaagtttcagggtctctgagctaacacagataaatgctttcattgcatttttttttaatggcaaagtggtagctgatttttaaagagttttcagaaatattttcaacaaagtacctctcagcaactttcttaggatacagacctctctctgaagtttcacagtccttgcatctgtaattatggatgaaatgtagtattcctactaacaacactgagacatcaagaaaatgctgaaatgtttgtactgttctgttctttattcaataaagggcatacagcagtgttaaaataaaaataattttataaagacaatttaaatagaaatattaaagtacttgtaaagttcaaactctaaagtttcttatttgaaactcatttttccaatgatgctaattcaataggtataatttaaataatatttttctaaattcgtggtcacaaggattgtttttggacattaaaagaagagggtaaaataaaacaaaagagtcgttcatcctagaaatcagagtttagtaacttcccacagttagcaaacttaatagcttaaaatgagtttaaaatagaatcaaatatactagttggagaagataagtttttacgagattattttttgattaagtatatgccatagtgaaaatggggatatgatactgaacagcagcacacaaaagcagaggtattttttgataatatagtcattcatagtatcctaggggtcaggctaaagataaataaagttcgagccacattcctgcaaaaatggtatgtacacagtgctgcaaaatggggagaaggagaaagaaatgagaacataggatattcctctccttatgaaaaattatattgactatgaccagacagaaatactaaatacagtcagcaatttatttcttattttaggatgacagaaatcaatgtgaatgggtgatttcacaaataacatttgtttttgttgttaatattactattattagaagggctgaaattaaaaactattctttgtggagacaattagcacctacctatattagaaatacaatatgtaagccaggtgcagtggctcaggcctgtaatcccagtactttgggaggctgaggcaggaggatcatgaggtcaggagtttgagaccagcctgatcaacatggtgaaaccccatctctactaaaaatacaacaattagctgggcatggtggcatgcacctataatcccagctactcaggaggttgaggctggagaatcgcttgagcccaggaggcagaggctgcagtgagccaagattgctccacgccactacagtccagtctgggtgacagagtgagactccatctcaaaaaaaaaaaaaaaaaaaaaaataccatatatatacatatatataaaggacagtttttctcctagtattttcatcatgaggataagacttctgcaacaacctggatatcattagaatatctaaataccagctccatttcatttcaatacagacaaataaaatgtaacacagagccttaattctgcaaatttcttagggtacaaattgcaatgaaatatgtcatggatttgaagactaaaataaatggtttgaaacattcattaacacaatctaaacttgccatctttagtgatcaaggcttctggacctaccgttcacctggaagtgtggcataggacactggggacagcaggggggcgggactctgaggactccattcaagtatggcaggtccctaacaagaccgtagcctcgacaacaagttcaatattagtttaactgtaaattacattctatatttaactttgttacacggggagtatatgtttgctgtgagtgatggcttaatttatttttaaagagaaagtgaaagatatttctcgtgattgtatctgaaacatagtgaatgaatttgatggaaggagtgctcctgtggagctaacattggtagaaaatgaaaaaagggaaaccctatcagaaactgactggagtcggccttccagacagaaaaacaaatgcctcaacacctctttaaatgtttttattttcctagggataatgacaatttttttttatgaccagctccatatttttcttaagattactgcatgaatttctctcttcctctctcaataccttactctggtaaagttacagagcattacactggttgccttgatcttttacttcatttatatgcatttacagattagcagagaagcaagctcacttaaaaggtaggaaaatttaggtttgaatgccattctcacatttaatagtctgtgacccagaataggttgtaagatctctcttagcctcatcttcattttaacttgaggatgatacaatcttcctcatatgtaaattgtaataattcagggggcctggcgcagtggttcacacctgtaatcccagcactttgggaggccgaggcgggcggatcaagaggtcaggagatcgagactatcctggctaacacagtgaaaccccgtctctactaaaaatacaaaaaaaaattagccgggcatggtggcaggtgcctgtagtcccagctactcgggaggctgaagcaggagaatggcatgaacccgggaggcgaacagagcttgcagtgagccgagatcccaccactgcactccagcctaggtgagagagcaatattccgtctcaaaaaaaaaaaaagaaagaaagaaatcaggaaggtaaagaatgaaaatgtacgtgtattgcgatacattattattagctattatgtttatgattatcattaagggaaacaataatacttatgtaaaaataaaataccttaagattttgagagatagggtttctgtcttagagtgaatttttcttcatggccctgagttaccaggcagagtgattggggaaaataaatgccccaatttaatatccaatactctctggacaagtttagttccatagccagagcagatgtgaatgatactatcaagcatgaactcctcattcactcatttttacacaagagtatcacaagagactgccaaatgctttattgaaatcacgaagcattacatcttcaggttgtcgctgctttatttgtatggtaatctgttggggaaaaaaaacaaaggaaaacacacaaacaaaaaacaaggcagtttgtaaccattccttctgagtgaatccaggtgggcacattctgatgaatttttcaatgtattctccagcagttgacttaactgttaactccaaaacctcctgttagtcaagcctttttaagaaaggaaaagatcctttaaccatctccagaaagttgtccaaataacagatacatgtgacaagtagatttacccttcctactcttttctgggaattcagttctaggaggccttgccaggagtcaatattctggaatgcttcaattcatgcatagcttcttaaaggcatcttataaatgtcttaagatagaaatggaaatgttatgggcctgcctataaagagattacccatccaagtgccaaatacatgatttagttagaatgcatttggttgcgacagaaggtcaatgtgagctagtttaagcaaaccaaaaaaatgaaaatgacaaaaaacaaaatcaaacaacaaaaaataatttattggaagaatactgggatctctcactgaatccaaagagttgaacaatcaagcattctagctttctttacagggcagaaaacaaggcctccaattatccaaactctctatcgtagacaagcagacttcgttcaatacataataatgctggcatgaaaggactcagaaaaaatgcactgatgtgtccgcatctgttcaagtaaccattctggggccaccaatcctctacgaccaacatgagcatggggtatctggactattcacagagtgagcaattagggcttgacagccactcataaggggtttcccatagtaacttccggattcctttataccaggtctgatgtgatactacatcattatcaagtcataatgtttcttgaaaaatgtaaacccaacaacaagaagagtagcaatttagttatacacttaattaaatagtttaaataataaaataattgagggatgttaacaaaggataaatgtaacttctcattcatttatttatgtgtatgttatcaaaaaggtcaaattcaagcatgtgcccagatagcattaccatgaataagagagattatttactttggttaaactcttttaaaattaaatgtgaggtattattgcaattgaaatattcacatcacagccttgcaacccttgcatctacctaaatatattaaatttcatttacttattttctctctatacaatttctaacagttgttatttatttaatcattcattcatttaacctaaaattgaatcccatcagttaagaaattggaaagtactagtctttttatttacttatttgtttatttatttatttatttatttatttatgagacggagtcttgctctgtcaccgaggctggagtgcagtggcgcaatctcagcttaccacaacctcctccacctatgttcaagcaatgctcctacctcagcctcccaagtagctgggattacaggtgtccatcatcatgcccagctaagttttgtgttttttgtttgtatttttgtattttgagatggagtctcactttgccaccaggctggagtgtagtggcacagtctcagctcactgcaacctccgcctcccgggttcaagggattctcctgcctcagcctcccgagtagctgagactgcaggtgtgcaccacaatgcccagctaattgttgtatttttagtaaagacggggtttcgccatgttggccaggctggtctcaaactcctgacctcaggtgatccacccacctcagcctcccaaagtgctgggattaccagcatgagccaccatgcccggccaaaagtactagtcttgatactagaaattttgttatgaaatagtgattttttgaaaagacagaaaatgagtttcaccttactcactgtattagtttgttctcacgctgctaataaagacgtacctggcagggcacagtggcttacacctgtaatcccagcactttgggaggctgaggcaggtggatcacctgaagtcaagacttggagaccagcctggccaacatggtgaagccccatttctactgcaaatacaaaaaaaattagccgggcatggtggcaggcacctgtaatcccagctacttgggaggctgaggtgggagaattgctagaaccctgggggcagaggttgcagtgagctgagatcacgccactgcactccagcctgggagacagagcaagagactgtgaaaaaaaaaaaaaaaagatgtgcctaagactgggtaatttataaaggaaagaggtttaatggactcacaattcagcatggctaaggaggcctcacaatcatggcagaaggcaaaggagaaggaaagtcacgtcttacatgggggcaggcgaaagagagattgtgcaggggaattcccatttttaaagccatcagatctcatgagacttatttactaccatgggaacagtatgggggaaactgcccccatgattcagttatctccacctggccccactcttgacatctggggattattacaattcaaggtgagatttgggtggggacacagccaaaccatatcactcaccattaatgctatcaacaccttcttaaatatattccaacaatttaaataaaatagctttattgacttccataaaatagtccaatggcaataaaacatcaggactcttgaaatgaatttcgcacattcaattcaatctcagtggttaagtgtgaaatttattactattgttactcatgatcaattaataaaataatttcaatattcgtatttgtagctactatgcaaagagcagcttccatattccaggcactacgacaggccctttccattgaatccaaaagaaggaagatgtctcaaaggggcacaaggacactttgcacagcataattcaaatagtggctaatgttcttaagatttaatgaggactatctagagtctcctatcccaccttttgtgagaatttcaattgacccaagatttctggaaaccccagaacttcatgttctactggtcatctgtggctctgagctcccgcttctgtaggaaatatctccttctccattcacggacaataactattctatgtgctgactgagatgagcaacacaacttgttctccttgatttccccaaagcctcttgatatcagacattggcaggtgctgggacttgcaaacacacttgtgatccagagggttttaagtcacagcaacaaaaatgacctgattatcaagagttctaacacattttctttttttacaaaaaaaaaaataagaaaagtaagagagaaaaaatctacatcttctcccagaacactgaaatgtaacatgttgaagtgttatcaaggagctttgaaacgcctcctgcactctctctccagcggatttatagaccatctcatgtaataatctgtcaataagttaaattctgaaagctcatttattattattttttctctaccaaatatcctctcctctctccatatttccttagtgactaaagaaactccagattcaccattggatttcctgatttaatccccagcttgagactgcatagtctttactgcttaattgtctaagagagatggcaaagagtaattcatcaagctgatatcaactgaggagcacagatttccatgggcatcctaataaactaatatgtgtttgtaaaatgtgtgttattatatgcatacattccattacaacactgagagctaactgtcttcattttatcagataattaaaatcagtttcagaaatgttacataaccaaggccgttcagtaagaaaatgctggaggaatctgaagtaagtctactgattccaaatgtatcactttttccatcatgcagaatattagcccacactctatggccacttatgaatcagtccttaaaacaagatggcatacttctccttcagaagcgagtgtcacgtagcttactctgtgtcatggcagaagccatgaaaattaccttatccttaaaatagattacagcccagtagtactgagtgactttccccctaattaacaaagataatcagatgtcccacctcaagtccttacctagacttgtggtggagacaatggttcctaacgctacataataaattgtctgttgttatagatactacatatttacaaagtatggatatctcagaccacagaggaaagattcttagcaggaacaacaacaacaaaactatatttaaatgttgtcaagattaaaaaataatatgcaatatttatccttagcgatgaaatactaataagtagattttactagctaacaagttatatgtcagagtttaacaacatctatgatttggagaagaccttagttcatttagttaaatcttcactctaatttaagtccctcacagatattcattcagattctccttgcttaattctaacatctaggacttcgctacttctctctttgaatttgtgggtagctctgacatatacacacacacacacacacacacacacacacacacacacacacaccacagatcctttccaacttttttcgtaccctagtatcctatgtttcatatggtagttagaaaaggataatatattttgagcatgctgtgcaaggcaatggacgaagccagtgcaaagagcttacccagccacaccccaggctaaaaagaattgcatctcagcacatttactgacaagcgatggtacatctctgtgctgccacccactggtcaaaaggtctgtcattgattactgtttgtcagtgaatttcccaaagagacagcagcaactggccgtacttgagagtacttccctaaatttgtcatttgctggcatctttgagaccattttttccattaaaaaaaagtctaccttatgaacacatcccagaggcagatctgcagtgaaacttgccattgtcactagcaatgtaaaccccaaacctatttgttccttccaaatatatggggggctacttaagtctttgagttattcctttcaggcttaaagttcctcaagtttgtaactgagattcatatctggcacaagacagagacctgcctctcctaaattttgacgctttatcctaagctcttctcagttgtacaacagttattgaacaaaagtttggttcttcttttgcataaccatatttgaagacagctcctacagccccccttcctgtctcacccgaccacccacaatttgcaagccaagcatcattgattttcccacctgcaacatatgtaacttggtttctatattcttcacaggtgtgggtatgctgccgcgactcatgtttgggagcttattttgtctactgactaaatatattgctaatatttttaaatataatatttacatattttaaaatgtgttgttggtctgccatggaatttttttgatgttcttaggctctggtctagcagttcatttcagtgttacctcagctcactattctgcctatagtcaaaaaagtcagaaaacatcaagtgttggcaaggatgtgaagatattgtaatcctcataaaatacagaaacagcctggcggttcttcagaatgttaacctagtgttgtcatgtgacccagcatttccactcttaggtttttattacccaagggaaataaaaacatatgtccacacaaacttgtacacaaatattcacagcaacactattcccaatagacaacaagtgaacacaacccaaatggccatcaatgaatgactgcataaatgaaatgaggtgtatccatacagtggaatattatttggcagtaaaaagtaatgaaatcccgatgcatgccacaacatgaatgaaacttgaaacattatgataagcaatataagccctttagaaaagaccatatatttataattccatttacataaaacaatcagaataagaaaatctgcagaagcagaaagtataatagtggtttcctggagtgactgtgactataccaaaaccacataaaaaagggaacagtatggtatgtgagtaaatctcaataagctgtttttttttaaattcaccccaggctacatagaatcgtaagacttagaagtagagaaaatggtctaacatgactgattttttataaacatggaaaaaatgagtgaattggttatctactgctgtgtaacaaaccacctcaagatttactgacttgaaattacaaccaccatctgctttggtcctctatctccaaatatcaatgaggacagatggcctctgcttcacacagcattagctggggctcggggctccactgctgatggctcactggaaaggttgctaagtcagtgctggcatcagccaggagttcagatggtgctgcatgcctggagactgcgtgcctgtccacatggcctctttacaagtgtcttgagcatgttcacctcatggtgactggtttctaagaatgagcatctcagaagaactaggcaggaggtctacttccctgtagccctggtcacatgcattcccttccaccatagtcctaagcctaactggaatgaagaagaggaaatatggagctcgtctatcaacgggagaggatcagattctcatcacaagaaggatgggagacataggaaattgtgatctagcactctgaaacaagacaacttaccatagtgagttttaggctaagtttattgtcacaattcccctgtttacttcgccttcctgcaatctttatttgtggtccacatttctaacaaaaccacctatttactcacttcctgtgttgatgaaaaatatattcatattttacattttagtgaggtagctttcaataatagactgctttaagacaccattttcacagagttttctcctaagaagatgctgaaaagtaaaccctcacatgagccagggacaagaatgaagaatttgctataacagtacttaaatttttcaacacaaatcctcccagcattttcttctatgaagattctatttcccgtaaactgaagagaagactgaaattaatggttacacagttgcaggtaagtatgctttttgtctctcttggaaccatctacacaaatgtgctcaaaaggaaatgtgctaaaataaaaaagtgccaacaataaaagaactactcatatacaacactgtataagtccattctcatgctgctatgaagaaatacctgagactaggtaatttataaacgaaagaggtttaactgactcccagttccacagggcctgggaggcctcagaaaacttacaatcatggtagaaggggaagcaaacatgtccttcttcacatggtggtaggaaggagaagaatgaccaaaggtgggggcggaaagccccttataaaaccatcaaatcttgtgagaactcactcactatcacaacaacagcaggagggtaattgcccccatgactcaattacctcctaccaggtccctcccatgacacatggggattatgggaactacaatttgagatgacatttcggtgaggacacagccaaaccatatcaaacacatatgacatgccaccattaaacataaaaataaatagtaaacacaaaaaattacttcaaaatctgtaatgattaaaacattttaatatgacaacatcaagagtttcatcaagcacaaatatgtgaaaaatctcccaaacacaaaaagcatacaaaataagcactaaaacaaataattggatttttctgagactctggggaacagcatgctttcaaacagcagttaaaaatcactgaagattttcaacaaatatgataaacttggcataattgtatacaaacaaaaataattaagtgtatttttatgttttttatgtgtaaagttgctgattcatgtactaatatggtaggttttttttcctcttaactaaaacaaggtacacagtctagtttcaaaaaaaaagacaaagacacattttattaatgaaggatatagttgagtaaataagcctcatattaaactgaaaatatctcattccacctgattaaatgagttttgattgaggttgtttatagaaaaaattgcaatttgggggcctaggattcatcagtcaatgggcacattctgaagcgatatgcaggcagcccaaatggaagatctagacccaatacaaccattaaagtaagggaaaaagcatatgatcaatgtaacactggaaatgagacccctgcaccataaaagtgactaaggacttttaccacaattaagcaacgcatttacttttgtgctaaaataaaatggaaaaagacagtaagttcattcctaagtcatactctcaatacaaatatactaaacacctcctccatggctggcactgctccaagagctggtgacccaacagtaaggaggggagacaaggccacatccccatccaataagcttaggtgagagttagaaaaatattacagttattgggccgggcgtggtggctcatgtctgtaattccagcagtttgggaggccgaggtgggcagattacaaggtcaggagatcgagacattcctggctagcacagtgaaaccctgtctctactaaagatacaaaaaattagccgggcgtagtggcgggcacctgtagtcccagctgctcgggagctgtggcagaagaatggtgtgaacccgggaggcggaccttgcagcgagctgagatcacaccactgcactccagcctgggcgacagagcaaggcttcatttcaaaaaaaaaaaaagtattacagttatgcagttattaattattaccagtagtaagagtaatatgtctattactgaaacggttcatttatattagatcagttgactatagttaactattgaaaggttttcaatgtcagtaaacaaaccagtaaagctcctagtatggtaatttcttatcttgggtctccataaagacagagtcaccaaatcactgcagcattattcaagccgtgttcttggggggcattccagtggagggatgaggtgttgttttcaatatgagcagagctctcaaaagtgagaggatttacactctagatgattcatttgaagaataaattgcctctggcttttgacaggaggtctctattaggcaatttcaggtctctgaacagtatctcaagtgtgtggtattatttaacaaaataatttaataaaagtggctgttttgttaataggtgggctggattccaagcttatctatttcggtggagggtttctcctctgttgtggaggtggtgggcatgggtgctggccaacagtgctacagtggtatttcaaaagttctgaatcaaataaaagacttaaacacctttggttgatatcccagagttctacttttcagaatagaagatacggcagtgtcaaaactatatgtggaattgtttgtgatttcctataaaaactatggactagacttttatgtaattttaatttttaatttgagcataatttctttatcactccaagatgtgtaacttgcgaaaatgcatccccaaatgactaaatctattgacttggggaatgaagctatttagcaatgtctccctagatgttgaagattacctgtcaaaagtgatttttttttttgccttattgatattgagttgttctttctcacagtaattaggcaagtggcccagctgcttcctgaggctatgagtagaatatgaaagtcagaacttgtccttagtgaaaaaggaggatgctaatcttcacttttccatgggaggccacagagccagctcatttagagcccagggcatgaacttgcacgtgcgttttatgattgcagcccagtgacagcaacttgaacatgatcgatgggctgcctcaggcatgtttacctgtgtcactgatgcatgctagagataactccagtccaggccactgatgcccagcaacagaaattttcaactaaagtaagaatgtgtctaacccacagtattcccttcctgtcacattttctctacagatacaattaactaaaaaataaggtatagttgttccttaaattatttgtatttgggttattagtgattccttttaaaaatacattgcggatcaaattaaatatattgcagatcaaattaatgtataaatttccctattctcttctcctcgttaaataagagactggcagagaatactatctaacttgaccttagcaaaaccttggtcatagaaaaatatttttcttcagaaaaatatcagacaacacattgtaggcctattattttatctaaatgatgaggttgtgtagtgtagtgggggggaaaagcactgaatttgaagtaaaacataaagtctcagtttcttgatcataaaacatattgagcaaaataatcattagaggaaaaatatatgatttaattatatatctgaggaaatgtttcacatgtacattttatagaaatacatgttttacaaaaatatgtaaattaaaggaatttattgtctgttctttttaaaaaacgtttttgagatactattgaacattgtttccttgctctaaaataattcctgtgtttttcttgactattcctactatatctggttccatttctctgaaaaaatcaacatttttcccatgagcttcctctagaatattctatgggttaatttcttgctttgtgcaaaccatgcacagcgcactgactattttaccccaggagcccctgctttgttggcctgccagtggcccttttcagtaattaatgatgacatattttccaagcgaatttttaagagtcttgaatctttttttttcaaacctttgctccaggcagtgtctgtcaaagcagacccaatgattaatgtacaaggaagtgtgacatgtcacttcttttcatactgtgaaaatggaatcaatctaagatcaacaaaggtaaaaatgtgaaatacaattatattaaataattcacagtgaatctatatcacatactcattagaaacatgtttgaaataatattaaatgatatgaaaaaatactcctcatagaaggttaaatgtacaaagaagaataaaatatttataaagcaaaatgaaaattttgtacagataatcttatattcatataaaaagtctggaaggaaatctccctaaatatttgcagctacctctgtttgtggtgaattttcaaaataaaaaaaacccaattcatttatttttcctatctaatgttttaaacttttacacaacatgcatgaattacgcctttatagtggaaaattcataaaaattactaaaacaccacattttacatattcagtatgattttacatatgaatatttaacaatgagttgtagtaataaatatgacagaagcgttagaagcactatattgtcatgttacaaaaccccacatactaaaggcttattttctaatctagcatataacaccctagtctctttttttcccttgatagctccagtgctctgtaaacccaacaactaacactattaaatagaacagagcataaaacaatcaaatgagttaattcttggaatggagtttgaaattatcaaaaggacagataggtatataagtgtcctgagaagagttataaactgaaactaaggaaaatattaagtttcagggggaaaagtcaaaataacttagagtaactaacagaatacacataagagagcatcaggaagcaggggtggagagacagagatgatctatccagagttctagaattattcacccataactggaactcccagcacacattcccaagacttgaataagtagtttatgatttgtttctccttgatttatagttttatttatcatttttctgatgcacagggttaacaagtaaacaaatacacttcaaatgcaggtggtcccatcaatctcatgctacctgagcatccctttccttcatacatgaacttcataactttacatacacactcattttctttctttaccctcctggaactctaaacaccccatctggtcaatctatctacaatccttccatcctgtacgtatgaaactcacaaggctttctgatccttgctcccccttccttgttataaaccatatcatgtgtcatgacccagttccacggactcctagcttgcacctttatctctcaattcacagcttcaaacagatgatcactattcctaatacagctgagtttctgcaacaaaagttaaaggaaatgcatgctttttttttcatttctaatccaccctggcttgaaacaagaaataaaaattcagcaatcacgtaattctcacttaaattttgatatgtggagaaagttcaactggtagcactatgctatggataattcttcccttctctgactaaacgaatataaacttcactggtctttgcagataatcctctatcttcttgacctttcctaaggtgttataacttctgctttttcttggatgataattttgtcattaatttcataaaatgctttcccaaaataccatccgaaatttgattaatagttataggtcatttccctaacaacacattgtgttatcagaaattattgttgcacattatagtaacaccaataatgctgaaagatttagcaacgatatgtggcactggaagaaaactaattaagggagtattttataatgaacttcttccaaatagtattcttgttatatatagagttaagttacttttgaaattctaaatgtagaagctgaataaaaaggaaggcatgctatcctcacaagagatgatgtaaaagatctagtttctttagattttaaatgaatctttttaaattcttccttgtggcttcatatgacacaacatatataaagtactcagtgtcgtggtttgccccatagtgaaagcccagaaatgtcagctgggcacggtggctcacgcctgtaatcccagcactttgggaggccgaggctggtgggtcatgaggtcaggagtttgagaccagctcgaccaacatggtgaaacctgtctctactgaaaaaaaaaaaatagccaggcgtggtggcgcatgcctgtaatcccagctattcaggaggctggggcaggagaatcacttgaacctgggaggtggaggtggaagaggttatggtgagccaagatcgcaccaccgcactctagcctgggcgacagagcgacactccatctcaaaaacaaaacaaaacaaacccacagaaatgtcttactcttactttcctatattttgtacaataagaaaaactaaaaggaagagaatgtctgttttgctacctttgaatcaccaatatcctaaataatggtactcaaaaaatcctctaaaatcaagaatacggtttataatgattgtgaaactaaaagaacaatgaaaattagtgtaacaatagagtatctggagttacaaatgctctcaatttcaagtttatttttagtctgtaaaaatcatctggggtttgataatatattgactaaagagtttcctgaaattttcatctatatttttttctattttaaaactctttacatatggttgtcttatatttttaactccactgctaactacttgaaggccaattcagataaaaattttaagaaacaacttagctttcactctacagataatattctagacttgaggaaaaaaataaggaacctttaagaatgatttaggatacaaatcccctaatgaaggataagattggttgtttgcatcaggacatccccaaaaagctcatggaatctgctgctttttgatttatgctttcacctaggcagatgctgcacgtgggacctaattcccagcttctgacttgggcacctggggcttctctatctcaagtttccagaacacatttgcatccctccccaaattacttatgtgccaccaaaaaaaaaaaaagtcatctttgctgccccaaaatgaataatacattttttaattcctcagaaaaaaaacttttcacagtgatatagtttggctgtgtccccacccaaatcccctatgtcttcagtctgtttccacctccatctaactgtaaaacacaaatgctaatcaatattaatagtttgatttgtttccttctatacttttctagatgctcataaatatgtataaaccaaaaacatatctaatgttctgagtttttaaaaacaggataataccatactatgtaatttcctttctaaaattctcatggattttttccccaaagattaaacatatagccccaactcatttttactaatgactgcataatatttatagaaagaatataacattttcaactcttcaccaagccatccgtatttttggctatttcaaataattttataataaatttcgacacacataaaatcttacctatttagtcactaatttctacagaatatatatctaaatgactaaatcaatggttattgaacattttaaatgtcaatgcatagaaacaaatcattttaccaaaaaattatagcaatttatattcccatttggagtgaaaaagaatgtggattcctccaagccttaactcttacctagcatacaatataaactacttttcaacagctgtctacctggtagattaaaaattagttttattttcacttaaaattgtatgtccccaatgggtgcattagagtggacatttctaaacattcattacttgcttgcatctttcttctgtttatatcttttgcctagttttgtattcgtttatttctctttttctcaccaacattaggaagtcttcatatattaattttatcaacatgttattatacttgtggcacatattttctcttggactatttttctttgctattttgagttgtgtcttgctattactagtagtattcatattgtgaaactcatcgaccacttatgtatggcttctggacttcctctcttgtttaaaactttgcttacctttagtttacaaagctccttccccagagtttcttctaatatgttgatggttttatttttacagttaccatttttttccctgtgagatttatttctctttatgctgtaagttaacagttctaattttcttccagatgtcgagtcagttatgacaacaccacgtaagcctcttctttgtaatgaattgaaacacgaactttaagtgaataggcatatatgtatatttgaatctgttttgaaccctcagttatgttttacacagagaccattcttttttgggcccattgggtactactgtgattggtaagattggtaagataaaatctctcaaaactttccttgcattctcatatatttatacttccaccggtctttaaaatagtttgatccagtttgccaaagaaacaaacaaccagccacaggcttctgattacagctgcctaaattttatatcctaatttgggagacagtagtattgtgatgatactaagcttttcaacagaggagcatgccatgcctttttattcattctgaattactttatgtccttgtgataaaacaattttcagcagacaggtcttgcctttttgttacatttgttctttctgctttaaattttcttactactcagaagttagtagcctagcaagacttccagatcacacatgaataagaaagcacgacataacccaaccataacaaggtagtgtattgaggatggggagtggtattaacccccttggtggtccctttttccatttcccctaaaacataatcagaaaactctcaagagtgagctttggaaagcaaactaatcaaggagcacagcctaaagctcaacccaatttcctgcttactgactattttcacaaactagagtatccactcaatctattcaactctcccttgagtacctacttagctgaacacttcctgaccagatggcacacttttgactgatagcatcattgatcccttcggtcagtgggttgactgtttaggtggtttcccactcttacctaaatcagtttccactcatgaaacagaatcagtttcctctagagcccttcttctttttgaatagcgttactattcttaattgctcccattttaggctctcgctctgctgagatgttcctggagtcaggtaagttgccaattcagcatcaccaaatcacataacccaaacgcggcaggcttttttacttaaaattttaaaaaccgttatactttctagcacatgtttagaagaagcagtaactaaaagaatcttgatcgtccagctctctttatttactacttttttatttacaagaaacatgacttttataaagtgacgttttaaatctaaggttcagattttatttacttatgcattttttggcaaagtaacattggaggaagaatcgttcagactttcattagttcgagaaggaaattttagactacatccttccagatccatctcagaaaacactggaaaaaccaatttgccttgactttgatgtgatattcatttactgtcatatatatttttaacctcccggatatattttaatttttcattagattttatcttttctaagactaattatttcactttgtatgtttaatagtattaaatgtcaggtccatcaattaatctgccaaaacttcacccataggaaattttgattataaagttgtttttcttcccctataaaatatcttttcaaggaaggctgcccaaaacatggagtcaaaaggaattataaccatattacaatattatttatataataaataccaacactctgctacatgagtatgagtttcttttaacataatttaatctttaacgttcatctagaaaaacaatttttaaaatgtccccaaacgcatatcacaaaaatgggaatgtttctacctgttctttgactgaggcgaggatggcagaggtggtttctgtttcagagccatccccgttggaggtgtttaagccggggctcagggaactcgtcttctctgaggctgatgaaggctggtctggaacaggcatagctcctgcaaggcaagaggacatgatcaatacaatcagatgttgacactaaacaggtacaactatcagaccactttgaagatacacacagaaaaaaaagtaaaactataagctgctgagaaagaccaagacataattatagaacgggagtaatacagtaaagtaaagtaacagtacaagtaaacagaatgttttattcttttatcaactccaaccaaattccagaacacactcacactttctgttttgtctttgaggtaaatggggaaagaaatcatcagaaggaaaaagaaggagagactataagaataaagtaataaagaagtattgagtctaagaagctagtccaactataaatttatgactattttaggtaaatttattacctgcctattggtatatgtgctgttattacatgtttcctccttggttcctggctcatatctcccataacccccgttatagtcttgtgatggtactgggtgtgtcaggtctcaggagcaggcctcagaaagcaatctctctgaccttcccctgccctccttttacctgctctaaggcaggactctaatcctccctgcctcctttctgattgtgggtcataagatcctcattccacagagggtcctgccccctacgtcctggggaaaaaaatgctgatgtcaagaagcctccataaaaccccagaggactgggttcgtagagcttctggagagctaaccacctggaggttcctggaaagtggcacatcgggagggcttggaagctctgcacctcttcccccataactcgccctatgcatatcttcatctgtatcccttgtgatatcctctgaaataaacgtgtatacatatgtgtttccctgagttctctgagctgctctggcaaattaatagaatccaacccagggactgtgggaaccccagctgaagcctgttggtcagaagttctgaggcctggacttgcaattggtatctggggggatgagacagttttggggactgaaccctcaacatgtgggctctgacactctctgagagtggatagtgtagtagatagtgtcggactgatagagtagatagtgtcagaactgaattagaggacacccaactgtgtctgttgcttggcgtgtatgggaaaaaacccacacatttggtcacagaagtcttctgtgtttgttgttgttgtgtgagagtagaagaaaaatagagtttgagagggtttttcccaaaacagaatattttcaactcaaaagaaaatctatcagacattcccctttgcaagaaaatcatacagaagccatgattaataatttaccaataattaaagagatacctgaattaacataagaagcttagttagtattgtgaaatacagtcaataactaatctactccacaaatatttaccaagttcctagtccatgacagacagcagacaaaaactggcaaggccatttgccatagttgattttgtctgagtttatttgtgaaagaaagcagaaactcaaataacattagacccaatgcataagtggatgcatatgtacaggttaaaaacaagattctcagaattgttcccatctttcccgcacaaacaaatgagattgctgtggtctgaatgttgatgtctcccaaattcatacgctgaaatattaatacccaaggtgatggtactaggaggaggggcctttgagaggagatgaagtcaagagggtggagccctcataaataggatgagtccttataaaagaggcctgagagagacttctctaccctcccacgatgtgagggcacagcaataaggcatcatctataaaccagaaagtcggccctccccagacactaaatctgccaggacttaatcttttgcttcccagctccagaacttcaagttaatttccattgcttataaggagccaatttatggtgtttggttactctggtccccaagagagcagccatgaccttgtatcgccacctctctccatgtccaatggttcacaagggactttatgcaaggtgatatggtttgactatgttccccaacaaatctcatcttgaattgtagctcccaaaatccccacatgtagtgagagggaccaggtgggaggtaattaaatcataggggcaggttttgcccatgctgttctcatgacagtgaataagtctcaagagatctgtagctcaaatgaacttaaaaagggactgaagtatttgttacatgtatcatctagcagtgatcaacagagaaagcaatagttaactgaggatatttaccaaggcattacaaaacccccatctcaataaaagactgagagtaaacagaaattattttcttgcctaaagctattacattacacatccctccaggaaccagggttgtgtaaatattaaaagatattttctattataccatatctaagcatcctgggttttacattaagagatgtgatttccacagtagcctttgccctaagttattacgtatgtctagttaataatttagagatattccaacctaaaaaggccccattacagaattttacttaaaatatatgttaaggaaagcagtcatccaaatttcctattgaacatttcatctaattttttatttgttttaattttatgaagtacttataataatatcaccaatggggattggaatagcactgaaaaagtaaatctgttacaaacagaatatgtgagaaggaataataatatcaccaatggggattggaatagcactggaaaaggaaatctgttatgaacagaatatgtgagaaggtttggggaaataatatcaacaaaacaaaatttgagcaaagagttagaatcagattaaatatgatttggcaaaatgcaaccacagctaaaaagattaaagtattgaaggtgatgaataccaacaggatgacagaaagagatttgcgtaattatggtggtgtgttaggaagaacataataaagcatatttatgtattcaacatgctttctcatatggttttcttattcgatcaagtctcttaattatgtaaaatgtaaacaaccagttcagcaaatgttgtgcccagataaagagtggaacctatgaatttccagctagggaaggtttcagagatggtgaaagagcagaaagtaagaaggaaggacaatgcagctcttgtgtgcacagtcacctctggtccctgagaaagccgccgtgaccttctattgccacctctctccatgtccatgggttcacaggggactctatgcaaggtgatatggtttggctatgtcccccgacaaatctcatcttgaatggtagcttccataatccccacgtgtagtgagagggaccaggtgggaggtaattaaatcacggaggcaggttttgcccatgctgttctcatgatagtgaataagtctaatgagatctgatggttttaggaagggcagttcccctgcacgtgctctcttgcctgccaccatgcaagacatgcctttgcttctccttcaccttctgccatgattgtgaggcctccccagccatgcagaactgtgagtccatgaaaactctttttctctataaattactcagtcttaggtatgtctttattagcagcatgagaatggactaatacacaaggagcacctcatgctgagaaagggggactcttacatattttaaattaccattttaatttttgtttatttacattttattgggcccatgctaattcaggctctgagccagtattcttatcaacatatttttgacaaagaaattgtttaagggcccaaagttattaagtcacataagtgggcccagaactcaggctttctgccttttaattcctatttcaatgtcctttgatgtgtcagcctatttcctataacctgtactgcctcctaatgctactctactaactaatttttataaaatgtaactctttaaaagcataacagtgacctgtcataaaaaaatatgggatttaataggcactgaatcaaggtttctcctccggcacttgacaagtgtgacccacacagtatggggaataattaggcctgtttatctacctcctttctccttacagcaataacagaaagagaagtggaatcttcaaggcttattccaccgtacagagctaccgctacctaaagcaacctccattcctgaatgcaaatgacttggaataatttccatgattcataatttttttaatccaaatttaatgtaactattgtgtctggacagaaaagacagtcaccctccaatcacaatcttctcagctcaggtcacacagaagagagagaggaaaccacaaaagacctgccccagtgaatccctggatggccttagggtaagtataaaaagtgttaaacttctaacttcgcagtaatatggccaaatacgtcagtcttaatcacagctaatctactaaaaattagtatttaatctgtgcaaccaggaaatctgggaagtatagagaaataaaaagcaaaaaccaagaacaaaggaagagcaaccaccagcaattctgccattccagataagtaaaattactttgggattttggtgatttattatttctaatataacttattctgtacaatgttttttacataataaggtactaatgcaaggtttttgaatttcttgtggctcagcaacatctcatgaacaatttcttatatcaacaaacattgctctacagtttaattacaatgaatactcagtattcaataatctgtacatgttgaaagttatctacctgtcttttatatgtgatttttaccccatttttacatctatgacatattcaatacatgggttcccagcagtagaattggtaaaataaggaatctgtgtatttttcggccttttgttagccagtcctgctgccaggctggtccagcctactcgcccactggaaaggtcatgagaatgttacctcaccacaatgttaaccacacggatctccattatcctctcaggcttttgccaacctgatatagaaaaatgcacccctttgactttgtttttgtttgactgtgagtagagtgcacaatttacccagatttattcaccctgtacagcacttcttgctacccttgaagtggttaccatgtaagaagtcttcctacacatagtagaattataatctgcaaatacccaagctgcattttggacagacccatcttccacatgagaaaaagagacagcagtgcgggaagaacagccctaaatttcgggtgggttcttctagcagaacttggtaccaacaagtcctatgtccagaaaataataaaacaacaccactagcagtttcagggtgcaagtcaccctgctctatgcccacacatgcatgagcagtgttacggacagaactgtgttccccaaattcatatgctgaagccttaatccctatgtgactgtattggagatggagcctttagggaggtgattaaggttaaatggggtcacagagtggtggggccctaatataacaggacttcatgtgcttatacgaagagcaagtggcatcagaggtctctcttcccctttgcatacacaaagacagaaagccataagtaggcacaatgagaaagtactgttgaccagcggggaagagaggtggcctactggcaccttgatcttggacttctggtctccagaaatatgagaaaataaatttctgttatttaaaccattcagtctgtagtattgtgctatggcggcacaagctgaccaatacaaaaagtgttcaattttctcaactttctttcccttaattcccctgtgggctgggcatggagtcttgggaactgacaggagaaaggtaaaacatctcttggtaacaccttcatctaaaacgaatcacaggtctcaggaggaggcatgtgtcccaacattgcttcaaatcagcataccgggacaaagcaaagcttacaaagggatgtaccccattgtatgaaataagcctacagaataaaacagtatcttaaacacatccataatactaccactttcataaatgatgcaataagaaattcagaaaaattggcctgcataacaataacagcaaaagcagttaggccctgcatgccgagccttcttttcagtttgaactcttataaccataggtaataagatgttatgatgtccaaatgaatagtctaaacttttctttcccaaataggagtctctataaatttacattacacttggcaacatgctagaatcttaactgcattttggaaggccaaactctctagccgtcaatgcagagacaatattcaatgtcatattttattgacatccatcacacacacacaaacacacacgtaaattcttcatatttgaacttgttctttctttagtcacttttgcattgcaactgatgacttacacatcaagacatggtcatcttcaacaaaataactgatgatgtctgtatcacacaaccatccaattaagtgatacagccagcattcttgtgtcactcttacttggtggtcccctcctctccaattttccagtaagttcctgtggccattatatgggtttgctccttcttagctgccctcccctctctataagccatgacctcttatccttccaattctcctctcattctgtcactcttggggtcctagggccctcaggctctgaagtcacatgcttcaaattccagcatttccaaactgcaagtatgctgtgggaagctagagatttcattagttagacttgcactatagcagcccctacccacacatgactatctacattttaattaaaataacattaaaaagtcaactattcatatatttcaactgctccagagctagagatggccagtgggtacactattgaacagtgaaaagtggaagatctccatcactgcagaaagttctactgatagcccaagtctatgcccagtagtaaattctctgatgtaatcttccatctgcagctgaatccaggcaggagaggtcttgagatgtggtcagattaccaggataattggaaggcagaactggtgggcctcctgaaagattctatgtggatgtaagccacagtgagaggagaccaggtgagtccaagggcttggcctgagtgaccggccatcagccaagatgtcaagaatgtgggtggaacagacttggggcagggaaaggcaaccttgcctgcaaactttcaacctgaaatctacctatgactcttatgtgctgctgacatctgggcagctgagctctatggccagaaaccacactctgatgtcagtcagggaatgtaaagattgagagctatttatgacaaacccacagctaatatcacactgaatgggcaaaaactggaagcattccctttgaaaaccagtacaagacaaggatgccctctctcaccactcctattatagtgttggaagttctggcccgggcaatcaggcaggagaaagaaataacgggtattcaattaggaaaagaagaagtcaaattgtacctgtttccagatagcatgattgtatacttagaaaaccccatcgtctcagcccaaaatctccttaagctgataggcaacttcagcaaagtctcaggatacaaaatcactgtgcaaaaatcacaagcattcctatacaccaatagaagacagagagccagatgatgagtgaactcccattcacaattgcttcaaagagaataaaaaacctaggaatccaacttacaagggatgtgaaggacctcttcaaggagaactaaaaaccactgctcaacgaaataaaagaggacacaaacaaatgcaagaacattccatgctcatggataggaagaatcagtatcatgaaaatggtcatactgcccaaggtaatttatagattcaatgccctccccatcaagctaccaattactttcttcacagaattggaaaaaactactttaaagttcatatggaaccaaaaaagagcccacacagtcaagacaatcctcagcaaaaagaacaaagctggaggcatcacactacctgacttcaaactatattacaaggctacagtaaccaaaacagcatggtactggtaccaaaacagacgaatagaccaatggaacagaacagaggcctcagaaataacaccacacatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatagattaaagacttgaatgtaagacctaaaaccataaaaaccctagaagaaaacctaggcaataccattcaggacataggcatgggcaaagacttcatgactaaaacaccaaaagcaatgccaacaaaagccaaaacagacaaatgagatctaattaaaataaagagcttatgcatagcaaaagaaactatcatcagagtgaacaggcaacctacagactgggagaaaatttttgcaatctacccatctgacaaaggcctaatatccagaatctacaaagaactcaaacaaatttacaagaaaaaaacaacccatcaaaaagtgggcaaaggacacttcttacaggcacttttcatacaggacttttcatacaggcacttctcaaaagacaacatttatgcagccaacagacacatgaaaaaattctcatcgtcactggtcatcagagaaatgcaaatcaaaaccaaaatgagataccatctcatgccagttagaatggcgatcattaaaaagtcaggaaacaacagatgctggagaggatgtggagaaataagaatgcttttacactgttggtgggagtgtaaattagttcaaccattgtggaagacagtgtggcaattcctcaaggatctaggactagaaataccatttggccaagcaatcccattactggctatatacccaaaggattataaatcattctactataaagacacatgcacacgtatgtttactgtagcactatgcacaatagcaaagacttgaaaccaacccatatgtccatcaatgatagactggattaagaaaatgtggcacatatacaccatggaataccatgcagccgtaaaaaaggatgagttcatgtcctttgcagggacatggatgaagctggaaaccatcattctaagcaaactatcacaagaacagaaaagcaaacactgcatgttctcactcacaggtgggaggtgaacaatgagaacacatggacacagggctgggaacatcaacacactggggcctgtcagggggcgtggggctgggggagagatagcattaggagaaatacctaatgtaaatgtcgagttgatgggtgtagcaaaccaacatggcacatgtatacttacataacaaacctgcacgttgtacacatgtaccctagaacttaaagtataataaaaaataaattgtcttatatattatatattcatgtatattatatatataatatatattcatatattatagtatacatgtatatattacatagtatatatgtatatatagtagtattcatatatatatatataatggaatactactcagccataaaaaggaatgaaataatgttatttgcagtgacctggatggaattggagccaattattctaagtgaagtaactcaggaatggaaaaccaaacatcatatgttctcactcataagtgggagctaagctatgaggacacaaaggcataataataatacaatggactttggggactcggggggaaagggtgggagggggtgagggataaaagactacacattgggtacagtgtatactgcttgggtgatgggtgcaccaagatttcagaaatcaccactaaagaacttacttatgtaaccaaccaccacctgttaccccaaaacttatggaggaaaaaaatatattgatgacttctaaacattgcttgtcaaatcttgtttcccgtcctgttccttctcttcaggaaggtccctttttatcttttagtttagagtagctagaaacatttataactcttctctcactttcttcttttaccttcagcaacagacttcaactccagagactctgatgttaactaccttgacttcctgccccctcacaccaaacaaacaagagaaccctgttacagccacacttagccttctttccttctctcatgtagatcaaagaaatgtcttccatttctttcagagaatacccccctccctgttcttgatcctatgttctaaaaaacaaatgttggcaaaatagaattacttttggctttacttccatcatcaggcattactttcataatctgccattaccttatacccaagtgaataatgaaatatggcattagaacatcccaggtattgttatttaaatatatatgtaaatatgagctactgaatgttttaaaaatttacatattttaaaatattttattttgaaaatcttccactgaataggtgacattttaaagactcctactacgtataattgaagaataagcataaacatctttttatgcatattagggtacacagaatgtgtggattagtacaaattagcaacacaaagaacagtattgagcacctcatttgtgtaatcactctcatcaccaaaactgcaattctctatttgtaactagcatatcgctaccaaaagaaataggcatcatgtcattctcactcagaagtgctctgcacacataaacatatattcatcctcacttctcactttacaaagagaaatctaaagttatcgcttatcataatataaacaatatagtaatagttgtcaaaactataaacaattagggcagaaactcaatctgtcttggtctatgttcaatttcccacagctaactcagtatgtaatatatagaagctagttaataaatatttgttgagctaatatatgaacgattagagtaaaatcaataataattgcttatgagagcatgtaacaaaaatataatgggctttgcattaggagcatttctctatgtggcatttgaaatgatactcctttatttcaactcaagatagctgcttttcagtaaaagcagaaataggattcagaatcctaggactagtttaagactttcgcttccgtcaactacctgagaatgatgtacactttgggtaagtggcttccaaggtagaatcgtcgatcaagtaggcttccagaacctgatacttgcaaccaacagcttgcaaatatagaatctggcaaaacatatagagaagatcatgcaaggatgggaagcagcacctttgagccatagtcagaacatgcaaccacaagggcatcagcagacaaaggcaggaggcagaggaatttcagttccacctgagaagttgggggtgtggcattaggtcttattcatggaggcggctacacaggtcatttgctgctgtagtggaagatgtgatggctggagggtggagagctggtgggatctcagtgtggagctcatgtgtcaaacacaaggggattaccgttctacctctgcgttcagacaggcaggagcagtgggagggtcaacatagcttggtgggtcaggaaacccattctgtatccttgcatgagctattcatcattgagaagaatgggatcatcctgaatatcaccacagacttaatttccacctgagttattattcttagtgacatattatgtgtgaaggtaaaaaggaaggttctgtgatgacttctacaaagcaagatggaacggtgctcctcatacaggggagacgcctaagcagccaggctctagcaaactgcggtcagtgaggatgggagcaggtcttcctttggctacgttccgaatgtctcaccgtctgtttctaaagcatgatctcagccaattttatctaatcttaacaagcattacactaacaacttatctgtcttaaaaatattattgaaaaggtagtgcttttaaaaacaaaccagtggttaagggtgaatcaattgctgctgctcctgagctctgccccaggcaagcttgtgacttgagagccagagccaacaccacaggtgaagcaaggaagatgcgcgacggccaagcaacaggttaggctctcagggcagaactgacagatctctcaacagcaatcagggtcccctcagacctgaggactgagaagaaagctaaaaaagtgtaggagatggagtgattgacagtgtaatggcacagggttagagcagagaggaaaggatcagaataaatgtatatagggagacatgaggagcaggaaagagcagcaagtgggctgagatgcagggagcactggcgtgagcctcgaaacactgccagagaagaaaagtggggtcagcagacatgctgttggtagatccttgaagaggagtgtgtgtgtgtgtgtttgtgtgtgtgcgtgtgtgtgtgtgtgcacgtgtgtgtgtgtgtatttctattttattattttattattattatttttttgagacagagtctcactttgttgcccaggctggagtgcagtgccacaatctcggcccactgcaactaccacctcccaggctctggtgatccttccacctcagcctgggactacaggcatgtgccaccgcgtccagctaatttttgtgcttttagtagacatggggtttcaccatgttgcccaggtgggtctcgaactcctgagctcaggcgatccacccacctcggccaaagtactgggattacaggcatgagccaccatgcccagctaaggattttaagaaattggatgatgaccttgaatttgttaatgatcttgaacttgaacctggtaatttcaggaaataacctatatataacgtactatattatcattgttttttaaaccaaataaacattgtatttatggatttgcattttcttggaattctgtgtcatatcccaataatggaagtgtggcacatacattgttggcaatgttgtcacccctcacacatgttggctccaccaaggcattctcaggagtcttctttagatgcgcccttcgtgggatactatattattatatcaacaaacgaagtgagccactctctacaactgcatgtggaatcctggggagaggctagtacaatgaggctgaaggccactggcatacgtatatgagtttccaaggggtccacactttctatttcctctcattgaacactatccagacctctctttggcaaagccatgcacacccaagattggatgtgcaagtaatgattcagatgtctacctctagctgagacctcacagttgatgtccatactatacatttgtaataagccacaatctactgcaaatggctccatcagatcctcagaaacacaccaaattcagcatgagtccaagtctcctgcctggacacacaaaaccctcctaacctgcctctcatgcctgcaatattacctccttcaatcaagtccatgcattattcattaaaagagtcaatcttccttaccaaccatctgatcacataatgctttttccctaaatttatttgagtggatctcagcatctaaacagaggtttccaaactttctttgacagaaaatgtgttttaactcatggcccaattacacataatcatgtattttaacagaaacaagacttcatgaaaaaggaagctttataacatgtgatgcactatattttatattttattccattttatttaaaatgctagtgtcacccactaaattaatggatacaaaacagttcagaaaccactgacacagaggatagagttcgatctgctttgcatgatgtatgaggctgttcttgccctggcccacacatctccactcttaaggctgttgcctctcctctcacaccttacactacacacaccaagcctcttgccactcccaatacatcttaataaactgtgttgtgaacacgcagagttctcttcctgcgtgtgccaattcagtttaccacaattgaatttatcatcttccctttaccatcaccaagacttttgttggctgccaaactccctttctcttttcactttcatagtcctaatggatgcatttcttcctctctgaagccttttggacaactccaggcaccatgaatcacttcacgtcctctttactgttacctttacagcttgaactttcctcagatattacatgatcactaagaactgtgatgatcttatctcttctgggattaaaaaaaacttttaatgtttttgaaatcgggatggttcttcatgtgactatggcccctttttcctttaagccattcgggataaattttctgtcatttgcaattaaaagtgttactaaatcaatgatatactcaatatcttagatctatggaaataccatatattttacattttacattttacatcccctaattagttcatgaattctttgagcacagaaattgggtcttattcatatttataacctcagtgcctagaataatgcctagtaaagagctggcatcattaaatgcttattgaataagtcaaaatgaaagaacatttataatttattgtcagccccattttaaaatgtcaaggaattttacacgtacaacactggcacataaatgtcctataactcttcccaggtttacaaacataaatattcaatatgttaaattaaatctattaagtatatagctataaaaatagaaatattcaaattaatgactttggttgatacatgatattaaagtagtcaaaccatatatatttctaccaatcacacctatgtctacatttataatggaaatatgtctagataaaattaataatcataataagttctagggttcatctctactacaaattagatagtgacacatttcttgcatcaacaaccatcctagttcccccagacaacacaaatatatttcaacagctgattgatgggtttaccaagctacagggacacttatccttatgccagaaaaataaagtctgggattctaaaattacagacccatcaaactaacagtagattgagccgaaattgaaataggcacagtactttaaaatttgactcttccagaataaaagaggaagttctaacatatttcataaaaatgaagttcagtgttgaattgactattcttttggctgaaacttcaaagaagcatgcttaccacagcccctaatacagtgttcaccacacacagtgactgtccagaatacactgtcactgccaaatgtctcaggttctggagttcctctcacacagctcctgtagacttcgaatccatctcatacattgcatctgtgcaagacactgaataaaagcatctaagcttataagtgaaatacaatctgtcttcctaaatattctccctagtaatatcctaaacaaatacacagttttccagcttagattccctatttaatcatagatttacatcataaaatctggcaaaaaaacaaaacaaaacaaaaaacgtgcttaagccagtcacaacaattttaccactgtgaattgccaactttgactgtcacaatctattaaacagaaagtccccaaatgccagccacacagtggttcgcaacatgttcttacttcacagtacttgaaagtgtccactcaaattatggcaatttacccttcatattgattgcaaatatgtatctgccacttcacaatttctcaagataccgaagctcaatgacacatctagtttttccagaattgctatcaatgggcagtcaagcacaaaaaatctcactctgcaaacagatatctgcactcagcccatatgtttaacctatcacaacagagactgtatcaatcagtgttttaaaattaactataaaaccgagtttcaactactcttatacaactttagtcactaccattgacttagcagttttttaaataaattgctgaccttaagaaaacaaagactgaatagagccataataattttatagctgccaagatacattgacattttttacccgcatataacaaattttgaaattttaagtgatataacctgcctattacaacacatgactttaaaagtaagctgtgcttaggagttaaatctaaattatatatatttaaaaggtattactgtaattgtaaatgttacatagcaaagaaactcattttttgtatataatcattcaatattacacttcagggcttcaaataccctggtatgtgatcaacaactaattttaaatggacaaataattagatattatgaaaaggggtgattatcaattcccagccttacttttttgccaatttgttttctgttttcttttaatttacaatttgtacaaatcattaccctgtcaagcaaaatttatagcatttctttaccgccaaattcccattttctccaaataagactctcagatattgttccctttttaaattacctcctaatgaaaatattttccctctcacctgcatttatatcttatctgcttattatttgttactatctctgttgggttgagtttgggagtatgtgataattttcaattatgtccacaggttctttcatactcctctcttcacgaagtagagcttacttcacctccccttgagagtgggctagacttagtgaccctttacacaaataatatggtagatgtgatggtatatgatcctgagacaagttatgaaagacactcagacttccctattgatctctctttgatcattcactctggggaagtcagcttccaggtagacaggatgctcaagcagccctatggagaaagaggtccacgtaaggaaaaactaaagcctcctaccaacaactggcaaaggactgatacctacaaccaatgggccatatgagtaagacatttagacagcagatcttccagtcccaggcctgcttcagatgatatagacctagctcccatcttgactgaaacattagaggaaactttgactcagaaatacccagctaagtggctcctagattcttgactcacagaatccatgagataaatattagttgtgttaaggtcctaaattctagggcaatgtgttatgcagcaacagataactaatattgagcgtagtgacaatcttcaggtgtttttgagggtcattacctaatgctgaggtttcagtgatttcattatagtctttttttgacaccagcacatggaaggagtcagaaaatatgccaggccagagattctgctccatccccaaattgtattctgcatagtccctcagagtttatgacttatcacagactcctcaggagccatctccaagaaaggttcaaagttaggaagaaatcaaggaaaataatgtatgaatgacttagcatgagagtaatcatgatttcacagtacattctgtctgtttaaagatttctaaagatgttcaaggattttacttagtatatatacacatttaaaaagcatttcataattattgctgaagtttaggttgatatttttggacacggatatcttctccatggtttacataaaataagtataaaataatagtcttacatatgaatgataatgaggatatacaatgtttttgtcatcagatgatctaatcttattcatttactataccttatttaaaaaaatagacccttgtatatttaggtttcaagtatttctcttaatgagtgcatatcataatctataattatatagctatgattagtgctaagtttccaatgactaattttctggcagggtttttgcaggatcctctgggcaagtgctcacactgaagccagtattctggcacttgactttcttcctattcttcaactagtacctttctggtcttggtatgaaccaactgcataatctcccaactcaaggtggagtgagttaattttaccttgatagatactagcgctgctgactgactttccatttttcttcttcatctaggacagcattcacctaaaatcagtcttgctgttatgacttgttttggttaaggaattataattgagtacaagcatttaagatcccctgtatgattcctcattctctgtttcttcctactttgaaaaaccctgtgtgttgtattagggtggcagaggcataagagattgaagagtaactatgtggaagaggaggtttcatctacccacagaggatatgttgcttgagtgattaactagactgcttggattaagccagtgtgattttggtattgtttgttactttggcatgcccagcccatcctgactaatacactgtccagagtgcatgacgggggatacctacaaaagtttctgagttaaaagaacatgatagtctaaatttctcttgaaaaacaaattttgttttgcccccaaagggttcagctttaattacagtcctactggaaaaatatttctctggatcttagtttcctcattggtataggtaacattggtatagctctatattgtaggtttgcgtcaagattcaaaaacagtaatttttattatattttaaaaattacaaagcttgtgactagacattagctagtctagactagactagacattaatacaaaatggattttaattcctaaattatctttgttaatatattttaaattatcttatacaccaagatgtaatcaataataattgataaatgaactatgactatgaatactcatacaacattgtgatatatggtttaagcaatgcactttttaaaaccaaatgtatttcttaacttcttggtatgataaaattaagatttcatagacactcacctgtccggggtaaaatttagtagacttttttatatcaggaaattaaagaaacactccactaaagtgtaaacctgaaatttctacttagggaaaccattaaataatttaaaagagatttatcagtgaattttgttgatgtgctcacaatttaatcaatattaatcatcttttccaccattcattctgaaatttctcaagtgtaaagcagaagaaaagacagcttgtttccaacttttatttcaggttcaggggtacatatgcaggtttgtaatataggtaaattgagtgtcatgggggtctggtgtacagattatttcatcacccaggtaagaagcatagtagacaataggtagttgtttgatcatctcccttctcccaccctacaccctcaaataggtcccagtgtctgttgttcccttctttgtgtccacatgtactcaatatttaccttccacttataagtgagaacatgagggttggttttctgttcctgctttagttcacttaggataatcgcctccagctccattcatgttgcttcaatgaacgtgatcttgtgctttttaatggctgcatagtatgccacagtgtatatctgccacactttctttaaccagtctactgctaatggccatttaggttgattccacgtttttgctattgtgaacagtgttgtgatgaatatggtgtaatgatttacattcctttgggaatatacccaataatgggattgctgggttgaatgacacttctgctttaacttctttgggaaatcgccacactgcttactacaatggctgaactaattttcatcccaacaagcagtgtataacattcctttttctccacagcctcaccagcatctgttactatttgacttcttaataacagccattcagacaggtgtgagatagtgtctctctgtggttttgatttgcattgttctaatgattcatgatgttaagtactttttcataaattgttggctgtgcacagtcttcttttgaaaagtgtctgttcatgtctttgggccacattttaatggggttgttttttgcttgctactttaagttccttacagattctctacattagacctttgtcagatgcataagttacaaatatcttctcccattctgtacgccgtctgtttactctattttattttgctgtgcagaaactctttagtttaattaggtggtcccctttatcaatttttgtttttgttgcaattgcttttggtgtctccatcatgaaatctttaccagagcctatgactggaatacaatttcctaggttatcatcagggtttttatagtcttaggttttccatttgtcttgagttgatttatgtaaggaagggatccagtttcaatcttctgtatatggctggccaatttatcctagcagcatttattgaataggaagtctttttcttattgctcattgtcagttatgtccattagatggttgcaggtatctggctttatttctgggctctctattctgttccactggtctatgtgtctgttctttttttttttttctttttccactaacatgctgttttcattagtgtaggcttatagtatagtttaaagtcaggtagtgcgatgcctccagctttgttctttttgcttaggatttcttgggctattggggctttttttcgttctatatgctttatacaataggtatttctatttctgtgcagaatgtcattggtggtttggaatagcattcaatctataagttgctttgggcagtatggccattttaacagtattcttcctatctatgagcatgaaatgttcttccattttatcagtcatctcagatgtctttcagcagtattttgtaattctcattgtagagatctttcacctccctggttagctgcattcctaggtattttgcactatttgtggctattgtgaatggggttggtttcttcatttgaccctcagcttggacactgttgatgtatacaaatgctactgatttttgtgcactaattttacattctgaaactttgctaaagttgtttgtaagatctacgagctctggggcagagactatggggttttctaggtatagaatcatattgtctgcaagcagagaaagcctgacttcctctcttcctatttggatgccttttatttctccttcctgattgctctggctaggacttccagaactgtgttgaatggaagtggtgacagtggtcatccttgtcttgttccagttctcaaggggaatgcttccagcttttacctgttcactatgatatggctgtgggtatgttatagatggctcttattattttgaggtatgttcctacagtgcttagtttgctgaaggttcataacatgaaggaatatttaattttattaaaagcctttctgtatttattgagataattaggtttcatgtttttagttctatttatgtgatgaatcacatttattgatttgcaaatgttgaaacaaacctgcatccaggaataaagcctacctcatcatggtggaataccttgttcgtgtgctgctggatttggttcgtttgaaatttgttgatgactttttacatcaatgttcatcaaggatattggcccaaagttttctttttttgttgtgtctctaccaggttttgctatcaggatgatgctgtcctcatagaataagttagggaggagtctgtcctcctcaattttttggaatagtttcagtaggattggtaccagctcttcttatacacctgatagaactcagatgtgaatccatctggtactcagctttttctggttcgcagtgtttttattactgattcaattttggaactcattatcagtctgttcaggattgcaatttcttccttttctcaccttgggagactgtatgtttccaggaatttatcaatttcttctaggctttctagtgcatagaggtgtgcatagaggtgtttgtagtagtctcggagggatttttgtatttcttgggggtcagtggtaatgtcctctttgttatttccaattgtgtttattgggttcctctctcttttattattaatctagctagtggtatatcaatcttatttattctttcaaataactacctccaagatttgttgatcctttgtgtaacatttttttctcagtttcattcatttcaggtctgattttggttatgtcttatcttctgctacctttggggttgatttgctcttgattttctagtttctctaggtgtgatgttaggttgtgaatttgagatctttctaacttttttttatgtgggcatatagtgttataaatgtttctcttaacaatgttttaggtaggtcccagaaattctgatatgttttatctttgttctcatcactttcaaggaatttccttattattctgttgtggttttttgggggagggggcggggaggtggagagttctgtagatgtttgttagatctattcggtcaagtgtggagttgaggtcccaaataacttcattattttcttctctgatgatctaatattgtcagtggggtgttgacatcttcctctattattgtgtggttatctacatctctttgtaagtctctaagaacttgttttatgaatctgggtgctcctgtcttgggtgcatatacatacaggatagctatgttttcttgttgagttgatccttttaccaatatgtgatgccctttttgtctgttttgattgttgttggtttaaagtctgttttgtctgaaattagaatagcagcccctgcttttttctgtttatatagtggatttttttccatccctttactgtgagcctgtgggtttcattccatgtggggtaagtatcttaaagacagtaaatcttgcttctttatacaatttgccactttgtgccctttaattggggcatttaggccatttacattcaatgttactattgatatgtacagatttgatcatattatcttgttattagctggttattatgtagacttgattgtgtggttgctgtatagtgtcactgatttatgtagttgtgtgtctttttgtggtggctagttgaacattctttcctttccataattagcactcccttcaggacctcttgtaaaacaggtctggtggtaacaaattccctcagcatctgcttgtctgaaaaggatctcatttcttcctcatctacgaagtttagtttgactggatatgaaattctccgttgcaatttattttctttcataatgcttaatataggcccccaatctcttctggcttgtagagtttctgctgaaaagtccaccagtagccagatgaggttccctttgtggatgacctgtaacttctctctagatgcttttaatatttttttctttcacttcaatcctagagaatctgatgactatgtgtcttgtcgatggtcatcttgtaataccttgcaggcattttctgcatttcctgaatttgaatgttggcctctctagcaaggctaggaaagttttcagggaagatatcctcaaatatgttttccaagttgcttgcttactctcccactctttcagggacaccgatgagtcatacatttggtctctttacataatcccatatttctaggagtttttgttcattcttcttttttttttttgtctgatcattttattttgcagaactggtctttgagctctgagattctttcctcagcttggtttattctgctgttaatacttgcaattatattatgaaattcttgaagtgagcttttcagctctaccaggtcagtttggttctttcttaaaatggctatttcatctttcagcttctgtatcattttattttattccttatagttcttggattgagtttcaactttctcctgaatcttcatgatcttttttcctaccctatgttcctgttctgaattttatgtctgtcacttcaatcattttagcctggtgaagaaccattgctgaagaactagtgtggtcatgtggaggtagaagccactctggctttctgagttatccgagttcttgttgtggtctttctcatctgagtaagctagtgttccttcaaaaagactgctttttaatgctaacattatgcaaaaactttgtgcctagatttaacataaaattcggaaaagaaaaccaaaataattttaaacagttataaagcctaggctgcaagcactacaaaattattaacaagtggctgattcaagaatatagaaaatttttttaaatattataacttctatctgatctgagtaaaaaaaatacagtactcaaaaactgaacactggataaacagttgtttagttgttatgtgaaaagtcaataatcacctctaagtattttaaaaatacatttaaactgataaaggaaatgtaactccaatataaaattcatagtgccattataaaatgttgcttaacacattgaaaaattacacagtatctggctttcaaatattcaaacaacttaaaacaataaaaacaacatattgacaaatttctcagcagtcatattttatgggtattctgctagttttcccctatccatttacatatatatgtaaaggtacacacatatacataaatacatccacatccacacaaatcgatatacacacacatacatacacacacacacacacacacacacacttaacagaaatgtgatgatgctatatatattgtctgtaacttttttttccaatcagtatgttttggagaccatttcagaccattacttatgaatttatcatgtttaaatctgtcgacagctatcccattgtattgatgtaacatttttagttctctcctctacaaatgttgttttcattgcattgcttttagttgttatgtgaaaagtcaataatcacttctaagtattttaagaatacatttaaactggtaagttaaaggaaatgtgactccaatataaaaattcatagtaccattataaaaagttgcttaacaccctgaaaaattacacaatatctggttttcaaatattcaaacaacttaaaacaataaaaacaacatatagacaaatttctgagcagtcatattttatgggtattctgctagttttcccctatcaatttacatatatatgtaaaggtacacacatatacatacatacatgcacatacacacaaatcgatatacacacatatacacacacacacacataacaaaaatgtgatgatgctatatatattgttctgtaactttttttccaatcaggatgtcttcgagaccatttcagaccattatgaatttatcatgttgtttaaatctgtacgcagctatcccactgtattgatgtatcatttttagttctctcctctacaaatacttttttcatttctttttttattttgctcataaatatatgttgaaatcaggatcactttataagggtgtatgtgtgtatgtgtgagtattattttagaataaattcctagaaatgaatttgctgtgtctaagaatacaaacatcttaagctgtgacagatgcagccatcttgttcccaacgcatttccaatggagacttcgccaacaacataaaggaatgccaaattacatgccctttggcaaacagagatatgagtcgtcatttaaatttttaataatctgacagttaaaatgtaatgtataattgttttcttttgtgtaaaatgacattttaaactgtagagtccgttagacaaaaagctgattccattaacagaaaaacatgagtcatctttctatgacttgtcaaagtagtgttgttgtatttctcttatagcactttacccactttactgcaattacagataaaaatcttctgacccttacatccaatgtaaaaagtcattacttttaacttcatttcacaaatggagaaagatgagactcaggaaaaataaacagcatgtacagtctcagaagtgtagtcaggggcagtcaaagattttaaactaaatttctgacatcttgtcatgtattattttgattagaccccagaatagtcaatgtttggatgtaatagttcttttgcatatacatcctattacaaaacaatacacattagtttcaaggaagttgtttttataattttagataaatccttcagctttgtcacttagacggtaattacttctgaaatcctgaagatgccatctttctaattccctatgataccaatatctatttaaaatttgtatttttaattgatacataattgtatacattcatgagggagtatgatatgatgttttgatatatatttatggtgtggaataattaaatcaggatagctaacacatttataaccataaatttttgtttgattaaaaaaaatttcacttctactgttttaccaatattaaaatatgcaatgcagttattttagtcactattctgtataattgatcaggaaagctcattcgtcctgtctaatggaaactttgcacctcttgaccaacatttcccctttccccatccactcaggccttagcatctggtaaccatcatatagtacctttttaatgtgttgtgaagtcagttatcttccaagagaccatgcttattcaaaactccaaagacaaatttcagaaaagctgtaatttctctgtgtttacaattactttatgtaaccatatcatatagtaaatcttagatatgagtaaacaggtttaaattatcatattcccagtctaaaaataatatttaacatttcaaaattcatttgtagtattctctactgtatttttaaaagtaatttccctgaccaattaaattattctatgtttaggagaactcccctcatggcagtagacttcacacattttattttctttgttctttcttttcagtacatttagaatgtttcacatcatcaacagttaccactctctaatacataaattattcctgaataaaatgtcaaatattttaatatttagttgttagaaaatcagtcaattataagtgctcaaaaatattaaacaaatttaaaataaaacaagaataacctgtggaaaaataaactttgactttatgtaaaaaaacaaaatttctgtaaattaggtaggaagcacttgcttctttacatagaaatattttagcatgattggtctttttggagggagaggtccaagcatgaacctgattataatctacctttttatgtcactgtttttttaacaaactttcctctccaaaagataattgggagatgaaattttaatcaattagggatattatattttacaaagagcaaaaattgttttatgtttaactgtctattatgaaaaccttaataacctgcaggagctattaaaagcatactagcaaatgcttaaaatcagaatttgctttttataaacatgtccaaggatcttaaggaaaatgatacataaatataaatcaatatgatgtttctttttaaaatctcaattatgcaaacatggtagttatacagatttttgttagacaaagcacaaatattcaactacaaaagttttttctatatttattttacaatcaggtttcttatcaattaatttctctgtcttagatcaaaaagcaataaaaatgcatatcagtgtcatactgatctcagcatgtatgctaaagattatctatacatggattgttatacatatgaggtaataacattctaagttaaagagaaatttttacagtgtaataataacactaattgtgtacgtactatggaccaggcattattctaagctcctccagtactgactcaactaatacagcaatgctatgcagtacttctattattatcctcttttctagatgatggaactgagatacaggaggttaacctccccaaggtggcaaagggaagggctactgtttgaactcacatggcctatggttcagtcactacactgtgctgttaatctactggatgcctctaaatactgataccaatttggtaaattattcattaattaaaaaatcattcatggaccacatactttgccaggtccagtacttggcattgagtactggatgcaaaaaaaaaaaaaaaaaaaaatcctatttatccctccttcctactttggagaagccataggtaaaataattaatatagcaattggatctaaagcatacattttggttatgaagaaggaaggtttctaagtaggaaagtcttcagagggcttgctttggtgttccagtgcctaccacaatggccacgtattctagaagctcttgggaatgactccattccacaatccttgttacccagcccctcattgcacctgtggtcatctatctactccacaggagcctgggacccttctgcctcctctggttaaggggcctattaccaggagctagttgtgttgcttctaaacccattcatttcaattttatctaataattatattatgtgattaaacatatgtaagacaatgagacataactgcatcaagaatagtttttgttattttatgaatacttgttgaaattcctttaagataagccactgaaaaatgccgtggtattatagataaggtaattgtaaaaggcaaaggaaaaattataaacatctagaaggattcttctttaaaatacttcaaaagtttcttagattcctcctagaggaaggaaggaagagtagggagtggagcagtaagaatgctcattccatgttattacgagcagactcatatttaaataactgacctaggtcctatacagttagtgaacacatgtacaattaagttaaaaataaaacgaatacagcatttatgtagtttttttttaatgattctctattttaaatgactcctcttaactcaatctcttgattgaaagagtttttaccaaccatggtctcaacacttattggttgaatgaatgaacgaatgaacagtaagtgaattgatcacgtttaacctattctgcctgttatgtgattgtttagttggtcttttcattgtatgagtatttgttttgcctggaatcatttacttgctggatcaattagtcatttattaacttaattaagaaacaagtggctactggtacttgatgatgtcaataattccaccaaagacgataccgagtgttgaagggctcttttgtttcgcctggaatctgcctctgctcccttgtaactgtgtctgcacacggcacccgcatgaggcaatgcactcggatagaccaatttcatgaaactgtaattactctgagaacgatgctaaatttaaattgtacaagtgactgaatttcaatttagaataacaaatctacacatcatcttattggaaaatcattatctaatttctgtgtaccacacatataatttgcacaattgagaaaaaaagtctctcaatttgctatcttaaaaagtgaaacagctttgtgaactttgaacagaggattaaagttccattgatattctgaacaaagtgaagtgaactaaataggaaaaataatgttaatcagaaattaatttgtagattttatattcaagatggtacaatatctagtaacaatctaatcgctttttcaccaaggaaaaagtaaataataaagtattggatttgaatttattgtatttaaatttgtatcataatatttcaataaactcaagttattagagttgctacctactgatttagaacaaacaactctagtgcagaggatgaagcttgtgtgaatacaggaaactctgttttggctgtaaaagactccatcaggttttcaagtagcataggatctaacactaattatttctggtatactgtgcactattttatacaaaaaatgtgtagcttatattggtaaccaagaaaacttcctatttaaaaatctaagttgatcaccatagttaacgcaatgggcaaatttggaaaactagattctaccataattagaaaaaaatgtggaaattgaaaaatgaaaggaccaggtcacatatatatagattaagtgacattagtcaaataagagaaaaaattgtgttatccacaggcataggcgacttctatcatatttagtttctattatctagaaaattaaatgcacctttaaatacaaaaatatgcttactgatataactggatgaaatctcaatttcacgttgtcaattctagagtcccctacaaaaatggcatccattctatacatttcctctttgcacacagcaaaaactacagatgcacatgagtaacccttgtgcagcacaagggagagtaaggactcgttgcccagacatcttataaatgggagggtaatgaggcataaagaaattaagtaacattttcaaggtcataccctgagtctttaatagagcagagaatagaaacgtaagttttggttattagatctatactgtaatgtctagagcatgcttccaatcttgcaaatcttgcacaacaaaccaaaatgaagtacctggcacaaaatagacctcatatgtgcatatgaaacacttgcttatccaggaaactaaatgatccaaaaaagaattattttgaaaagtaaattaaagacaaaataaagctccattacaatttccaaatgaaagcttgctttaagatggatgatagcaatcaagcaaatttctcctttgcttgcttttatgcatgacatattttgtaatgaccttctgagtttaacccaggccttcacgaataataagtttatcgtcctggagttgcctggagcagctctgtacagcaatacatcttccacatggactggtcaaaccccagtactgccttctgtctagttattttctcctgttcatatatggatttggatctgaaaccacacatttgagttcacaaaagaatgataattcaccaactgaattttgcctgggcaactgttcttaatctaaaatacagaactcctttccacttgctgttagtaaatattactgtttggctctgtgtccccatgcaaatctcatgttgaattgtaatctccagtgttggggtggatctgagtaggaggtgaatgggtcataggggcagatttcccccttgctgttctcatgacagtgagttctcatgagacctggttgtttaaaaatgtgtagcacttcctccttcactctctctctcctgctggccatgtgaagatggtacatgcttccccttcaccttccatcatgagtgtatgtttcctgaggcctctccagccatgattcctgtatactttgcagaaccatgagctaattaatcctcttttctttataaattacccagtctcaggtagttctttatagcagtgtgagaaagaactaatacagtaaaggcttacataaggcaatgaaaatgggagaaacacactctttactcagccattgtgctttctgcccaactacccaagcccaagtaaccctatgacagtaagtcaatggactaaaaactcctgtaggtcatttcattgtatgatcatgacccattctgcacaggttatttggcttattaatgttccacctgcctgtgcttcaattgaccagagaaactcttgtagaagaaacactgacttagctttaattgtcctccaaatttgatccaatgagcattacaagagcttccaaagtaagtaatagagaattcagaggaaatggcttccctgaatgctactttaaacatttcatattagcaaattcactgacacaatttcagatattctcattgaatggagaaacatctttacaaggcacttttagcgtcaaaaatggatgatatgagcttcaatgagtacagtggaaattagttgttttggttgatcagtagctggtttccctgtttttgttcattgcatcttgatcttccttgacagacttactcatcctgacattgcatgaaattttatggactcccaatcaagggtccacaactctgcagtcagagttggcccccaaggatatccaaattccaatccttggaacttgtgaatatattatgttaaatggcaatgaaaattagggcacatgaaagttaggtttctaactagctggctgtgagatgtggagattatgctggattatctggttgagcccagtgtaatcacagggtccttataaatggaagagggaggcaggaaagtcagagtcaggaaggagatgtgacaaaggaagaaggaatgatgtaattgctggcattgaagatggaagggtccacgagccaaggaatgcaggcagcctctagaagtcagagaaggcagggaaatgggttcttctctagaggcttcagaagcagtgcagacctaccaacaccttgatattggccaagtgaggcctatttcagactcctggcctccagaagtagaaagtaacaaatttatattgttttaagtcaccacatttgtgacaatctgttacagcagccgcaatttcctggcccattgtgggcatgtctctgagtgggctcctcttgggatcaaaaagcaaaaaaaaagatagaaaacagttgaacttgattctgctggtgaggccaccccaaagccactgtctactagtccctgatgctcatatccctggagtcttcctgggtcctgcctttcctaactcctggcttttggacatttccctttcttttatgggcatgtcatatggttccaacatgtgacttttcctttccccctggaagcaaatcagtggtttcttcaacttgtaaccaaagatcgtaactgatacagttcagtcagctctttaacctggttctagcaatgccattagttgactgtgctattaaacataccttttctgtgggccagctactgtgctcagcactgaggatcaaataataaacaacaaaaccagtttctactacaaagtgttactgagtagccaatactgcagacccaatgcacatgaatcaaagtcaaacttacatgtatgaaaaaaaaagtgtccagataaaaaataaagaatattatctaactcagactgcaaatttatcaagttccattggccatggggcaacatgaatatggtaaaatccatcctcaataagtgagtcattaatcctgccccccccaccctcccttcctttcttcctcatagagaaaatgtttatgagcctctatttgatgcattgagcatagagaataccagaccaatttaatgcagacaagcaaagtcagaggatcttgcagttctgtggttctaggctaagggcagatgaattaagagagagtctctataatgaaacaaatgttaaaatggttagactgggatggtaaggtcaggatcatgcctggggaacacactgctgggccaaatgcccagggacgagcagaagccgctcagggggaaggtggagaaggggcagtcccaaccactgggaggtgtgacctgggcagaggcagtcatacacacagcaaggttccaggctgccaggtggatcagagaaggggagcaaagaccagaagaaaagaaccttagatgatgagactggaaagaaaaggaaagccaggccagacaaggtctgtgtccactcttctgcattcacactccttagattatctaaaaactgacaatgaagtaaaatattttgtatgtgaggtatggacttcaagatcagatttgaatattttggaaatattaaaaatatagcttgaaaatggcgtcgaactctcggcagagctattataaggctcttggggtcgtctgtgtatgcaacaagctcaaatgagatgtagaggaggggataaattggagatgcaaggaattcacctccacaggccttttgatagacataggttttccaaaatgactcaacacagcttattgttagaaaacaaatcaaataatttgttaataataatgtattaaaatttcaattaaaataattttaaattgtaaaatgctatatgttcattacatcagaatagatctgttatacactgtggattctgtattatttcttaataactagagtcagtatagagatagaaagcaaaagcttgggttttctaaaatacatgccatgaaactagcactgtaatgttcaattttgggaaatctcatgacatatataaccaggccttttaactatttaccttctgtaataagggctcatgttagacatgatttttatgtttccattgtttgcaccaaataattaaatcacattccaggaatcatttatttacatatacttgcattgtcaacatccacttggctgactgagggaatgtgcaccccatagggagaagtaaaacattccatagggataataatgcaagttacaatggtattagtgttggtggctcagagccgcttgatgttcaaatgggtggtgatatggtttggctgtgtccccacccaaatctcatcttgaatttccatgtgttgtgggaaggacccagtgggaggtaactgaatcatgagggcaggtctttcccgtgctgttctcttgaatgaataagtctcacaagatctgatggttttaaaaagagttttcctgcacaagctgtctctctctttttgcctgttgtcatccaagtaagacatgacttgctcttccttgccttctgccgtgattgtgaggcttccccggccacatagaactgtaagtccactaaacctctttcttttgtaaattgcccagtctcagctttgtctttatcagcagcgtgaaaactaactaatataggtggcttggggcacttaactgaccctcaatttagaccagggtggtgctgggagtctcatcgaagtcatggagggaaggctttcagtcctgtctcacataataataataacacgctgtgaattctatttcttatctcctctcctccctcctgacatatggtaacataaaatttcaaacctaccttgaatttcagggcaatatttctaagtcagaaatgttcacggtaataaacacctcaggaaaagagaaccaggaaactgattgatctctgtaccatacagctatggccaggagtgtggcatctccttgcatgccagagctcaccctgagacccaccccaccccactgcacaacactccatccatctacattgtcatctgggtcttcgtgactccatgtagttagtacaccagcagcattagctatcatctgggagctcattaaaaataaaaaatctcacctttccctggacctaatgaatcagcattgtaacaagatgctaagcacatgtgaggggcacagatatagatgaatagcatctcctagaattgagtaatgtgcaacctatgcagctgtgtatggtagctccaatcccatcagtgcttcaatagtgttttgatggcaggaaaaccattggctacacaatgcccattaattactagtaggccatgtggtggcaggtgtgaggttgtgtgtgggcatgtgtctatgcctccatctgttcatatacacccactgcatctctccaattccacttccagaaatgcagaactcatgcctgtgcacctctgtcctaagacaaaagatcactgagtatgtgtcacactcaagagatggtttagaaatgaaccacgaacaagaattatattccctttgacaagcaagttagatgaacgcccattttttatcttagggtcttttggaaaacctccaatataatgctcaatagcccctccttcatcatattgaaaatggattcctaggatgcctatcaaggcagactggcatacggcaccattctgcttgagtcgatgctaggttttgactggccaagcactgatgaccactttgaagaagaggcagaggcagttgaggtaagctctgtatttggcaaatatcaaatgaggagcactgggaggtctgttgacagagccttcatcgctgttccccctggctagaccattgtacattatttggataatatctgtcaaattatgtaaaaagaaaaatgtatggtagatataaatattgtgtatatctcatagttttgtctgctaagagaatattccaataatgtatcactaaattcttaactgtaatacaaaaattctaggttgaaacaacaaactccttcatttccactaataatccaaaatgggagttgacctgccttatcacactaattttttttttctaattacagcattcagcatgaaaaagctcttacatgcatctttatgaaactaaatggaacaggttttctgtggtctcttcattagtctgttgtcttcctgacaatcactgcacaatattagggctgtattatactaagtcatgagcagtaaggggcacctagcactcagagagtctctctcccactcaggagttttgttttgttttgttttgttttgttttgttttgttttgtgacagagtctcactgtgtcacccaggctggagtgcagtggtgccatctcagctcactgcaacctccacctcccaggctgaagcaattctcctgcctcagcctccccagtagctgggattacaggcatgcaccaccttacccagctaattttttgtattttcagtagagacgggttttcatcctgttggccaggctggccttaaactcctaaccccatgtgatcggcccaccttggcctcccaaagtgctaggattataggtgtgtgccaccacacctgggtgttattaaatagccaaaacatctgagacactaagagacattgctgaagttcacataaccaatgagtaactaagccagacccacactgcatcttgtgatcacatactatcccatgctcattgataaaaactacctgcaatcatttgtgaggacaaaccactgccacagacgaatcactgagaggtcccaagagaaacgaagcctccctaagggtcctgatgcccagtgtcttcaggatcccagttccttctccatctttcaaacatgtggggaattcagtgacgaaatattgctgggagttgtctggcccagacttttatttctgtaggtaagagctcccctcagttaacataatccagcccatttctcattaaggggaaagaagatagtttttgtattctttgtctttccatagactataaataagaggcaactcccctcagaatcacatcagtggttctcaaacttcaatatgcatccgaatctcctggggaccttgttaaaaatggagaattctaggcatcagactcagaacttaaaccttctgaattccttcagggatccagtcctgggtcactttcgggactacctgctctatgccttgctttgaaaacccagacacagaaaccacagtgaggctgaatctccagagggaactttatggggtgcaaagttggggcctccagaggtctctctgaaggtgatgcgcaccaggtccccaacagtattaacagaaatgatatggataacacacttgaatttataattaactacaataagagcatatcagcagaaggcaatcatttcacatttgtaattgcaaaaactaaattcttaaaggaattttgtggttaatattgtatttgagcaattctcgtgatgtacttaaagtgaatattatacatgcatataaagataactgtaaaacataacattcttctagagcttaaaaatggcaatttattctactaataattttacataatatccatttgcctatatcactgaaacagacacttaattcactagaaactgaattccattaatgaaggtttaagtataaaacaagatggtaaccagagatactaagtggacagtacatatatgcaaattaacacacacataaaatatatgccccagaataagccattcagttgaaatcattacagtataagtgattaataattatattttcatatttcagtaataagatgatttggccattcataaatatgtataattttctgtaccaacactgtcgacacataatttgttttccaaccccactgattttctccaggcagatgtatcattttccaattataaaattaaacattcaacttgaaaatatgttagcagtctaattccagtttgaataactttctgtatattttcagaagtatattctggaagaattcagggggaaagtatggaattcaaaatggctgatgaatttaaaagatgtaatcagcctctgagaagtattaccaccatgggctaagttgtgaagaggagtagaagcttttaggataaggaaagtcattgaagaaaagaaacagaaactccctagggcttaggagacctcacgggcatcacagacatagggagagacagaagaagaatggaaacctggtctctgtatttttcaaaacatggaactaatatttatgggttttgatagtaactcactattctaaccttaacgtgaatactcagtactgaactaataacacttgaagtaaacagaattagaatatataaggatcctgaaatactactgaagattcagattgttacacgtggtattaaaacagaaaaaaaggaaagaaggaaggaaggaaggaaggaaggaaggaaggaaggaaggaaggaaggggtaggggtaggggaaggggaaggaagactgttcaatatgatggatatatttttaatctgaatgaatatttcccatcattcaggaacctactcatgcctgcacagtgatcacaaaaaacagagtaggctgacatcttcctatactttcctgcaccccttcccctgaggcaaatgtctagccatctgaatttgaccatgctaggacagagagaacctgtcctgggactgttggatttggggcgcaaaggagtcagccaatccttcttcaatgactacaaatatgatgcaaagtttgagaacagtgagtagatcagaaaagcagacacaaaaagagagagaatatgtgtgtgagagagagacacagagacagagacaaagagactgggacttggggtgagaagagagacagagactgaacacagtaggtgcccaaaaaggagggggggactagtttcagttgctttctgatactcagctatgttcctcttcttggttatgagaaacacaactatatcttataaaacaaaacaaaatcacttcttttctttaatgtatgtccactggattctgtcagaatcaaatattcctagtaacatactcataaaatcacgatatacatatgaaatggaaggctttacattataaaaaggaaaggggtccaaattacctttgatagggtccaaattaccatcctggaaatagctctatcatgaacccacattgttagctttttttttttttttttgggatggagtctcgccctgtctcccaggctggagtgcagtggcacgatgtcagctcactgcaacctccaccttccggctaatttttgtatttttagcagaggcggggtttcaccatgttggtcaggctgcccttgaactcctgaccttgtgatctgcctgcctctgttagccttttagaatttgaacatttttcaatgtttaaattatctaattagtgcagatctacattataaaatgaaaaataaggaacataaagaagaatagagttaaaatacttaaaaacactaccatttagagaaaagtcaatgttaaagggtttttttaaatgagagatatattttttcacagacacaaacaaaattctacaatgttgctttatcacatgtagtcttctttatcattgtagacctcacttaataccttctcctgacccccgtctatttacataatcatttatgcagtcactgtaataactttctattatctattacttgatgccttataatttagctacctgagctactgttttgaatatttaagttttctctaatttcccactattaaaagagattagaatggaaacctttgcttgcttgttcacttccttaagataaattatttgggttaggatcattgccttaaagacctataccacgtgagggcttttgaaacactgaaaatgttcactctgggtaggctgttggatttatgagctcagcaggcacactgaaaagccatgttaggtactaggattttctagtcaagtttgctgatccaaaggacagttacttcattgttttatgaggcaaaaatgaacattttcccccatatcttggccatgtttacttattttacaatttgaacatggtccctgcctgttctaggagatagcagattttctaatagactattccttaaatagcagaaattgattttctaactaaattagaagttttaatcttaattaatcttaattaaatcttcaacttttttcctttattatttctgcttttgttttcctatgattatataaataccctttgttttatctatttctaaagtcgtatttttacacttcgcattagatcacaattgcattcattttggaaaagagtttaaagtcaagtggtagggctttttgtctcaggtttttctgtgggaaaattaataataaaaacaataatatgaaatttagataggcgttctaacatggggtccatagaagagctcacagaggactttgaatattttaaaccgtctctgaaaagttgaatgtgtatgcatttgtggattttactaagaagtcctaaagcttatatgaaattctcaaacaggtgtgtgagctcttaatggtgaagaactttgatttaaagagtaaactatagattaaacacatagcagtcctttcctttaaaaaggtggtaaatcccttttaatttcagaggagcagacagagtcctgtgatcttttggccactgaagtttttgatccaattgaatgtcacacaaagccccacagatacaagcagttcttctgttaaagccacggtgggggagtccggaaatctggggcagaatttgaaaatactgcatcagaatatgattcaaggtggcaagatgttctatgaatacatcttctacctcttcaaataaaagttttcagaatgactcaacacaactcaaatttgttatggttgtggagcctgaaataaataatgctgcagattaattaagagaaatgcatctttttctcaaagagcagaaatataagatgacccagatcatcatccattatcagactgtctggcattagtgcaaagctggaatgtcgatatcacaaaagaagctcttgtgctgaacagttactgtcagccatgaaatcaacctcaaatgccagtggagcccaataaacaccaaaacttcctctcaatcatctgtcagtgcacctattttaggaagtgatgggaaacaatgcatcaacatataaattcaaatatatctatgaatccatacaaatgaaatgattttttttccaagcagtaaaatccaggtctttcagcttttctgctttgtgccgtacaggtattactattaggactaatttacacaattagtaatgatgcaaattactaataatattgctgaaaacacttaattatttaataagtacaatagtcaaatgagttggacactcctgtgatacagaattagttatgccaatgtagccttagccccagatgctatttaagtacagaactatcaaacttattttttctttacaagtttccatatataaggacttagtaaaaaagcatgcaacagggctgggcgtggtggctcatgcctgtaatcccagtacactgggaggctaaggcagatcacttgaggtcaggagttagaggccagcctggccaacatggtgagaccctgtctctaccaaaaatacaaaaatcagccgggtgtggtggtgcatgcctgtaatcccagctactttgggtggctgaggcagaagaatcgcttgaacccgggaggcggaggttgcagtgagccaagatggtgccactgcactccagcctgggtgacagagggagactccatctcaaaaaaaaaaaaaaaaaaagcatacaacaaacatgcaaatttataaccaatcaattttaaaaggaaatcatcatgtattaatagaagtcattaaattcttttttactattaagagaatgatcaatagaaactatcttttaatatctgcacttcctgttctgaccaatttcttagaatagataaaatactaaacatgttgtcaagaaagaagagatcatacattaatctgtagaattgaaactaggtaccaaataacattaagcagaaggaaattcaagtagttgttttacaaaagaactgaactttgacagtttgccacatttattattaaaaatacaaagaaaaactcattgagatatatttcaagcacacatcaatttgcctattttttgacagagaataaaacaatgttcttgcgatagtttactgagaatgatgatttccgatttcatccatgtccctacaaaggacatgaactcatcattttttatggctgcatagtattccatggtgtatatgtgccacattttcttaatccatgagatcacatggacacaggaaggggaatatcacactctggggaccatggtggggtggggggaggggggagggatagcactgggagatatacctaatgctagatgacgagttagtgggtgcagcgcaccagcatggcacatgtatacatatgtaactaacctgcacaatgtgcacatgtaccctaaaacttaaagtataataaaaaaaaattaaaaaaaaaaacaatgatggctttagtctaaaatactggttggtatgccagccatgctgattaccagatagtcacattttcgcttgcaatatggaagtagtatgtatctcagtcttgatttaagaaacacttttttttcaactggagaatacagtttaattttgtgttaccccatgataccattttattagtacgattttcttcaaggactcaaaaatagctctgttcattaatctgagcacacaggtaactgcacattagtacagttcaactaactgagcttgtctgcatatggaagacacatccttaacaactaacgtcaaatactggcaatgttctaactacatacaacaccgttcagctggaagtgcagtcaccagcttctcacttcttacatccaatcccatcctagttgtccttctgtctctcaaaatgcacatcgtgtctgactttatagtcacagtcatcaaagacagccaaacagagctgggcgggggggcggtgcgggcaagaagacctgtgtgagaactaaccacctctttcaaaaggctgagaaaagtgcggtttttaccacattaccttttaggaattattctcccattctggccttacataaagatgatagaattttagtacacagttaaacaaaagagtgaaagacatttcctaaattctcggagaacaagaaaggacttgggcatttgaattgacgaaaattggacataaaattctcttctgccacatattagctacaggaccttggagaagtcatgcaactttccctgaatatccgtttcctcaaatatccatttcctcatctgtaaaatcgagataacactaaggacactcctgaggataagacgagagaagcacaggaaggttccgtaagcactcaataactgtctagcatgtccccccattgcactgtccccaactctcttgctacttgatatcactttatcttgtcaaggatctccccttggagtatttacagcttttccctaatgaatcaaagtgtgcaatatcacaaggagagcttgctccttccccttcctacagaactcagggaggactgcggttgctcgtaagggtgctgctgctttcagaggagtcaaaggagcgaagctctgggccccggaagggactctgagtagagtatgtgtctgcagccttggggcgctgggaggaataatatacccccgacatttatgtccactggaatctgtgaatgtgaccttatttgtaaatagagtctttgcagatataatcaagttaaaatgagatcatattggattagagtggtgctaatacaaagactagggtccttataagaagaggggaatctggacacagacgcacacacacagaagacggccatatgaaggtggaggtagagggtagagtatcctgccacgagccaactccaaggattgctggcaatcacgagaagctggaagaggccacgaaggattctttcctagagccttcagagggagcatgggtggcccttctgacacttgggtttagaacttccagcctccagaactgaaagagaataaatttctagtgttgtacaccgctcagtttgtggtaattggttacaacagtagtaggaaacaaatacagctagggaacaatggtgggggcagaatcctaggttttctgtagtcacagaggacttcaggcagaaaacactggaagcagagggggagaccttcccctcatcagccagtgagtgagacaaaggacgctgaagacaaggagttaaaatagccaacctctgtaagatagatacccaacaacaatgcatttaaaataatattttctgttaattgcatttctaatcataaacctctactgtgagcactagtgtttgtggagggtcagagaagggggtaagtaatagatgcagtctacaagaccgtaaacagctttcattatttgaatagatactattttgctaggcttattgcatacttatttttatccacagaatgagaaacataatattatcaatcccatttattttatacatgggaacactgagactcagaaatactaattaatagcctcaacctcacaaagagctgataagcgactgatcagggatttccacccagaatatatctgattgtagctattatcgatgctttatcgcaggtatacatccccaagttattcatctagcaaataaaaattacttttaaaaaacaaaattactttaaaaaaaggcataatgttgatcaccagaagatagaaatattttattgttaaacattctgtatttacaagtccttaataagtgaaaaattttataatctcttgaaaagtaggaagcatcccataataaatcattaggcaagttatactactggacatccacactcctaataaaaacagtataagaaaatccagattttcaaaaaggataatctattgggtgactacttgttaaaaaatactcatgttaattaagtaattctcaataaatatataacacacatgacactttctatttcaaataaataattgtataagcaagttctcactttcaattactttgttttaatatactccataaattgtttaaatatattaccataatcgaccctcaaatgagcaaaatataatgaaacatctcttggcatgtaaatttgcccttcagctacaaatgaatcacttactcctcaatcaacaggacgtttgtacacaattaacaatagccatctatcattcctccaaagatggcattttgcccatgactagaaccatcacagtccattgactattggttataaaacacttcttcagtcatatctaccttagtatttcataagtcaacatttaatttattgtgttgattagattcaatgtttatattcatacttcccattcatctgcttaacttcagttaatgaggctgattttgttgtttccaatcctggatcgagttctgagacctggaagatggaggtggttgagtggtgaagcttgcagaaaagcaccactcctgaatcttagacagaggccagcataaaatttgggaaatgggggggcttctctaataaatattggggactgtgcctaaagcaggggaaatgcatgcttgctaggcaaaaacaacaagcatctccctacagcaaaattcttctatatccaacatcttagttttagttcttgaatgttggtcctgtcaaatttcccctggagaactggtaaaaaatacaactctccaggcctggctctctaaataaccttaggtccctgtgttttttattagctctcccaggtgattttgagatatctaaatgtttttgagaactactggtctattccacaaacttttaagtttttgcacctggtatttggacctaaagtagtcccagaataaaagattttttggaccaatcagtcttaagcatgtactgtgtgccacttcgtgcactacttgtcccaaactacctgtgatctcttttaattttagaatcaaaatttccagatctcaggttttgactgagactggaaatctcagtttaagttgttaaggatggaagagacatccttaacaactaacatcaaatactggcaatgttctaactacatacaacaccgttcagctggaagtgcagtcaccagcttctcacttcttacatccaatcccatcctagttgtccttctgtctctcaaaatgcacatcatgtctgacttcatagtcacagtcatcaaagacagccaagcagagctgggcggggcaggggggcagtggtgcggggaagaagacaggtgtgagaactaaccacctctttcaaatggctttgaattgtcaacaagttctccaggtgattcagatcagccactccaaccaggtgacattgtcagcatcatcagagatgagccatgcttgacaggatgagcccataatataagaatggtactttactctgtggtctcttcccctaaacctataatctcaattgaatcatgtggaaaacagaaaaatcctggttgagagatattctacaatataccagaccagtactccccaaaactgtcaaggttatcaaaagcaagcgaagtctgagaaactgccacagccacgaaggatcctagagagacctaactaaaagtaatgtggtgtcctgaatgggatctggaaaaggaaaaggatactggagaaacattgaggaaatatgaatgaactacaggctacacttagtaataatgcatcaatattggatcattaatcatgccaaatgtaccatgcgaatgcaaaactttaataatggaggaaagtgggtgtgagtcatatgggaattctctgtaccatctttccaataattctgaaaacttaaaacttttctaagatttaaaagtttcttttaaaaatcccccaaaatcagtttaagcagaaacactggcaaatattgacacatcctttaaacatatctttaaaattagaacatatttccaatgccccatctttttatggcatgacaggccttttttgggtgtaagcctctggtcagaaggccacagcgtcctcatgcatgacgcatggtgtatccgccatatgttcttgtttcagttaatttaaagaggcaaggaaaatcagaagaccctgaaacatactgagtgtaaaacaattttgaatttttatgaattttttaaccatatatttttaatgttttctcacacaccctaattcaacaactatttttgtcttctcactctcaagtacttatcatagcttttactaagacaatagctgtctttcacactttatcctcacattccattggtttagtgctatttacctgagttatctattgataacacaacaggcacaaacagacaaacaggtatggaagcaagccctgttgactccaatcgacctagtgggggaagaactgcaggctgccttgcagagagagggtgcccagcaaggtgctggcatcagttccaaatgtaacatgggttatggcatagcctgtaacaggaattatgacatgggttggtagagctggcaagtcacttcgatggagatcagctggtattacagcttctcctgcacttcaaatatctaccttggttatatgaggagtcgccacttgctgatgtataaatatcaaatggttttagttttgtccaataactgctacctcttgtgatttgtcaaacttccttttatactgggtggctggtttccttaaaaatagttcagtttaatgtattaaatttccagcaattttagtcactgaaacagtatcatttagcaaacaggacttgatggttgtccattgtaagagtccatcatcattcctaattccatcttcccctctctagcacacacggtaaagcaaggacctttccctgcaactgccctctctcttctctcttttatcccactaggattgggggaaggacaagaggaagataaaagcagggcctccatttaaccttccctgttgagcgtgatggccccttcctgggagggaccccactcatccagttcctggaaaaacgagagaggaggagctgagacctgagtatctactgcagacagtagtacattgaaggcagggccaggtcctgaagctgaccgcctctgggatcttcaagtcacacaccgtgtcatcccctagagtgccagcagtcctcatctcctctgctctttgccacccaatcctgagcccctaggtacagattggacccttctttcttacctctcagaaaccaggaattcaatgctatgccagccacctcatcacatcttccccacagccaatttgagtaggactgagaagtagatgtcatcctctattccacgtgctgtctcccaactttcccagtgattgtcatgaccttagaaagactggagggatggctgctgctcccagcaaactttgcccacagccacctcacatcttcctctgccctctcacctggagagtgcagaggctatgggggacatgttgaaatagcagcttttatctctgagctagactccacagccagcaggcctctgaactagaatgggattgaatccagggacccccattcccacatgcagcaactagaagatccctagagccacatcccaagtaaacagacatttttcttgctggatcctacaaggagggagatgcaaagggtaggagaggctggcccaggattttctagagtaatagaggtgacacacaaagctgaagctgaagttgcttaaaataggtgatgcttttcctgtgactgcaccaaggccagccagccctgggggaaatcctgagcagtgacacaacagatgacccacggagccactgcaagctggccagtgatgtcagtgttgggtgaagaataggtgaagtagcctgcccaggaccatggatttctacaataatttatttacccgataaagtgctatttccttcaaatttaaatgttacaacctccttagcctttgttccaagccaactactttactttccttttaaaggcactgctttagtgaaacacactgataaactgttttcaaggtaggcatggaagagaagaactatcattaacacacacctgttgctgccagtcactaggggtttggcaaatattatctcaccccgcagcaagcaaatgagagagagaacactaatccaactgacagaggagggatctaaggagtgttaggtggaaccaagattgagcttcagcccaattaaaaaaaataaaaaataaagcttatgcctttccaatttcatgctgcgattttccatgatggcatgctaatctatcagttccctaacacaatcattttctgaatgctgagtttaacaaagccacaaagaaatatgaggtttctgaggaagccagcctccgccctttaggaagcttataatcaaatgttggggattcctttcccccaggagtctgacttttgctttttattgcccttcaactttttgcaatacaatttataatttgaagaatatttgataaaactgcatgatgttctttgaacacaacctctgttaagacaggttttgaaatgaagaaccatatatatgagcaaacctctgtttttgtgttttgttatggataatttacacaatacacaatttatacagttacaaatgactcctcaactctgaaccaggtaaaataaacatttcattactgatctttttttcttggaacttctccacactgaattatactcaagtgcatcacaattacccatttgatcttctccccgtgtattttggacctaccatctaatttataaatactaactacctgtaaatgcactacttttaaattatagctacaatgatttttaaatgtgcctatacttgggcatcatctagggtttctaaaaaatatattgacacctgggtccacccaaatctcatcttggattgtagctcccataatccaaccacgtcatgggaggggcctggtgggaggtaactgaatcatgggtgcgggtctttcccatgctgttcttgtgatagtcacatgagagctgatgtttgtacaaagggcagttcccctgcacacactctcttgcctgccaccatttaagacatgcctttgttcctcctttgtcttccaccacaattgttaggcctcgttaaccatgtggatctgtgagtcctctttttctttataaattacccagtctcggatatttctatataacagtatgaaaatgagctaaaacagcccccaagagacacgatgcaattgggctcatgcaaatgtttgaaaaccagtgctctactgaacactaaatacaaaaaaaaagctgaccttttgtaaacttactacgtttgaaatttttaagaaaatgagatagaaggagattaaacctaaattatccagatatctgaatgcacactcatgagggcaataaaggtctgagaaaaggacctattatgtaaattccaaccatgtgtacctggtgcccacatggaggtataaaacaagccttcataaatgtatgtttctcttgtgaagtctcatcctttgttaactagtgctaaaatagtttaataatggttacattccactacgacgaatctatttcaatcagcattccaaaaaaatttatttgcttggtccttaattcaacctcttttctttttgaactgtctgggttcactgtgaaacgctcagtatctttcaaacaacccattatcctattccattatgagattcagatttcatttctcatctatatgttgatctttcttttacatgcttataatcaagtccccaaatctgtgatgtgagtattttcagggaccgagtaaataatcacacccatgttcactgctcaagttagagccaagtaagagactcagaaaggattcagatgaaaggacataacaagttctcttttggtgctggtctagtggacattggagaacatggcttacagctgtggcccagagggaatcgtgatgctgaagcacatgcatgactagaacaagctaccggggctgcctttggtcaacttaataaattatgaagaggctcatggaggggcagatcccggagagaagagagagaggttgagatcatgtgtctagctctttctcccaggctccccagtcaccctaaggagagatgagcgagggagccaagagaatgcaggagaatttcctagttggtttttctccattgcatagagatattcagtatactgcagatttgcttatgacctccactgacaactgtctaatatgcactattatttcatcttgacagctctccccatttgctacctgcaattatgtaatctgctctatatctaaaaaccattcttctgcaccctactctcaggaatctgcctctccactggccctcttcataatttgttaagttgaccaaaggcatcctcagtgggttggtctagccatgtatgtgcttccgcatcgggattccctctaggccacagccgtaagccacattctccaatgtccactagaccagcttggtttttcataatggtttttaggtatagagcagatgacataactgcaggtagtaaatgggaagagctgccaagatgaaataataatgcatatttgacagtggccagtggagatcatgagcaagtctgcagtatgctgaatacctgtatgcaatggaggagaaacttcttttgactactttcctctttccctgtggaggcacaccaaccaggaaatcctctagtgtaatggtttttagatatagagcagatgacataattcctactttccttcccagagctatcaggtgaggaggcaaggccctgactacttgtgctatctgtctcttcttaaggacaactctatagatgtctctcgatggcaccctgggtgagagatcacttagcagaaaagtgagaagagtcagggagtagacttgtgaaccaccctatagagctggtgacccagccacgttcagtagatggaccacataccatgtccacaaaagttgttgcaaaacaaaccagaacaaaaacaacaaccacttatagaacacactagggaataagctgactttttgttgtgatcagtggacaaatacaaactggatactgtaaaagagctattgttgacctgctgaaaatggcataagcaatagaaaataacactggttgaaacacacaggcacaacatcaaactcatgtccatggaattcaaatggacaatgggaaaatataagagaaatgaaaaaaggtaacgttttaaattcttgtgaaaaataacttgatttaagtggttaacaggtgaaaataatacaggatctgtcacatattcatgactcaaagaatatcagtggtaactgattttaggaggtttttcttggggagggggatgtgataggcaaaactctaaaatgacccccatgtaatccatatccttttattatcctctcatccacagatgtggaaaagatctgtaaatacaatgggatatccttccattgattagactaagttacatgacagatgcaaagggatttttccagatagaattaaggttgctaagaaactgacttccagttaatcaaaaggaaatttatcctggttgagcgtgatttaatcaagtgaactggttttaaaaagtgcctagagatgaaagcctcaaagcagcagatgtttctattgttggcttagaagaagcaaaccccatgaattcaaccaccaacaggaaaggaattctgccaacaatctgagatagcactgatgtaagtgggtccactccccagtcaagcctgcagatgagaccacaactagtcaatgccttgatttcagtctaatgacaccttaagcagaggaccaactaagccaagcctggacttctgacctttggaaattgtgagttaacaggcattgttttaagccactaactttgtgctaatttgttatgcagcaacaaataattaatatgaggataatttgcaccagttttcttctattgttcttgcaacttgactatacatataactatcttgctcataagtgcatacaatgtaaaaataaaaaaatttccctgattagagttcttcatcataataccttatacacaggctttttcctcacatcaaaacataaattgttattgtgtatattggtaattataatacagtgagacataattaatgtatcccaacattatagtgttcacatttacctagaagatgaggatgatagtgtgttggtcaaaaatagtcacaagttattttgcaagccatctctttggaaacaggacagatacagattttaaaaggaaatatcatgaataatgatggctggagtaaagaagggttaattcggatttttgaacaaaataaccatataaaaacacttttcagtaacttgaacatcaaatataaaatgttattttttaaaaaactaagttccaatttaaagtgaataaaatatgaattggatggataatgtatgttctatcaaaataaatctaaactatttaacacagtaggaagcaagcattagatggaaatatgctactaacatatgttaatgtgggaaaaaaggaaagtgtaagacagaatgtataggagtatcccaaactcgcaggttaaatagtggaaaaaaaaaaatcctaaaaattattatcaaaatctaccttgcagaaagaagtatgttggtagaatttggaggctgggttactagcatcttccccaactttatcaaagagggtaatttcctcccccacttttctccttcataggggagggagtaacaaacacatcagtactatcaggacagggtgtttgaacttgagcacctttctgggtctggaagccagccatggaggggaactgccctgctgcaggaacagactcttcatgagtcagcctcttgggctggacagccagtgcccggggcagtcatggaggggggtcacactgctgccgctgtcactctcaccaactgcacccgcagcatttcctgggtgcccagaccagtgcagagcacatggctcacctcaccctattcgaccagacccccattctgcaagtgggtacatgtaacagcgcggcagcagggctgagctctgggtacccagccatctcacaacaaccacaggagccactcaggggaccaggccagctggcagaggacaggggctgctttttctttctcagtaatcacaattcacttctacaactgtcataattccattttagaaaagtaaagtgtaagactgccctctcagaagggaattcatcaatttgcatatttcctggagacttctttctgttactctattaatttattaacactttttaaagtgatgcagtttcccaagatgctctctgtctgataaatcattgaggtggttataaataaagcattacaccttaattccctaggtatctaacccagaaaactagatgctactgattttctacagagatgttctgaaaattaattgctactgataattcaattcttccctaaaatcaggaaaggctgaagcaagatgggcagataaaatgttttcagatgctagacagaacaaaaatgacaaagacaatgtaaacctatgctaggataattaaagaaagtttgtgccttatttcggactaaagaaactgaactgaaggagaaaatggacttttcctgaagatccctctcctttagttttttgtttgtttgttttaaatcatttccatgaatacacacttatcttgaattatccaaagttctcacactgtgctaactaacatactgagcttgtagttcccagagaaattttagggtttacccacattttcattttattcttgaactaaagtcacaacattttcccgaatagagttgggggacagaagtaagcatatgaaaatgtcagaggaagggactctgccttcctaaagcttggcctccgcaaacatgcaaaattgtttaaacaataaggtcacatctcatcagcaacttaggttcctccagacctggagtcggcagtatgtttgtgatgctatggatggaatgatcccatgacactaatataaaaacttctggactatgcgatagtggacaagttattaaagtccctaaaatgtagggattggggaaagcaagtctttattagtaccaataaattttcttaatttaagcaatggcagctttacatagtattctgaacaactagagctaagcaaaactgttacgcatgtgcacaactagtttggacagtctgttgataatcaagatatactaaatgtctccaattatgttaacaactcggcaagatttgaaagcgaacataaatcataggtaaaataaatgcaacaacactaataactgtaatgcatgacttactagaaactatatttcagccacttttctagagaatcatttacacgccaacatatctagccaccacagccacaccatgaagtagacccttcagttatgactaatctgcctgcaattgatgtacttattatgtaaagcatttgtaatgttacctttttatttcttagtaggttgaattttgagcattttaagatttttttattaacagaaagtattattggaactccatttgaaatacttggttggttatattggaaatcactgaactttacacattcccataatttaataaaggaaactctgaatgtgtatgtccatgtctgtgcacacgtgtgtgcatccatgcctgaacaatatggattactttgtacagttattctcgagcttttagtaggtaaagataaaatagagttgcattttgttaggggaatttttctattccctagtgagattgtgttcagttcttaatgtacttttccttagaagtgcaaataaatgaatatgaattgacaggatcctataaattagtaacactgactttccaacaaaacacagtagacattcatttatagaacattgctccctataagtttactgctttgaagaatatatgcttaaaatccaatgatatttcattgttgaaatgatatttgaaagtgttttttaagaagatttcaaaacagaactcattacctaatgatcacatctaatttttaattccagttgatgcttctcagtttgaccaaccgtagccttaaaataaccttggttaaattttttaaaactaaaaattcaaaaaatatgtatcataatattcaggactcaagactttcacaatttggctattaaggttattcccacacatcaacattaaatcagtctaataacttcttgcacaagacagtgtgctaaggacccctagtcctgtcctcaaatctgtaagagggctgccttcactccagcaaagagcaagtatcataactttatctcacattttatactttttaaatatttagggcctttaatcaacttggaatttatgtgtttagtgggaagatgaaaatctaatattactttacttttccatatagacagccaaagataccacattaagacaacagcactgattgaaaaagtctcctctgtttctcccttatatatgaaattctcacatacgtagaagtctatttctagttatatcattgttttaagagcttagtgatgcaatccatgtaaataaaaacaagcacagtgctcatgcatactttgtcttattaacattattattattattatttattatactttaagttctagggtacatgtgcgcaatgtgcaggtttgttacatatgtatacatgtgccatgttggtgtgctgcactcattaactcgtcatttacattaggtatatctcctaatgctatccctcccccctccccctaccccacaacaggccctggtgtgggatgtaccccttcctgtgtccaagtgttctcattgttcaattcccacctatgaatgagaacatgcagtgtttggttttttgtccttgcgatagtttgctgagaatgatggtttccaacttcatccatgtcaaagaaatgcatatcaaaaccacaatgagataccatctcacaccagttagaatggcgatcattaaaaagtcagggaacaacaggtgctggagaggatgtggagaaataggaacacttttacactgttggtgggactgtaaactagtcgaccatcatggaagacagtgtggtgatttctcaaggatctagaactagaaataccatttgacctaacattattactactttctaaattatcctggattattttgttcacttacattttcatgtgactttctgaatcaattttttgccactcctgaaaaatcttctttggattttggagtgggagagcattaaatttgtttattaggagtaattttctcttgccttcccattcacaaaccttctactgtctccttttatcctgttcttctttatgagcttctatgaaatttatctcctaaaaagttttgcatatttttgttaggattttatttatgcatcttataattttattatttctgcgagtaagaatatattttctattatattttctagttatttatggctggtatagaggaaagctattgatttttgtattttgagatttaatctgaatatcttaatggactcatttttattagttataatagcttttcagttactcccttgggttttctgggtatatagactataaagtctacaaataatgccatatttcttgcttccaaatctttttacccctgccatatttagaattgcctagtatctcaaatacaatgttgaatattggaagtgatacaaagcataacattccagattttaattaaaatacttctcatatttcaccactgaatataatattctgattggtaactcctttacaagtttaagaacttccttttattttattctgctaagagatttgttttttaaccaagattgggtattacacgttatcaaatgtatgttgaacatctgctgagatgaccagaaagcctttcttctgactagtattaatgtactagttttcattcatgagttttctaatattgagccatccttgcatatttgcaacaaaacatgctttgctataactagtttttatgcttcgaggattgaatttgctccagtgtttaaaattgagctggacctatcatttcatttactgatttccatttctggccgggttactggggtatcctgtattgcttatctaaaaattaaatttctcaaaaataaactttttttggttaatcaatttgaattgcatcatgtcattcatttgtcagtctttccattatcccctactccagaagaagtttcagccacttagtgcctgccatatgcttgttgctgttcattagaaaaacatttcaatatgaagtcctggagccctctgagttgactgacaatgtcatagaggtgtagattgagcatgggcttttgagtcagagctgacaggtccccttactgtgtcagtttaaacctatgctctcttcctttgtaaaatgaacataattcctacgttatatgctgctgtaatgactgagtaaggtaatgctcacagtgtacctagggcacacaagattttctacacgtaatgatgtgctgatttttcttgatgaatgtgaatgtgaacatttgcttctttgaatatgtcagccttggtctctgcatgttgagtgatgcatagagtttacacagtaaatctacaaatatcactcataaaagaaatgtttacgggtagtcctttgaaaacaaattggcatttatttacaaaatcaaaagttagatacagaccctgggacaatctgacagtggagggaatgaacaccatgtggtagggtcaggagcccacatagcaattgtcacagaatgaatggtattccccagatagatacgttgagggcttaattctccagtatcagtgaacatgatcttattcagacatgggatttttgcagacataactggttcaaatgaggttacactgggatgggatgggcccaatccaacaggactggagtccttaaaaaaagagagatgatgatgtgaagacactggcaccctgggagaacaccatgggaagacagaggcggacagtggagcaacatatctacaagcaaggaatgcctggggttaccaggagctggaagaggcatgaatcctcctccagagatgtcagagggaacatggctgtgccaacactctgatttcagatttctaacctgcagaagggtaagataatacatttcagttattttaaaccacatagttggtcatactttgttacagcagcctgcggggtatgggcagggggtatctcatggatcagagccatgaaataacttagaggttcaggttgtcaagcaaaccaagaggaagaccgtgcaacaagaaaatgctgatattaagccaaatgttatctgagctagtatgaaagcaagaacatgttctcaagtgcacaccagctagaacaaatggaaggaaatggccgaaagggtcagagaataaatggcataaatgccacgatggctacttatgttgaagatttattaaaagtgcatcagatgctcatcaatccactaggtaatgggtgtgactgtaactgttaagtatatttgataatgtatttggcaaacgttgccatagaaacacaatttcatggaacaaagaaacactagcttaatctccaatgtaattttgctatgaaagtggttcacgaaaacgaatctgggacattgaggctctttcttgcctcagaattaacatttatcctattaattcattactgctaaactttgggatccataatctttcctaggtagtatcaatctcagtcttcagaatttcaccctccccatccctccctattttctgagtgctgagagaagcaaagtcaattgttattctaactgatcagatactctaggcaaacaaaatgcagtcatgctggtttcacactggtcaaacaggatcaaagatgaggatgccatgccaagaaagtgggtgactgcatttaacattctacaaatagaattaattgacttgctgtccaagtcatatgatgaagctattctaactctgggaatgaaaccagaatttctcaccatcaattctcttttctcttctctagaccatgcggtctcaaagtttttattctccaatgataatcagtttaaatgagagaatgcctgccaaacccaatgctctaattacatagttaggaagaactgataataattattgcaatgttctaccctcaaaaactgttaggcaatgctgactgatttagataccgagacacaattttctttaaaatacacacacacacatatatattttaaaaactgtctaaatgtgtacatgccacaaaaatccatcattaatgattgttagcataaatttgtaactagcaaaactagttctgaggcttatgtttcgctttccatttttaagtaattcaaaagtattggttaaatcaatgaatgcatgaatattttattaacatggtctgcaaatataagaaagagaaaaagtcctgagatgctccttccccacatatttttgtgcaagcatgaacgctttcaaatatttaaatacaagtacagcaggggtctaagaggaagcacatcaaggccgatgaattgagtgttcaagatattattcatgcctgacatggctttttataaaattacacttcttgtcacctagaattttactgattctttcttttaattatcaaattccatggttacttccaccaataaaacagcaatgtcctcttaaaagaaaaatattctagcagcacacaatgcttctattctgcttccatttcctctttccctacggaaggcttccttgccagattccattcacagccaaaaaactcttgccaacaaaggcttaaaatgataaactaactcagggataaatggcagaagccacatttatttagggggaaaaaacgtccacatttacagaactctctaatacatatcatgatttcccagcgatgcattttaagtaaaattagaaatgctttagatggctaaaaattctaatgcaatcaattttcataattttttccatacaatggacactaaggtaactgatgtcgatttccacagataaagaatttgacaaatattttacagtttgctgtgctattggtttatggggctcccgacccttactataaatgtccactcttcacataggcccaacaggtggatctttccgaggccccacgtctgatctgctctgcctacttgctcctctccattttccatttctcaggaaatggcaattctgttcctctagtaattcagtccaaaaaacctggattcatccttgatgcctttcataatgtcacacacagtattattggttacaggataaactgtgtccctcccaagattcatatgttgaagtcctaacccccaatacctcagaatgtgaccctatttggaaataggattgttgcaaatgtaattagttaagatgtggtcatactggagtagggtgagctcctaaaccaatatgacagatgtcctcatgaaaaagggaaatatggacacagacatgtgcacaggcagaacgccatgggaacactggagtgatgctgccaccagccaaggaactaccagaagctggagagaggcctggaatagacccttccctagcacctgctgagagagcatggcacagctgacaccttgatttcagacttctgacctccagaactgaaggtaaatttctgttgttctaagtcactcagattgtggcaatttgatacagcagccctagaaaactcatagagtgatcagtctatcaaccaatcacattggcttttgatacctatgaaattacttacaaatgtttttcttctaacactggggttatttattcctagatgttattcctcatgtgacagttttcatagacatagtattatctctaggttgactcccatatttatggcatatacttattttgaatttactgaaaagaaacactgtatggtgtaaagcgtgttttgttgttttctccacccttggtgaccaattacagggacactgctcgcccactgcatgtcagtgtaccatatcacaccttgggaggggctgcccctggcattaggccaactcctgaaactatcatagtattcttcattcacagacaagcttccaacattaattctcttccctaaggaattttatttctggaagagggatgagtaaatggcaccaactggcatcctcaaagttactaagcaccatctactgtccccgtattttaatacatccatggtaattatattatttccatcagtctgctgaaaatttaaacactgatctaaacttagaaaaaatggtgtatcaacgtgaaacacaatagctactgataaaaggcgttatataattaggtgataaattgtgtgcgcagatgctacatgctgtaagagatcagagcggccttagatcaatgagagcgcaccagaggactggaatcttgctgtgtcaatttgtgtttttctctttgatttgctttgtcatctgtagactcttctttgttttgggtatttttaagtacttagaattaatttacaatatgaaagcataacttatacatctttgtccacaaggaatgctgagttttcaacaggactgtaagatgattagttgcaagccagtagggagcaagaactataaacatcagtcatttacaaaattagaatttataccatcttttctcccacgtatgagtgatcgacaggatataaaataaatgcttaggatccaagcagatgggttttctccatttgcaagactccaagtctttctgggtaaggaatgcctacttggatgctcttttgcatctggaatggtttaaacattcctatttatgattcgtaggctcaacacaaaaaactcatggtattagccccatacaaaataaatgtacaattattattttcccaaacactactatatttgtatttaccatattttcccatgtattttttacttctcccttttcacaaccttatgcaattggataacaaacaataaattaaaacgttcttcagggaccataaatattcatttatttatttaactcatttaatttagaaacaaagagtgagtgttcctcctgtgttagacagtgtactacgtgccctgactccaatggagggcaagtaagccttactgcccacagggtgcggcagtagctatcataaatgccaagaatgtctttatttagaaggccaaggaaggtctctggaggaagcgacccttcagctgagccatgacataaaaagaggagtgagcaaactagcaggtgaggatacaaaccgcagggaaggaataaaaatctggaagtgagatttaacatggtttaaggagattccgtttatcctacaggtaatgagaaaccactgaagagttttcactttaggggactgccatcatgaagttcattttaggatcccagtctgtgactccagatttagtgggtgggagaagataggggagtaactggctaagggagaccagtgaggagtcagattccatcatcttggttaaatgtagcgtgggagggatagaaggggaaatgaaagaactgaactgctctgagacaggtttagaatgtggaccagcccagacacagtggctgatggcccatgatagctgaggaagaagacaaagatttcttgggaaggagaatatggtatcttaaaatccaaaatgttattcatgtatgagaaatagccattcaatatggagatgtgactcttctgtcttactcagtaaggtttctattgttggtggagaaaaggttaccacagacttagtaacttaaaacaacacaaagttagtacattacagttctttaggtcagaatgtccacacaggcctcagcaggccatatcaagccattagcaggtctgtattctttcctggatgatctggcagagaatctgtttccttgtcttttccagcttctagaggccacctgtattccttggctcctggcctcctacctctatcttcaaagccagcaatggcaggttgagtcctctcctgaccctcctccatcatcacccatctgtacagacacacccagggaaggttctcagcatttaggaactcacgtgattctatgtggcccgagaggatgaactagttcctctgcacctcccacattagctgagtagcaacctcaactgcatctgccatgctaacccccctcaccgtgcaatgtcacatgttcacaggttccagggattaggacaaggtcatctttcagggctattcttccacgaactacactgatgcagcatttctgcctacacatgctagtccacatccagcccaattacttccctagaaactacttttgcactattctcttctgaacaaagcatattatgggccacattcttcccatagagccttatctgagaggctttcatttgcagtaatattttagcataatcctatcaagaatgatttccaaataaagggtattttgtccctttgtacctataacattgctaaaaccttatctcatcctttgtgctgcttaatttacttcttatagctttccttcaagggcatataacattttcaaacataagcatttgcccatttttaaggtaatgagcccaatctgttttttgaaaatgaaataatatacttaaaatcatatgacttagggctgtttataggatgtcttaatttttcagatggttaagtattacaaaaatctatataaaaactaaacctcaatttacaccatccatttcctacatttttataacaaaacagtaggaaaatatattgctgctaaaaattaatagttacagaaattgtgaaaagctcaagagaagtactacttctggtgataaaacttaaaaagcaaattatcaaggaatagtatgtaactattattgtctttgatggagcacaggagtgaggaattttacagaactattgtccataaacactggattgtgtttacatttatctcattgtgtttatatgtatctactagcagtaaaaaggcaagtatcagggaaaagagccattacagatcccgaaaatggcaaaattaactgaggaaaaaggtttctttgacattgagattggctttacaaatatttttcctaaatgagatctcctaataaaacaactaggaaaagactttaaaagtctcctccattcaccacaattgaatgagtgatcaccgatcatttcggtgtgagtaactctgatatgcacacagggcagtggggatgctgcattcccgtcattgtcacagcctggcacttgcctgcgtctcaccacagggtggagaatattcctggcccccagccaggacttccaaaatggggcaaggataagtggaattaattttccctcattttggatgtattccaagtttcagggttcagtggtatcattaccacaggatcaaattgtgatcaaagacaaaaatgcataaatattttatagagtaaccaagtgtaagcttacaactccaaactaaaatgtttagtattaaatgctattctcaaatattcacctctaagctcccatcgtcctcattatgtacttgaataatttaaatataaatgatgtagttatatctctgaatgtggaaattttatagaagtaaaattatgaaaataataaacaattttcaaacttctcaacaaatgtttgctagtatcctagaaatttaagataacatcatttctggatttgcattttatttatcttcttgtatctatgtatatgaatagtctaaatttgtagtatagttgcttgactttacttataaaaagacagtgccataagtttcctttgcccctctgtaacaatgcatgcaacaaagcatgttttgtatgtttataactgttttaaatgactttagtttaaaagtaccacagagcaaaagttaacagagaaagtgtcttaatagtttgtgttttggctgagcttggtggctcacgcctgtaatcctagcattttgggaggccaaggtgggcagatcacctgaggtgaggagttcgagaccagcctggccaacatgatgaaaccccgtctctactaaaaatacaaaaaaaaaatagccagtcgtggtggtacatgcctgtagtccgggttactcaggaggccaagaaaggagaatcgctggaacccgggaggcggaggttgcagtgagctgagatggtgccactgcactccagcctgggtgacagagtgagactgtttcaaaaaaaaaaaaaaaaaaggtttgtgtgtcttcaaaccaagatatcaatttacttctttaaattttaaatattgtaaatgctattttcttttagtggggaactattttcatgtatgttagactctttctactcttctggtaaccactgattatgccagtgtgcatgtgtgtgtatgaagtgagagtccacatgttttaatgtcattttctacaaaaacagaggatttggccaggtgcagtggctcacgcctgtaatcccagaactctgggaggccaaggcggacagatcatgaggtcaggagattgagaccatcctgatcaacatggtgaaaccctgtctttactaaaaatacaaatattatctgggcctggtggtgcgtgcctgtaatggcagctactcgggacgctgaggcaggagaatcacttgaaccagggagtcagaggttgcagtgaactgagatcgcgccactgcactctagcctggggacagagtgagactccgtctccaaacaaaaaaaggaggatttatatggttgcatttatctccatataacaagtatttcaggaaaaaaaagtaacgttttgtgttaaaacgtactgtatacactttatgggccatacaaaacacagtataaatcatgactttaaaatgtttgtgctctttatcatataaataatcactattttaatgtgcagaaattaagggaggtaacaggcagtttcattcatgtacaagagtgctatctcaggattctgaaatacttgaggctgaatcctggtttgtcaatattcttttttccttgctgagtgatccttgagtaagttaacctctataaacctcaattcatactaaagatttgtaaaaatctttagtatactagcatttatatttaggtcttaaatcatccatcacatatttgttcatcgttttaaaacctttctacacactctccaggtgcttcatgaccattttctacttcactggtgtagtttcccattctgtgattctatcttaaattctagggtagttttatgtcactggtgatgtttttaatcctgtattgttttaatttaccacctgctttcttcctttttatctctgaataaagatatgggttccttggcaatttccaagtctttgttttgagacagaatttcatggcttacagttcaatgtctctttcttcttcctcccgttgagatgtgtatagttttcaaacattttaccttctccaatggctttttatcaacttctactccctgtttttatctgttacatcattttcaatgcatttttgttcactgacacaatatacagacttttttgtggaatttaataggaaaagacattagctgttattactaccatattatgaaatatcccccccttgctctgtccatatcgctacttggataaagagggagaagtttaatattttatccatgctagcaatattttgaaacataatgaaacagcattctaactgcacagacagtgatagatactattaatgttgcacttaagttgtgtcaggcaagctactgtctacagataaaaatgaggcatgaaaagtttatgtagtttagtcaaagtcacacaacacacaaagaggaatgctagattcagactcatatcaaaacactccatgcattttctactactccaaactccctcttcaattattttaagaaggaattgactagggtggtaaagtttgacattccagaattttggactagctgcccatttagccacttactactttaactaaggaactgaattcatttctcttagcctcactgtactttttctaaaatttaagcaatgactgtcaacttcatgtgttaatgatacaatgaaatgaaattaagtatatattaaaaagtctgaaacataataagtgttgagaaaatatttgttgaatggaatttaaaccttcaaagaattactcccactatagagtatcaattttggttttccctctatagtcacctatcagtaaatagggaacttctgagaagaactgaaagcaaagatgattcaatacgatatggtttaaagatatctgagtttctaacactaaagaaaagcttgaagacatagaatacctggaaacacacctttcaaaattcaatatagataggatctactcaggattgtggtcatgaaattacatagtacatttaaagatgttattgagcgtgatgatctaattagcagaattaataaacagaaactgactagcatacatcccttaatttattcaccataggtcagacctttactgtgatactactgtgtgccagacactctactgagcaccaagtgatgaaggaaaaggcatacccttccgtccattagagaaacttctaaaaaaatttttcatttgactcttccacagcatataaactaatgattgataaacataaagtcaattgagataattaggcagaacagtttcttttagtagaataacagcattgtctcatcatattctcagctattggaaaacctaatccttctcacttagaattgagtattatatttgaaatccaaagataaagtaatagatactttataagtcttatttataaatcacaaaatacattttagaattcccttctcttgctttcattactttcagaaaatactgttgttaagtagcagtaacatgctaattttctaatgagaaggtacatacagagtttcacgactgtttttcaagagggtgttctttgcatctatcaaggctaaaagaaagaaggtatttaagaagctaatttcctacgggaataatataaggtttaaacactttcagggctgttcttccataattatcttttacaattttatcttccaaagtgaatacactcttttgtcgttgttgttctgtgagttaaatagcacactggcaaaatgtcttgttagctgatgggtaccagttaagcatggaggttttttgtaagtttgcacagtggttttattttctgagccaacacagaacaaatgtaataatgagcaaactcttactcacctagggtgagtaacagtgatagctacatttactaagggcagagcatccgactgatgatacagttgcttctgaacctcttttaactctcacatctgtttttggctctgtgtttaacaacaaaacctgggcttttcctcaattgcaaatgaactaatttgaataggcacagagatgtgtaaaggcaacactggtttcttcttacctatgataatccaactattatagtttccatttttgcaatgtttctggcaggacattgtaactaagagcattgaaatgagatagctggcaccctccaggtatgtaattgggaaaactccataggcagcaaccaatttttttttcttttgtatatgcttatatgcccttagttatactgtattatttggaactggaaattttactctatgagcataaatataaaaccagcatctttttactttagtaaagagtaattctatagcatccaataactggacaataatcagtaattctgagttgcatatagtgatctaaatagcaaatgtgtattttacagtgatttgtttaacaaaataagcaattgcattcttgatcctataatatttggaataacaccttccaaacatataaaaaatgaaactaccacccagaaaatgcgatacatttttcccaaacttttctgcaggctcgagtgtgtatctattaaaaatcttctaccaggcatggtagctcatgcttgtaatcccagcactttaggaggccaaggcagaaggatcacttgaagtcaggagtttgagactagcctggccaaaatggtgaaaccccatctctactaaaaacacaaaaattagccatgtgtggtggccatgcctgtaatcccagctactcagggggctgaggcaggagaatcgcttgaactcgagaggcagagattgcagtgagctgagatcgcaccactgcactccagcctaggcgatagagcaagactctgtcttaaaaaaaaaaaaaagtccaagtgcagtggctcatgcctgtaatcccagcactttgggagactaaggcaggaggatcacctgaggtcaggagtttgaaaccagcctgaccaacagggagaaaccccgtccctactaaaagtgcaaaattagctgggcgtggtggcgcatgcctgtaatcccagctactcaggaggttgaggcaggagaattgcttgaacctagaaggcagaggctgcagtgagctgagatcgtgccattgcactccagtctgggcaacaagagcgaaactccatctcaaaaaaaaaaaaacgaatcttctaatcatactatgtaagtatttcagttaattatgacttgttaccttgttacagtgtatacactttaccaggtcatatataataaaaccatgaaattaattgctatatagtagcccactgtatggctgtttactaatttactgaacaatttcccatgattatctatttcttctttttatgataaatagcaatgtaatgaacattattttatcaaatacatattcattcaactaataacttttgagtcccttctatgagcatgtgcctaggaaatataatctttgttcttaaaaacttatagcagcccagatgtcataaacaccaaatatcagtgactctgacatatttcaagacacccagattgtgaaaagaagagaggggaatattctcaaaagtttgttaaccaaaggtaagttcatgcgagacctttaaaccatattaagaagttccaggactggcgtggtgactgacgcctgtaatgccagcactttgggaggccgaggcgggtggatcacgaggtcaggagatcaagaccatcctggctaacatggtgaaaccccgtctctactaaaaatacaaaaattagctgggcatggtggcgcgtgcctgtaatcccagctactcaggaggctgaggcaggagaatcgctttaaccagggagtcggaggttgcagtgagctgagattgcaccactgcactccagcctggcaacagagcgagactgcgtctcaaaaaaaaaagaaaaaaaaatatgcacaagagtgcacaagaggggtcactgagaaatttaactttttgcttttgaaaaatcatctttgctccaaaggggaaaaggaatctgaactgtataaacttgtgcagagcaggctactgctagcagctacttatgataggatgacataaaatagggcactgaatgatatttcggaggtagacgctataggatttctggatccactgaactgaagatgagaaaaagagtcactgaatgttaaggctaccgaaatattaaggaagtgaaccctctgcctgtcacatgtgactcacacagctcacgttctaaggttttgcaggctgtcattgtctagtgcttctccactgtgagacgagttcacttcctattccacaaactgtttttctcactgtttcaaagggagatcctacgacccattgaattttatatcactcgtcttataattcactgttgtatcaccagtgcccatcctcccagatatctggtctgcaatattgcaatatttgaaatttttcttttttttttccactcatttttctcctccaatctagtcagtaaaaaatcttactaaatcctggcaacctccatttttttaaactcatttttgctccaaccaagtcagttaaaaatcttaccaaattttagccactggcctctgttctgaggactcctatgagttctgtacttctataaagtcttcacattttgtggggcaagactctgacagggacttctaggcagatgcacttttaaatacaagtcatggtttctgtttaacagtatattacacattaaaacaatcatgagatacactatacaactattagaatggctaatatctaaaaaacctgacagtaacagttactgtcgaggatacagcacaacaggccctctcattcactgctgatgggaatgcaaaatggtatagccattctggaagactgtttggcagctgctttagtatacaactaaatatagccttactatgctatccagtctttatactcctaggtatttacccaacttatttgaaaatatgttgacacaaaagcctgcatgtgaatgtttatagtagttttattcattactgccaaaactggaagcaaacaagattgccttcaaaagatgaatggataaataaactggtatagtcatataatggaagattattcagccccaaaaataaatgagctatcaagccatgaaaagacatggcttaaaccctcattactaagggaaagaagacaatttgaaaagggtacataccgaatgattccaattgtatggtattctagaataggaaaactatagagatggcaaaaaataaaaataaaaagatgagtggttaccaggggtttggaaggaggagaaaagggttgaagaggtgaaacacagggcaatttttagggcagtgaaactattctgcatgacactactcatttgtcaaaacccatggaactttacaacacaaagaatgaagcttaatgtatgtacattttaaaaaacatttaggatagcaaggaatctgaggatgaaatgccagatgtggcaaagcaatctaactgtacaaaacaacctcactgaagaaggtgagaaaagaaatggtgttctaagtaactttggaaatgaatggcgattgcaagactaaagggaaaataatcattttaatcattgtgatttaatcaatgatgttgtttcccatggaagcatgggttaacgactgtgatcttgctatacttctctactgtcactgaacaattaagtaaaaggatggcatgtggtttgagccaggtttctcatatttggagtaggcagatacatttaagcaacaggaggagaacagaatgatccaggaggtaacagactagagttggacacatcactgtgaactgatatatagctttgtacagatacagatggttgaatacagaaatattcataggtaatgtatatactcagattagtatacactcatatatttatttgctatatcaactgacagtctaaaaacaaggacactccactagcaacaagcacatctaccacccttggtttttaatagtattcttcaataaaaggaatcacggctcctggaagaaatggctgatcctaagactggatcagggacatgtaagatgagttcagagaacctcataatgccagaaaataaggaagtacaaataaataaatgaacaatgaatgaatgaatgaatgaatggaatatgtcaaagccactcagtagcccctttgaagaaagctagaataattggaacaacaaaataaatatgctagcattggatcataacataaagtataaaataaatatccatgtgtctatactaatataaaggtttgaataaataagtaaatggggagaaacaacaaatctcccatgcagaattccacgtaactcacatagaacatagatccaccagccttaaaaagtagagtatattactccatactcaagtggatactgtacattgtgacttccttccaattagtagagtatagaaagcaggagagagcaactttacaatggagaaatatgacaaacactgtctcagctaagtgagcaaggtcaacgtcaataatggtcagtcatgtcaacagtgtatacactaaccctatcagacagattccaggagagggacatcctataatatgactgaccaatactcctcaaaactatcaaagttattaaaacaaggaaagtctgagaatcttccagagtcaagaggagcctaaggacacatgatcctagaagagacaaaaagacattagctaaaacctaggaaagttggaataaagtgtggagtttagttaataacaatacagcaatacaatgttgtaattacaatacatgtgacatagtaatgtaagatgttcaagatgttcagatgagggacaactgggaatgggatatatgagaactttgtactatcttctcaacttttctgtagatctaaaactgcacaaaaaattatcttaaaatgtattttaaaatgcattatatatctaacaatttaaagcaaataaaatcaatagtaactaacgctcactgcccacatgtcactctaaatacagaatactacaagaactttaaagtgatcagagatgtcatagtatctaatttacatttaataaggtagaatatattcaatcaaaatttgtttgaagatcttttggcactgccattcattcatttccagggttcatttcctgagccagccatctacaagcaatgtgcagatctaaaacataatatgggcaatgtaaaaacctgggtaagttctttagcattctgggttttggttgccccatctaacacatcagggttgtaacagcacttatgtgcacattggggaaatctaaaaagttaatatatatttatatatataacactgagaagggtgcctacaataatgaacataaatgttagctatcattatgattattttgatgatcatgaataattgatcttaaaaaaaagatgagcagtacttgctcccataattccacttttattaagcaaaaccatgggcagggttgaggatagacagtgcactgctagtagtaattacatttgagtggatggatcataggtgattctctttttctttatgttttgtttttattctcaagttgctaatgggtgtgtattcaattataataaaaataaatatttaacattctgcgtccatttgctacatgagatcaatgcttatatcacccctgcttaaactctgtattattaaaataatacatgcacatagtcaactgctaaatagttcaggaggatttcatattgaaaaacaacttgttccttcatttctttccacacttaattcctctggtactgctggcaactttaatactttcctatttgtgtttttccccttggttactcccatatctctaaatattagacttatataaagaatgcttgttgtgtccaattaaacattatcttttgactttagactacaataaataaggattcagcttgcttaaaccatccctactaccttctgcctcccagattttggtacgtacatcataactctaagtccttgtgttgattaggtttttaacttacgtgatattcagaaggctgcttttgcccttagtgttccacagtattacattagcaaatgtgctccacactcccaatgtcatcgagttcaaaggaacaggtgtatttaacacagagttcagaattatgatcaacgtggtagaatttattggcaatctggaaaaaatgtagacttacatctaatacaaccttagaattgtgaactgtgtgatcattacagacttaggttttcaaagcccactctaaaacactgtgtacttcctctcagaagttcaccatcgccacgtactaagacgcacggacagaggcataatggttctgtctgcatgttcccacaggcctacttcaccaaaaggaaatgcatgacatggtttgtttctgaacatatattaaaacagccatctattaaaactgctaagcctataaattaacttatattattaatgattgtgtttgagtaggttatgtactgttcataacagtgattctcaccctcatattgtactctgtacaaaagaagtataggaaatatagtctatcagtaatagtggctccctacaatagaacttctcatcagatggagggtaccacaagacatatgagaatttgaatgggatggcataagcactgaagcctcaaaataagtcctacttctctatccaaagagattctgctacaacttctaaaagcatatggccacttccttccctgtcctcaactgtaccacaccacattaaacatcacagatttaaaccataatgtgaagacttacagtcattggaccataactaaacatactttattcacttattgccatatatttaatgaactcccaccacctgcagatgacggtcgaggagctgagagcccctccctcaagagcacagacagaaactgctatgctcacagagctgacagtctagagtggggaacggacaaacaaacaggcaattacaacacagagccatcaggacaagatcaaccattacttaaactaaccccaactttctctgggaattctttaatttagaatcagatcttctcagtgcttttctgcagctcttggtctgcaagcagtttcatgccaactgctctgaagtgcttttcatagctgccagaagttgatttctgttacaactacatggtttctattttaatattttccccttctagttggtctcacccattgccttggattctcctgcatctgctttctttcttctctctaccacaggcagaaactctgatagaaatacacatcacattcactagagacagcaatgcaaaccaaactttctacattttcctaacacagtaatgtttctctaagcctgtttgttcaggaccctactattttcttagtaaaaacaacacagtgattaaaaataagttttattgtatttattatctgaaaagatattgaaagtggaaatgaaaatattgacaactgcagacaaaacatccacgatactaagaaaattaacctgaactactaatggaacaactccagctggaatggaaagctgtgagaattatcatcgctgaggctgcatggagatacttcaatatgggcataatgggaagaaaattcttgggatataattccttggtaatgctgcaggttgagcattgcgcaaaattctaaatgtacaaaatgtgaaagcacaaatttctccttgtaataaggatgacaaatgtggatgttttcataatcaggttttaactattactaccttattttaagattctttggagaactgaatatcagattctagttgagatatccatttattctaggattccattgattgtatcactttcaaagtgatgtaaagctaaacataataaaacaggatataaaagatgaattttgggagactcttacagagttttcaagctccaaattctaaaagcatatgcatgtagcaatacattggtgggattctaacttagtcatctttacttagaatatctaccaagaaaattattttaaaactcaagacatgttcataattttattacctaactgaatttactcactgccacaggatagccataaaccatgaatctaacaaatgatcaacaaagagtaagtcatggtggaaattcatatgtcattgtcagggagaggaataactgagtcagggcggaccacaggtctccaaatagcaaagggacttcatcatcatcgccaaatattgatttatcaccaggcataaacaagggaacaggtaaagctctgttctataccaagacatagaaattggtcacagctcatcgaagggtcacagtttagtagaggagaaccaaaaaacaactgtaaacactgactagtctcttgtcaaatgcatggtgcagccagtgatgattgaaagggtacagggcatctgagaagtcactgcggtcctattgtaaataattattttatcaggagagaggacttgcagcagttctcaatggaagagcagaacttaagaaacaatcatgtctataaatgctggccttgaaaatcccaggctaaacatatcaaagaaactatcagtccctgaagcaaacatacagaacctgacaataccttactttttaattattgagaaaaccatgtccccggacaaatctgacatcttaaatataagaacttatatgtaagactatacatgccaacttgaatgtgacattctttaacatattaaatattagcatatactatgctatatttttataggaaaaatccatatctagtatctactatagtagttttcaatggtattaattttgctaaagttgacatctgagctaccacgttaagttaaattgctaagattatgacgtaagctttaaaagtaattaacaatgcctgtgacacagaccttgaaaaggaagaaagggcttcatgaaggataattgtagaatttgggatgatattcataattttttcaaggatttactatagaaaattactttttaagcttaatcttgaaaagcaatttgataaattataagaaaacattgaaccattgcctcaagcaatgttgtgaaaattaagtgtgcattgcattaaaagtttaaatgtggattactactttttaacaaatgttaatttctaaattaaaaatgatcacgttttcctcttactataaaaattatttgcaattatatcaattgtggcatgtcagaaaaatcattatcttgaaaaacaactttgtttctaatgcttattataaggcatgattgtaatttggaaagcaaagcaattactggcatgtgtacatgggtgtatgagtatacaggtatgctattgattaaaatgagaagcaatatgcctcttaaattagctaattacgcattgtcatactactttaaatttgagcttaaaatcctagggtaagttaggcaacacctggtgtcggcacttaagggcctatttttttaaaaaaaaagacagactttatgacatgcaacagagaaagtggtacttatgtctatttccataatgtgatattttacatatcatctgaattttactgtagtttgtgctatgagttagacatacttattccacattaagccataagaagtcatcttaaaagtgaaatatttgtatttataaaccactactctacctatataggattttatcttcagcccacaaatattcattgagtttcctaggaaccagtcactcagggtctgtgaaagatgctgaggaaactgaggcctgatggaattgactgcactgctaagctaaaatctgactctgaccgtccaactccaaagaccaggctctttctatagcaccaccatacagcttaatggagaactgggcagacagaatgaagtacagagaatgtggttaaatactgctgccttggggacttaaaacaccacctcccgtgctcggtataatgggatagtgaaacttcatggccattctgatttccctgattgagtgtgcatatatctaacacaacttacccattccacatgagatttctttaaagattatcatgaaataaggtgtatgaacataaataaatccaataggctagtataaattctcttggataaggcatgatattgtaaaggtgtcaaaattttccattttgtgcatttaaaatttagatccatccaattccaatttgtttagacagggtccaatggatgccctagttttatattactcattgcttaagtactagagagtgaattaagcttctgatctattttcattttgatatttaaggatcaaacagaacaactatacatgaagtccccatttccataatgggagatcagcaacatcacaggatactgaattctaccgttgctttataatgtccagcttggcagctcagattctttctagacactagatctacaggtaagctgtttgttgttgaacagcaggaactaggcaatgttttagaagtggcatcacatggcatccagagaaaaatatggaagtgctttatgatgatttttaaagatttttaaaaaatcattattaaaatggctatcctcataaacttcaactgccactataacacaaaaaaagcatactgccactgtaacataataaaaacatggtaatgtagccatcaaatatttattaactttctaccaaatggaagcactatttcattcaaggttccaaatagtcaaaactccctgtccttatgaagcttacctttaaaaggagagaaataaaccataaacacaaagaaattagtaaaacacagatgtcctgttgtgcggggaatatcaaagcagagacagtgaatagcaatcgctgggagaggtactgctttttcttgcttttccagctctatttttaatcttaagatgaattagaacatttttaattctgtgaaaatcagatttttggcataagaggtcagtttcaaaatagatccaaatgctttctattctttcataactgcaagccaggaaaccatcctatggctgacatggcatgacccctatttaccttctcatcctcttattccaaactctccccagtaacagacactgtggagttctcccagcatcaattccttttctatcccatttgttaatggccatgagtttgcatcgaattgcttggccaccacattggggcagtgatggggaggtacgctgccccatccattgttagaccccatccaggtctaaacaaatacaagcaagttgttggatttcaggaaaataacagtaaagctgagcactttcgtttgatgattaaagaaaaaaggttcctttctccaaacaatatatttgaaaatgtgagattcaaacatagtagcctttgttttctgataagggaagacagcctacaatcaagctgactcttaggagaggacacagtgctgggaaccacacaaaaaaagttactggagcccccatcaaagcatgactaaagcccacaatgccaggacacgtttccatgtcaaacaaaaaattcccaccattaattatgtgttcttgcctgctttgtgtatgcaaaagtaacccaaactatcaccccccacacacatactcatatatacaccaaaatctactcatataatcgggtgtgttttagaatcttatttgtagagtcatgcactgcataaggacatttcagtcaatgatggaccgcatatatcaaagtagtcccgtaagattagaataccatatttttactgtacctttgctatgtttagatacaccaatacttaccattgtgttacaattgcctacagtattcagtacagtagtatactgtacagatatgtagcctagaagcaatgggccatacaggctgtaccaactacttgtgtgtaagtacactccgcaatattcgcataacgacgaagtgcctcatgatgcatttctcagaacgtatcccagtcattaagcagagcaggacttaccacagtcttccggaacaaagtgaaatagtatagttgtgcctcagccacccgaatcttggaatgttttcacagtctgaagtgttctctgttcattttttttcatttcggaagcctgaataacaacttcccccaacacttgttatggaaatgtatcaaaccatttctgctcctaatttggtcttgtacaagctgaaatgcatatccaaatatccttagcaacagatatttttggtgatacatatatctcattctaagtcaacatcaactttctaaaagagtccacatctgttttaaaacaaacactttttttattatctatttatgtatttatttagaaattttttgtagagacagggtctcgctatgttgcctaggctgggcgcaaactcctggcctcaagcgatccttcagcctcgacctcccaaagcactgggattaaaggcatgagccaccccactcagcctagaacaaacatttaaatcagcatgcatgtaactgacaaatgaacaagacgttaaaatgatgctataattttcatgctttaccacacggctactgatgggcacacttttaatactccaggtaaatcctgtaagaatctgcataatgacttgagaagcataatctattacaactaccatgaaattactaatagaatgaggctattattttaatttagatgcttttttctttaatgtgtatttacgtacctgacatatattttcatcatctatgtaattacatttactttatgtatctattatttctagcatatgtcattgtaacaataatggaagtcaaatattcaaagttcaattaagttgtacctaaaacatattaaatcatgccaatgtagattttttacataaatataaaatgcatctgtattttgaaatggaatgtatctttgtgtatctacagagagcaatcatgaatctcatatataaaactgaaggcgtcttgacattacagaactttgagtccccagtggacaaacatctaattaaaacatgtggtagaggacagcagctcaagcccacatgagtgggatatcactgatggacgtattaacactgtaatagactgctggtttaaagagttctataacactaaagcagacctgtctaaaatttactttaaagtttgcaagaaatggtgacagcacatgtggtgagccaggttggagagctgcaaagcacacatggaaaaggaaagtgagtggctcctggccagctgcaaagggaaagccagacgcagagagccaccgttggttaacgctaagctactttcaatgatttccaagctgcagtttttaatggacaaatatcaaggatcttgctagcaatccctgggtttcactctgaataggactctgcaatgttgcctaaagataaagaaagtgttctctacttgacaaaataaaataaaacatcaaatgaaaggatagcagaatagcaacatatttctggttgtgagactacaatatagattgttgtatgtaagatttctaaacaagagaactgagttgatatttccattatcatgatcaataaaagctaagttagaattgaccatagcagatttaatagtttcatattttagtagtaaatgcaatttaaagaacttatttttaagatcttttcttatttcataagattctcattagtgagaattttgtggatgccagaatcctacttgctaaaggaattatatctacaaattatatctaaacatacaaatccctacaaaacagaagttcattaagagacaacagatatcactaagaggtaatatataggcagatatagaaattatgtgaaaactgccatgaataaaatgaaaatggaaaaggagtttaattcaaaaaccatagagaaattagaagtttctgtaccaatgaattagaattaacattaaatgttaattaaaattaacgttaatgtggaattttcacctattttacttacttaacatatggaacttgtagaaaatactgtcataattatgcctacttttagaattataacaatagcaaaagcttatgtgaaagatgtcatttaataaattgttttaaccaattggcagctattaatgaattttatcttataaaatcctcaggagactcaaactgtgttttatgatttatgattatgatcagttgttctctaggctacataaacaacattaatggattataatcccaaggggttttttttctatataattctattaagtagtaactactacacactgttgcacaaaaccagtggtatttcatgatagatctcgtaaaatcaagtatgccattcaagtaccagcgcttgtgccagcagtttgttaatacaacaggatgaagagtagggttcttgttgtgtaagcatttcagcaaaagcccaaacaggttcacattctcaggagcacagctgagagcagcgaccatcagcctcccccaagacttgccaacaggtgggggattcagacacccccaagacttgctagcaagtggtggctctgttccttctaactttgtgggagcagagaaaaggctcctcctcatcatctcatgtcactgataaggtctccaagatacccactgagatacatgggagtgcctgtgagcaaggagacagcatctccttgtcccgtggccagctgggctgcagagcccacgagtgtaccctggtatccagcacagaacacagttggagcgtgcctgtgagagcctggcaagaggccctggtcctgggacccactcatgcacctgggggctgccacttgcctcctgtctggagaaacctacaaacacatgcagtgtggagcagccaccacgcccagggcgaggagagaggatgtgaatagattacgtaagctcctttctttggtgagatcggtcagtgagtatagagttcccactggctacctgaacaccacaaaagagaactgagcttgaaacttttcagagagatcctgtccccaagggctacctgctgggacaaggagaacacagaaaccagatgtggttgggagatcttctgtgtgcagcaacagtttgagagagggagtcccaaggctgtgtgaccatgcaaacaacatgcatcagggtctacgcagaacctcagaaaaacgcaatagaggggccgcagtcagcatctggggtgcctgtggttggctggtgttagcataacggtttttccttaaggccctctccccttgctccagtaccagagaagccaagtgcagagcaggtaggggagggaagagagagagagagggaagagggagagggggggaagagagagagagagagagagaggaggagagagagagagggggggagagaggggggagagagagagagagaggaggagagagagagagagggggagagagagagagagaggaggagagagagagagggggagagagagagagagagaggaggagagagagagagaggaggagagagagagagagaggaggagagagagagagagggggggagagaggggggagagagagagagagaggaggagagagagagagaggaggaggagagagagagagaggaggagagagagagaggaggagagagagagagagaggaggagagagagagaggaggagagagagagaggaggaggagagagagagagaggaggagagagagagagaggaggaggagagagagagagaggaggagagagagagagaggaggagagagagagagaggaggaggagagagagagagaggaggagagagagagaggaggaggagagagagagaggaggagagagagagagaggaggagagagagagaggaggagagagagagagagaggaggagagagagagagagagaggaggagagagagagaggaggagagagagagagagagaagagagagagagggggagagagagagagagaggaggagagagagagagggggagagagagagagagaggaggagagagagagagaggaggagagagagagagagaggaggagagagagagagagggggggagagaggggggagagagagagagagaggagggagagagagagagagagagagagagagagagagagagagagagagagagagagaactagcgctggagtgagccagagccagcggggtcagcatagcaccaacacaaccccattccccacaggtcaggccaacgggagggaaggagaaaggtagtgaaggggggaagcggaggggacagctttgcggggcagctgtggtggaaattctgaatcggatgagacttaagacataaaagccgtgtggctgttaaaatcagactgtttttatatgtggaagggcatctccacgctctgtctccacaggttacggcggggatgggatgcgagtccactcacaaagtgagaaaccatggttcagctcaatcagggctcagaatttatgttgaacaccagcagaagcatatttttaacacttaaggaaaacacgattataaaataagaaaatgaatgcttgggaagaagcacataatctgattcggaaatggcagatacagactcaattacaactccaggcaaaacaatctcaggggagtttcaaaatgccatgaagtgaagatacgtattatgaggtgtttttttttttttttttttttttcagttctcctccatccaatatcaaagccgcacattatatttcttttcagagcatagaagtgacgttcatttggtaggttctacaacacatgcttactaatacgacagtgcggaaatcaatcattaataatcttgaaaaattaggaaggaaggaaggatacacagatggaaaaaaggacatttattgattatgacatgtctagacattatcataagggctttgacaatatggtaatgcccatgaattaattcattaactaaatgcatcaactcatatagcggtgatacccgtgttgcagcgtttacatcacacggctcatgactggaggatttcctttgacccaagcagcctggctcctgtatatgcgttttttcttcttttctttttttttttcctcgctgtcacccaagcaggagtgcagcgatgtgatctcggctcactgcaacctctgcctcttgggttcaagcaattctcctgcctcagcctcccaagtagctgaaactacagctgccaccaccatgcccagctaatttatgtatacttagtagagacgcagtttcaccatgttggtcagactggtctcgaactcctgactttgagtgatccacccaccttggcatcccaaagtgctgggattacaggcgttagccaccgcccacggccctgtatgtgcattcttaaccgatatgccctattgtatccaagtggcaaggaaatactagattaagcaaattaaataagagtacatcaaagagtctacctaagacagcatatgtcacacatccaccaggaaaagctcctctgccaggtaacatggagccctcactgtgagtaacatggtcaactctggttttggattatagcgggtttcctctcctcagcaaagagttgtggctgtggaggtgatgagtggagggaagcaggcaccatgtgtctcaaagacctatttgttttccttttcagaacctgttgagaggcttataagtaggctttacagttttttctttcctcttagattgctggttccttgcaggcaggggctgtgcactgctccttgaagatcttaattgaaacagtatctgtacagtagacattcaataaatacttcattaatactaaacctggctttgcaaatgtgaccaaaggaggtatatggaatttagaccacactgtaatcccagcactttgggaggctgaggccggcggatcactggaagtcaggagtttgagaccagcctggccaacgtggtgaaaccctgtttctactaaaaatacaaaacttagccaggagtggtggcgggagcctgtaatcccagctactcgggaggctgaggcaggagaatcacttgagcccaggaggcaagaggtggcagtaagctgacatcactccacttcactccagcctgggtgacagagcaagattccaagacagacagacagacagacagacagacagacctctttttattttcttaatgaagaaaaccctgcaaaaccttaagtaattttctttcctgacacttatggggaagcaagactagaccagtggatccacccctgttcaggctcagtagctgtgacagcagcaactaggatgtcactattttcctctccttttgggtcttcctaaagacctacttagcagtgggaaccagtgcagagtctaggccaaagtaacttttgccgcctctttcactgtatagccctgttgccagggacatggaaatactcttggcaaactctccaggaatggcctcagcagaatcctgggccctgtcttggaagtttatgatattccctgctatggagtcctcagggtggcagaggagctctaaacacaggcctccacactgcctgcaacagtctcagaaggtatgttagtgattctcttcttgcaaggtggtatgctaagcaagctcttccctgactgctaaaggaagagccctcaggagcactcagcctttagctttctcctgtattccaatccctgtctttcaggacttgtggttggaagagtagacacagggtcacatgtctgactgcctgcttcccccgtgtttgtctcccctctttccaacactgtcaaggaaagaaaatgtgagttccctggtactttctgtctgagatggactcagatacgaaaccccatagcataacctgttaatcatggttattgacacagtctatgggaggcaaaagaatatgggaaatcctgttctaactgcacattccctgccatttatgtatctgtcaagttaaaaggttaagaatgtcaacttgagatccaaggctgcctctttaccttgggcaatgtctaatatttcactccatgggactataacccttaaggctcaaacttagaagaagaatggtgccggggaacacgactggaggtaaaaattaaaatgcaatactttaatacttagaaaatagtatccatattgcattaactcctgctccaaagttaacagaatgccctgtattcacattgcagagttaactctatggtgaattagtaaaatgactatagtcccagctcacaaactaagacgtgctcatgaagagttttacatattaaaatgaaattctcttgactgcttaccctatgttaaagatttcctttatgataatttacacaactgctccaaatctgattttcttttcctatatggactgtaaattaatgtgctgctttgataggaggtctcctgttaatggggaactcaataattcttgctctatgtctgttgaacaagttgagtaaactctttgaaacttcaggtactgcaggatgtgggttttaaaaggtgcttgtgtctgcacttgaagtaatgaaaggttcatttcatcccacaaactaattggcaattgtctgttactactaggattatcccggtaacagaaattatttttaaagataaattaagctttcagagggattgacaattcacaaactagacaccactggtcaaactactaatgtccatggtattctctgatgatgtcttgcacatattatgaaacatcatatctttaattcacattgattttttggtaaagaatattactttctccaaatgttagccagttatcaaaatacaattgtctgtaccttaaactctgacttctaacatacaatatatccaatataaacttaggtctaatactcatttgtcagaactttttgaatataagcttattcgtgtcatcttatgtaaatttttattttaaaagaaacatagggaaatactgagatctagctgatgttacataaactgaagtatttaaatgtgtagtctgtacagtgtacttcgcttcacaacttactctgaaagcaccaacaatgaattgatggaagagtaaagaaatggcaaagtgtatcaatacatgaaagaattcatagagtaaattgttacctgcacaatctaggtgggagaattctttcaacatttctgtcgctttaagggtttcataataaaatgttgggaaatttatttcaaatccttcatgaagaataaaatagcaaaaccaaaaaaaaaaatttcatctgatcctgaattgtataatctcttcaaatgacctgttggttgacccctgtgtcagttctacactgttctaactgcccagtcttctttataggaaaacttagcatctggcaggccatgttccccactgtaaatcactttcagaaattacttctgagagaagtgtcaatggcaatggcctaaaatcagtataagagagatttaaattcgctttgttttatcaattagaaatatgaaaatttctatttagttgagaaaaactaaatcaattcgatttcatttactagtgttattattttaacaatttaatttagtactccatatactgaaaccatttcctaataaaccaccagcccagcaaatatgtcccccaaataagtaaactacacattcagttcagtaaggatgcattctgagtttttcatcaatagaacaggattcctcattctttaagtaatgatatgcatcataataatacaccccatctatgtagcaattactatgtaatagtactatattaagtggtttatttttattatattaggtaaattgtaaaaactatcaaatataatgtcaatattatcttcatttgaaaaagaagaacttgagactcagagatataaagttaatgacagaacaggaatgtgagcaaactcctatcctgacctctctgttacacctcttccattaatgtggcagtaactgtctatcagtctgtatctctactgctatgttttggagagttggcataaattatggcacaatagtaatacctttggttgagaagaagttttagtgacatggtaaaaacaatgagcagtgtatgcgtttcaaattcttcaaagcaattttaagataaagaactttaatgactccagcaatatattcaaacaatacatggtatgtgtaacaaatgagtactttattgtggtaggcagtctcaaaaacagtcccaaataatttccgcatcctggtattcacggtcttctccttgaataaactccctctaatcacacaacaacgttgatgggattatcattaccacaaataagttataaaatattgtgacttccatattgatagtagtccctctctagtgctgtttgactttcacactttgaaaagtgagctgccatattggagagaccagcatggcaaggaaatgaaggagacctctgaccaaaagtcagttaggatataaagacctgagtccaacaatttatgagaaactcaatgctgctaacaaccactaggtgagaatggaagtggatccttccctacgcatgttttcagatgagactgtagatctggattcaggccttgtgagagattggcaaacagagaatccatctaagccatgtccagattccttacacacagaaaccataagataataaatgtatgtcactacagaccactaagtgttagagcatttttgttatgtaacaatagataattaaaatattcaattgcctgttaaaattactcaattattgtagccattgataatttacatttaactccaaattccttgaatccatattcagtgcatacttttaatattcatgtcaacaattaaaatatatattcaacaataatgagaattatattcagaagtaaaacactcaataaatgaggattaaagacctgcacatgggaaagatttcaagttctgacacttcatgtcttccaaaagactaatgaaaagatgaaattaaacaaaaccactaatgatgcatgcaattttttccaattaacgagtttgtggatttgtgctgggtgtgcgttgggaggattactacagtcaatcacgaattgtattgactcaaatttgtactcaaatattttcaaagaaaatgtctcagtatttattttttagcttgattctgaaagtgtaacagccactgttacaaaaacacactggtggccaaattgttaatcactgaggatattttcattgctgaataatgataaaaacgtaaatatcagtcattataaaactttcagatttttagctgttatgcagctcatttttattagccaaattgatggtatatgctatacttttttatataatattttataaggcaatgttctcacattagtaaatttaagggaaaggtattattcatgctatgtaaaaggtttctaggccattaggtaccatggtaatatcatattgtacagtagtactttaaaaatcaagttttgaggaaatatgaattttatccagggaaatgcttataataaaaagtataatataaaatgtgaagctcagctgggcacagtggctcacacctataatcccattactttgggaggctgaggcaggcagattacttgaggtcaggagtttgagaccagcctggccaacatggtgaaaccgtgtctctactaaaaatacaaaaattagctgggcatggtggcgggatgcctgtaattccagctactcaggaggtaggggaatcgcttgaaccggggaggtggaggttgcagtgagtcatgattgcaccactgtactccagcatggcaacagagtgtctcaaaaaaaaaaaaaaaaaaaaccatggtgaaactcaatttaaatactgataaaaaattaaatgtttaaaaaattattagacttcttgttgccatgtccctcagtatccatccaggcttaaactaagtgagttatacataaataccgcattggccaatgagaatccattttataaacatccatagtattacgtcaaaaattcaatcaacaagtgtaaaacacaaccctcttctccacacctttgctatagaaaacaaaggcattaaaggagcgtcagcaaatgtttcacttcaggcctgatgcaggagacagcagtggcagtggtagaagcagaaagtgtcccttcaggagggagatggggaggaaatcctccaactcaccatgaggaagcaggaaactatccactgcttttgggtaaagggtagaagcaaaagcaatctgcctctaattgaagggaaatctctagggctctaaattcctcagtgacacaaagcagaagtcagctaccattaggagagatacaggaaactctctcctacccaagaaaaatcagagatgccgacgaggtcctaaaccctagacctaagaggataggttctgtaaaactaaatctagacttggagaatcctgctggcacccatcatgtctaacactgaatcataagccacaacactttacttctgaggaaggataagaatgcagagaaagacacccctctgtggaacacacagtcaagtactgtgtaagagaatagggtgacagaagcctgaacaattctgtcaccccaaacagagtaggggaacaataatagctgcaagataatcagagtgcatcactgtacacatctgagcctgtagtgaactgaggataatactagctaccacaaaacccaacccagctaaactactggattattgacttatcctccaacactaacagactcacaaagattcccatttccagaggcatatagtatttacctttgattttgctgttcttccacaaactcaaaaagaaaaaaaactaccaggaaataaaaaaataaatactaagattcagaaatgatgcaagtattgaaactatcacataggaactttaaaagaactacagttaatatagaagaggtgggaacacgcacaaagtgatggggatataagcaaagaaataaaactataagtaaagaatgaaacacttatgaaaaatgtgaaaataaaaacacaacaacagagctgaaaagtaccttatcagccttatcagcacaaaagagctgaaaaaaggaggagtgaatttcaagataactcaatacagattatctttaaaaagaatttaaaaaattaaacagagcatccaagaattgtggaacagtatcaagaagtctaacctatgggtaactggactcccagaagaagaggaaagaatgaggcagaagaactatgtgaagaaataattcctgagaatttccaaaataaatcaagaagagacaacaaaccagagactatcagagaacattaaagaaaatgaataataatctaacaatcctgacccatcataattctgttgcttttatcattattaataatattattattaatttgcttttgctgaaaatcaaagataaagataaacttatgctggtagacagaataaaaagagaaagaaatattacctccagaggatgaaagccaaggattaagcagacttttcccctgaaattatgaaaggcaaataacaacgatgcaacactttgaagggctgaagggaaaattatgtcaactaggaattctatacctagtggaaataaacaataaaataaatcaacaataaaaataaattaaaactttttcaggaaacaaatactgagccattttcttgccaacagacatgcaacgtaaggcataataagggaaattctacagagcaaaaaatatggtgacaggagtaaatcgagatatacacaaagaaatgtagactagtagaaacagtaaaagtcaaggtaaaggaaaaagttttaaaattttttaatcatttaaaaacataacgttgacataagcaaaaataataactattattgtggattttacaacatatataggaaaaaatcatagttcagattctgagaaagacaaaacaaaattatactattgtaacttccttacaatatataagccacagtgcaatataatttgcagtagacatagtaaattttatatgaaccaaacacaataaatcctataactactaggtaaaaataaaagaaagagctagactaatatgccaatagtggagataatgtaatactttaaaagaaaactcaattaatccaaaagaatggagaaactttgggggaaaataagaaacagatggggaaaatataacacaatgatcaaaatggttgatgtaaacccaaaatacaataatcacatgaaatgcacatgaattaaatatcaccaaataaaaggctgagattgtcatattatatttaaaaagtgatatccaatctaatatggtcaacataaagccaaatttcaatatattacaaaaatacaaattaaaaataaaatgacagaaaatgataatatcaagtaccattcaaaagaaatccagagtggttatatcagacaagacagacttcaaactaaaaaacaattataaggagtaatgatagaggagtcaattcatcaagacataagaatccaatctatatattcatacaacattattcaaaatatgtaatataaaaatgtatataattcaaagaagaaaaagataaaatccataattattgttggagaattcaatactcccctctcaatagttgataaaagcagtagacagaaaactggccacaataaaagaaccctacacaacggtatcaatgaacatgatgtcattgacattaacaaaacattccacacaaaaatagcagaataaatattatttaaaggacacttggacattgataaagatagatcatattcagtaaaataaatcaaatatcaataaatttaccagaattaaaatccaacaaaacattccctctaaacaaaatgaaattaagtttgcaacttacaacatgcggacatctgaaatatccctaaatatatgaaactctaaaactcaggtgtaaataattcatgggatgtcaaagaagaaagtcaaagcgagattataaaatatttttaaattgaataaaaacacaacatagcatatgtgggactcagttaaactgttgcagtgggcaaaatgtgctgcattaaatccttcggtaagaaagccagaaagattgcaagtcaagaatctaaacttctacccttaataagatgcgaagtaacaataatgaataaaacaaagatagaaatcaatgaagttgagaaaagggaaataatagaaacaaatccatgaaatagaaaagcctgttctctgaaaacaataaaattgatacatcagtagacacatcaagcaagaaaaagatagagaaaacataaaatactgaagtcagggaaaaacagaacatcactacaagaactaaagacattaaaaggaaaataaggaattattattaacaattttatgccagttatctttgataacacagataaaaccacaaactccttgagagacacaaatatctaaatctcactcaaggggaattgcacaacaagtataactttctccctcttatagaagatttaattcataggtaaaatccttcacccaaagaaaacacacaatttgcttcaaaggtgaatattttaaaagaaattataccaattgtatataagattttgcaaaatatagaaggaactgaacacttcttaaatcattttatgaggctctttactcataccaaaatctagatatatagtcattgccagaacagtacagtccaaaactgtaagtcagaagagccaagatggctgactacatgcagccagaaagagcttctcctaccaagagcccagaccagcaagaaaactgacagactctgatatggtttggctgtgttgccacccaaatctcatcttgaattcccatatgttgtgggaggaacccagtgggatataattaaaccatgcgggcagatctttcctgtgctgttcccgtgatagtgaataagtctcataagatctgatggttttaaaaaggggagtttcccggccgggcatggtggctcatgcctgtaatcccagcattttgggaggccgaggtgtgtggatcacctgaggtcaggagttcgagaccagcctggccaacatggtgaaaccccatctctactaaaaatacaagaataagctgggcatggtgggaggcacctgtaatcccagctacttgggaggctgaagcaggagaattgcctgaaccctggaggcagaggtgacagtgagccaagatcatgccactggactccggcctgggcaacaagagtgaaactccgactaaaaataaataaataaatagaaaaaggggagtttgccccacaagctctctctgactgctgtcacccatgtaagacataagttgctcttccttgccttctgccatgattgtgaggcctccccagccacgtggaacagtaattccattaaacctttttcttgcaaaaattacccagtctcacatatgtctttatcagcagtgtgaaaatggactaacacagtaaattggtaccaggagtggggtgctgtgaaaatgtggaagtgactttggaactgggaaacaggtagaggttggaacagtttgaagggctcattaggcagggaaattgggaaagactggaacttcctagagacttgttgaatggctttgcccaaaatgctgataatgatatggacaataaagtccaggcagaggtggtctcagatggagaggaggaacttgttgggaactgaagcaaaggtgacacttgttatgttttagaagagactggtggcattttgtccctgccctagagatttgtggaacttcgaacttcagaaagatgatttagagtatctggcagaagaaacttccaagcagcaaagcattcaagaggtgacttgggtactgttaaaggcattcagttttgaaagggaatcagagcataaaagtttgaaaaacatgcagcctgacaatgcaaaagaaaagtaaaaccccattttctgaaaagaaatccaagcttctggcagaaatttatataagtaatgaacagccaaatgttaatcaccaagacaatggggaaaatgtctccagggaatgccagaggtcttcacagcaaccagccactcccatcacaggccaggaggtctaggaggaaaaagtggttttctgggccaggcccagggtccctatgctgtgtacagcctagggacttggtgccctgcatcccagccattccagtcatggctgaaaggagccaacgtaaagctcaggccatggcttcacagtgtacaaagccccaagcgttgtcagcttccatatggtgttgagcctgccagtgcacacaagtcaagaattgggatttgggaacctccaactagacttcagatgatgtatagaaatgcctggatgtccaggcagtagtttgctacagaggcagggctctcatggagaacctctactcgggcagtgcagaagggaaatgtggggtcagaggccccatacagagtccctactgaggcactgcctcgtggagctgtgagaagagggccaccatcctctagaccccagaatggtagatccactgatggtttgcaccacacacctcgaaaagccacagacactcaaagtaagcctgggaaagcagccaggagggaggctgtaccctgcaaagccacaggtgtggagctgcccaagaccataggaacccatttcttgtatcaacatgacctggatgtgagacatggagtcaaaggagatcattttggagctttaacatttgactgccctgctggattttggacttgcatagggactgtaacccctttgttttgacaaatttctcccattaggaatggctgtatttacccaatgcctgtaccaacattgtatctaggaagtaactaacttgcatttcatcttacgggctcacaggcagaagggacctgccttgcctcagatgagactttgaactgtggactttcgacttgatcctgaaatgtgttaagacttcaggggactgttgggaaggcatgattagttttgaaatgtgaggacatgagatttgggaggggccaggggcagaatgatatggtttgattgtgtcaccacccaacaatcatcttgaattcccatgtgttctgggagggaccctgtgggaggtaattgaatcatgggggcaagtctttcccgtgctgttttcaggacagttaataagtctcatgagatctgatggtttttaaaaggggattttccctgtacaacctctccctttgcctgctgccatccatgtaagatgggacttgttcctcctttccttctgccatgtttattaggcctcaccagccatgtggaactgtaagtccattaaactctttttcttgtataaattacccagtctcaaatatgtctttatcagcagcgtgaaaacggactagtacggactccacgcagatctcccagaggaaggcattgagaggcgagaggaagcagaccctgggctgaaaatggaggaagctgggaaccctgcaaggagctgcagagcacccggactccttacgcacctccagcaactcctaggtaaggagtgagttaaacagacctgatgtggcccactctttccacagacctctggaatcttcaatgtagaaaaatctatttttaaaatatatacttgcaaatgacaattgaaaattaaaataaaacaataccatttataccaccaaagcatgaaatatatagggttaagtgtaataaaatatatttgaagtttattctgtgaaaattataagacaataatgcaagaaattaaaggagagtatgtttgtgtgtgtgtgtttatgtgtgtctgctgggttggaagactcaacatgattaagttgtagattctttccaaactgttgatcttgaaattcaacacaatcctaataaaaattccggcatatatttatgtagaaactaacaagttgatattatatttttgtgccaaattgagggacctagaatagtattaacagaaaaaaaaaaaaaagcttgaaaaagaaaaacaaagctggaggacttatactgcctcaatcaagacccaatatgaagctagagtaatcaagacagtatctttttgacataaaaacagacatatagaatgaggaggaaaaaagagttgccaggcgtggtggctcatgcctgtaatcccagcactttaggaggctgagccgggtagatcacgaggtcaggagatcgagaccatcctggctaacacggtgaaaccccgtctctactaaaaatacaaaaaattagccaggtgtgctggcgggcgcctgtagtcccagctactcgggaggctgaggcaggagaatggcgtgaacctggaggcggagcttgcagtgagccgagattgcgccactgcactccagccagggcaacagagggagactctgtatcaaaaaaaaaaaaaaaagagttcagaaatatttccccctcataaatgagagccactgatttttgacaaatgtattaatgtaattcactggagataggaaagtcttcctaacaactgatggtaaaacaactggacatatttttgtatataagcatgaaaagaacctcatatcacttccaaaaacttcaagttaatcatagatctaatgtaaaagttaatatgtacgagttctagaagacaatgtaagagttaggcaaagatttcatatatatgatgcaaaagggaggcatcaaagaaaaaatataaaaacaaaacttcattaaaatacaaaagctctggccgggcacagtggcttatgcctgtaatcccagcactttgggagtcctagacaggtggatcatgaggtcaagagatcgagaccatcctggctaacatggtgaaaccccgtctccactaaaaaatacaaaaaattagccgggcatggtggcgggcgcctgtagtcccagctacttgggaggctgaggcagaagaatggcatgaacccggaggcggagcttgcagtgagctgagatcgtgccactgcactccagcccaggcaacagagcgagattccatctcacaaaaataagaaagaaaaaaaaaacgaaagctctgttctttgacatatattgtcaagaaaatgaaaagacaaggcacagtctgggagaagatatctccaaagcacttatctaataaaagacttgtatccaggagctaggaaaaaaacaaaaataaacaaataaaaacccttactactctaagaaacagaacaacacaactaaaaaattggcaaaaggtgttaaaaaatacttcaccaaagaagagagacagttagaaaatagaacataaaaagatattcaacatcaatggctgtttgggattctctcccaaagcaaaaccagaatgaaatgctactacccacctactaaaatggataaaataaaactatattccaggctggacgtggtatttcatgcctgtaatcccagcactttgagaggccaaggcaggcgaatcacttgagcccaggagttcaagaccagcttgagcaatatggtgaaaccttatctctacaaaaaataggaaaattagtgggtcatggtggtgtatgcctgtagttcctgctactcaggaggctgaggcaggaggactgcttgagcccagaaggtcaaggctgctgtgagcggtgattgtgccactgcactccagcctgggcaacagagtgagaccctgtctctaaataaataaacacaggaaagaaaaaaaattatatatattccacacagtgctacacagagctgacaaagttgtggagaaagtagaacccttatacctggaatcttggaaatggaaaagtggatggcaattctgtaagagtttggtgtttttaaaaagctaagcatgcaattaagaatatctattccattcctaggcatttacgtgagaaacaaaaacatgtttgatattttaagcaaatgtttgtagcaaatttattcataataactaatgactgaaaacaatgtcaaagtccattaactggagagtggataaacaaattgtgacaaagccacaatgaatactactcagtatttttttaatgtactgtgatgtatgatacaacatagtttaacctcaattccattatgctgagtgaaaaaagccagacacaaaagactatgtatagcatgattctatttatatgacattcggaaaaaggcaaaattacagggacagaagtcagatggggtcgccagggcagggagggtacaggtggtgactacagtggggaaggagggagcttgcagggatgatgaaactattttgtttttttttgttttgagacagagtcttgctctgtcatctaggctgcagtgcaatggcacgatctcagctcactgcaacctctgcctcccaggttgaagcgattctcctgcctcagcctcccgagtagctgggattacaggcacccacgactactcccagctaatttttgtatttttagtagagacagggtttcatcaggttggccaggctggtcttgaactcctaacttcaggtgatccaccctcctcagtctcccaaagtcctgggattacaggcgtgagccaccgtgcccgactggaactgttttctatctcccttttggctgcagtcacatgatagtacacattttgtcaaacttcactgaatgctaaaccaaaacaattgagccttatagtatgtatattatacatcaaatcctgaatatatcctgaaacaaaattgaattaaaaaatgttaatcatatgactgagatcaaaaggcctaagtccaccaaaaaataatcctttgtgggagaggcaggtgagacctaggggagggaatggggtagtttgccttctgaaggagtagattgtagtaaagtgctaaggaaaacagaaccttggggaaataaaataaaagcacacagccaataaaaaagggcttgcattcttaataactgcaccatcaaatgctcataaaaatattaatacatcccccatggtaaacgtatgcatgtaaaaataaatgcaaagtaacatcatagcaccttaccctctcttcctctacccatttatccaagacagctgtaaccagctggtatctacagatcttttctatgcattctaatttttcttccctagataacataacatgccaaaacaagtaattgaacaatgttgattctgaatataaatacaaaaaagtcttcctcaccaaaaaatggtaagtatgtgagggtgatgaatatgttaattaacttgaattagtcattccataatatatacatgtaacaaaacatcatggtgcaccccataatatgcatgttttatttgtcaaattaaaaaaattaaatacctatataaataaataagatgctttcaaagtactcagtaaaactgaatacacaaacacctatattctgcaggatcttgggttgaatatcattgtgaatataccttttattacatcatagaataataaattctgactcctacactgaagaaactagaactacaaacaaaagtagcacccactttcgaatctcctgattcacaggtctttgaatttgccccctttcaacatgatatccctcatagaaaacataggactaaagaatatttaaaagtggatggagccaggtacagtggctcctgcctgtaatcatagccctttgggagtccagagcaggaagatcatttgagtctgggagtttgagcagcctggccaacatggcaaaatcccatctctacaaaaaatacaaaaatcagccaggcatgctggcacgtgtctgtagtccagctactcaggaggctgagatgggaggatcacctaagcctgggaggtggaggctgcggtaagccatgatcacaccactgcactccagcctgagcaacagactgcaactacctccaagaataaaaataaagtggataaatgacgaaaggaagaaaacaatttttttatactgttggatttgattttatcatttttgaggatttctgcatctatactaatgaggagtattggcctgtagccttattttcttctactgtttttgtctgagttggtatcagggtaatgtggcctcataaaatgagttgggaaatatttccttccttctgttttctgcacaaaagcatacactattcaggattgttgttatttcatctttaaatattttgtagaattcacttcaccgggaaaccatctaggcctttctttctttttttcttttctggaaggttttaaattatgagttcaatttccttaatagctatagaattattcaggttacccatttaatgttagtgttggtagtttgtgtttcttgaggattttttccatctcatctaaagtgtcaaatatgtatatacaattgtacatagtattcccttactatcgttttaatagctgcttagtatgtaacgatattcccagttttgttgctagtgtcggtaatgtgtcttctctctcttctttgtcagtcttgttagaagactgtcaattttattgatcattccaatgatccagctctttgttcactgattttctgcaatatttgtctctctttaattccattgatttctactattgtctttcttctgtccttctttctgtttgttttggtttcatttcccatccctcttttcttttttttcctagagtctttagctgggagattagattactgtttaggacctgtccccttttttaatgcatgcatttagtgctatacattcccctttcagcactgctctgcttatgtccccaaatttttgatacaatgcattttaattttcattcacttgaatgtactttttaaatttcctttgagaattcctctttgagccatgaataatttagaagtgtgttgtttagtttccaaatgttgggagatatcatccccctttaaatcaacaaatcaccactccatgttggttgggccacgtcaagaacagagcaaaatgtttcatcaatggaacacgtttttatacataatttataaagtacaacataaaaaagcattggagactagaagagagtgctaaaatgatcatgatttccctagattctaagagaaaactatagaaatgtggagaatatgcttatctgagaaaacttgagaattagagaaccacatactactctttgacagtgactagctaatcagtaggcatggtagggaagacgtgagcacatgatccttctgtaacacattagctccactttcatgacactatggttctgcaaagtctcattctgctttcatttttaaaattagataataccactaaaaggagccaaactaccaaaaaaaaaaaaagattccattagccaaacagacaatttaaagttcaagcaaagaaatgaagtacccataaagaaattctctactttgaaaaaggaaatacatcatctcttatcatgtgctgattagaaccaagaaaaaaaaaactctactttgctaaaaattccataaaagcacaaaattattttaaagtagcctatttctttgctactctgtatttagctttaccgaaggtaggtatattggcaatgaaaatatgtgagacagaaattacaatcacaagagagctgacaaatgacctatgctgcctctgctcctgttatttcagggggatgggatgaaagaaatccaaggagaaaatatccatcgccaccagtggtccaaggcaaaagctccaagcggggccgctctgggaaaggtggtcagcagcagtaaagggaattgccatagagcctaactattaggatatgagaacagaaggggatgtagtttcaaagaataatcagggaatcagttgtggatctggtacttgttgttttctgactttggttcaaccaccacaattctcagggtgaccacttctctagctctgaagtacacaggagagaacacatgtccgttaaagtccccttccagatgaaaaatattatgattccaatatttactggacatctacctcaaaggacatgaaaaaatctggtgaatggagggaaagaataaagcactgaatcaaaacaatgggatcagatcttcactttacattttatgatctgtgtggcttcagaaagtcattggaagtatatgaagtctatcttgttcaacatggatgattgtttgaaaaataaatgtgatgatgtgaattaaaatgctctgtaaattgtaaatatacaatgggacattattgccagtggtcaaggtttgaagaacagaactggtaagggcttgtgagccaagggcagggaagactagtcatcataagagaaggcaatctcgaatctccattcgtagctggacaatcacaccactgccctagctactgggttttaagaagatggatctgcaaacatttctaatctaaatttacagtatgagtatctttaggaacaagtcagatcctctggacaaaaggtttgaaggttttgtttgtttgtttgttttctttctttgttttcccagctcaaagacttgtgaatctgttttttccttcgaaaaaaacaaaggtttttttctggctccaagactcctgagtgtactatagagggagatgataatgtgcacaagtttgggtcactaatatctacaaagtagttggttattgaaactctaggtcatttttggagaagaaatcaattctgaaaacaatcaaatgtatatatttttgctcttattaatttccaggccctttacttgtctccatcacagtagccatgactccatgacaagctctaattaccttcagcatggggcatcaccaggcccatagaattggattctctgactccagtcttgtgctctgccaggacaatcaattttacacaagcttctgttctaggaacaccaaacatttttttgcaccttgtattctaacattcccttcctataaaacatgcccttcccaacatctcaagggactctgagatgtttctctctccttcccagggaatttcctaattctccacattcaggccttttgtttccaccaaacttcagaattcctgagatgaatctttacgccttgtggagttcttttcctcccagctctgcgtttttagattaccttagctgtcctttaaaaatttcaaacacagcaggcacatttattttgaactttctctgccagatgtgaagtaagtatgttccagagtagtggttctcaaacttcgggcaatctgacaaaaatacagaggttcaggctctctccttaaatgaatcccagcctttttatgacttattagctctccaagtaaggacagggatagacatggacgttgctggggtttgaggtaataggattcagctgtgacagattcagtttcaagtagctgactacttaaagttctacattttagaatgaaggtcaggccctgcatcaggttcacccaacttatgactcctccctcaagcctatcctgaatttctgagatattctttgctagagtatgatactatcatcattaaatattacattgcatcaatttaagagataaattttttcacatttcaatgtctttgatattgtgtcatatcttaaaatctatgacatcttaaaattatttgtcagcatcttttcttccacattagcacctaacataatggtgcttcttacaatcaagttttcttagatttggtgaaaaacaacagcaaagacatcaagaaaagaaaattattctctaactcaaagttagaagaagtaacccaacagctcaataaatattgtggaaataaagtggtagaatgatgtaatattatatgatttatcgaattcaggctagcatgcttaaatatgaaaattttgaggaggaatttgtcatctgcacaattttgtaaaaattcagaggcgtctagctctctccttaaatgaatctcagcctttttatgatttattagctgtccaagtaaggacagtggtacagatggacatttgaaaagtattgctgggatctggggtcatacaattggtgatctagtatctaattacccagagaactgaagcatattccatcgaatagccaatttggtctgctagggaccaataaagcatggggcatggaccacatctcagttcttaactgtctattgacttgtgggtcatcaaacttaggttcatcctgataacacttcaaaaacagaggtgtctatatctgtgtaacaaactaccccagatttagtggcatgaaacaatgacaattttttttttaaactattgctgtctatcatggctccagggattacctggacttaactaagtggatttcacttggggacttccatatggatgttttaatgcaaaatcatgagtggctggggctggagacagcccacatgtttgatgcctgggtgggaagacacaaacagctgggagctgaaacagagggacaccttgggcgcctctcccaatctccatgtggcctgtttatgaggtctctacaagacactagcttcacagtagtcctatctcttatatgcaggttcttggctccaaaagtgagtgtctccagaaagagagagagacagagagatagacataggtagagagagagagagagagagagcatctacctgtgaaaattgtgtagctcttcgtgacctagcctaggcaggcgtgagtctgctgcatcctatttgctagaattgagtcattaagcctgtctacagtcaagagaaagataactaaacttatggatatgttttaaaaccaccataaagagacatcttaaatgttagtgatcattctctgaatccaaaattcaagtcttgcattttaaataatctgaaagttaatcaacacaaaatcttttttcattcttaaaaaaattataaaagctactgcaatatattcattaggaaaaaaaaattgtaactacatctgagtggtctgctgagtcaaagagaactctaagcaacctataaacatagaaaaacccacacacaacctataaaaatagaaaaacccacccaccaaaatccatgatgcctgtctttccaaaacacaaactggatcaacacaaaatcgctcatcaaagatgcttaaagtagcataaataatgtttctttgtcaaacattaattgtttactactatgtattgaagataatttttaaagtacattataaaagaacttgtgtcccttaaaattacttctctcaggttagtggctgatttcatttcttatctatgaactgcacccagagagatgggaaacctagaggtctgaataatcaagacgataaatatcttctatggttttatatttttcaaagaaataaatattaaatgggaagatgcccattgtttgtgattttgactcaacttttaaaacttgcacattttgatctgaatgctacaaactggacccaccaaaataactcgtatcacttcatgctatttaagaatcatgagtgtttacgtgtaggaattcatgctgtttagagtaaaataaagtctccagaatcagcattctggcacttattttcaatgtaatgtaggcacagtgggaaactgtaggtttaacagaaggaaatactggtaattaatgtattaaattttaaaataagaaatacccaaaaatctgactgcccatgtatctatacattcaagtaatttggaaactccactttttaacgggcatatctaccctatcaggcagccactgacaaacttgaaatgggtaacataaaatatctaaaatatttttatgttgataaaactactataacaaactttatggcaaacaccatgctgaatgccaggaatacattttcattgaattctcaccagaaacctataaggccaataatattctattttagatctgagacaactactgtattaattacccaattttatataaatgattcaaggaatcatttgaactccttaaaataaacaacgatgaacaaaaaaaagtaaggtaactttccaaagtgcaatctttaccctcttgtttctcactaatccattttagagacacttttatttctcatgccagccccttgttgaatttcagcattgctactagccttataagatgtctaaagatcagcatttaatctcagaacaagaaccaaaaacacaaacaaaaaaattaatgagccatcacccccacccctaccccataagtcattacagttaaataattatctaaacttggaatatggatcactgtgtttaggtcataagttgattaagtctgtaaaaaatgccttctaatcacatactctttgccaggcaatgggagaaaactgttaaaacaaaattatggaacttttatttagattgaagttgagagagacaaaatacaaataacaaaatagatataatagacataccacaataacagctagtggtgagaaagagaaatgaagcaggccaggagatggaaagagcgggctctctggggtggtgacatttcagcaggggtgacattatagcttctctagacaaatcacataacctctgtatgtccatgtttcctgatctgtaaaatgaggaactggactataatgacatttaatggacctccaagccttgaagttctatgaccctgagcccttccattcacaagaaagcctcccaaagaagagttttctctaatagctcatctagtatccatccaattccaatggaaccaacagtatcaatcaatcgcactcccttatgaatagtacctctcatccctagaggtgaaggtctgctctcttctttttaatctgataaagctttctggtaaatattgcaatgcaagagaaacaatatttctaagcatcagcaaggaatgtggcaggattccacactggctgatcttgtagactagacagggcaagagatgtaatttgctgaattatttaccacacaaattctcacaaccttaaaaaaaaaatcagtgaaccagtttcaatgcagagaacccagtccccttttttctctgaaatgaaggatggtattgtgtaaatagtgtcaggatgtagggatcacttaaggggaggcagcaattctgaaaacacagattaaagaacaaagatgcacactgacatctcaagctctgcttgatgggctgaatatagtaagacgtaccagtaacacaagcaaattctatactatggtttagaaaaccaaagtgcaagaataatatggaaagccaaatcttggtagcaacatatactggacaaaatctccttagatatgggccgggcgcagtggctcacacctgtaatcccagcacactgggaggctgaggcgggcggatcgtgaggtcaggagatcgagaccatcctggctaacatgatgaaaccccatctctactaaaaatacaaaaaattagccgggcacggtggcgggcgcctgtagtcccagctactcaggaggctgaggcaggagaaccgcgtgaacctgggaggcagagcttgcagtgaacggagatggtgccactgcactccagcctgggtgacagagacagactcggtctcagaacaaaaaaaaaaagtaaactgtctcttttataatttttatactgaaaatgtcaaaataatatgttggtgtgttggtttaactcaaacacattattaaatttaatttcacctgtttctatttgcattttttcatgtggctactagaaatttaaacttgcttatgtggcaaacattttatttctcctggcaatgccgctttagagacaatcaggaacaggtacagcagtttttttcaaacatgtgaagcgctgttgtatagaagaaacattaacttggctcagtctagaaacaagaattagaaccctgctttaatattgcttcatcagcaaaggcaggtaacaaatctttctttcccaacaatgcccagaagggaatgtcatcactctgacagatccatcattgaataggacacttatgaaaaagttgcacttcttatcttactaaaaaacgtgaaaatatggcaataaaaataaaacaagaaaaccaaactacctatcaaaaagcactgtctcattagtagttcccaatgcactctccttttgcctccagagaataattacataaatcattttattttctctttagagaatgagaggtggacacccagcaggcaagaacatcatcagagggactgacattcaggtttgcaaatgaacatttttctgaagatgccacctacttttgttaaacttcctcatggatacattacagatcatctactggaagaaatatttgctgtcttgagactgtcaggattcccagacagcctgtatcatcagtatcacaggaggaaaaaataaataatttgtaaaaccaccctgtgtccataaacctgatctcaacaaagtagcaagactgtcaacagagtttagcaaaaaatgtctatctcaccactatgatatttgagataatactcaagaaaatatcttacctttattacaagttaaagctacaataatgcgacttatatttcactagttccacatagttcaccttctaaatgtgtattagaaatgttaaataattatttatgatcctaggaaattgactctttgactctatttggatcaataaaatcagaaaaaaactcattttttttccaggggtggtttgtttgattttctttaacagaaccaggtttttaaaggaaaaataaaagattatattgtttgtactagcacagaaaatcttaacaatggtttgacagaccttcaaattataaaatatcagtagcccaaagtgtttcaaacactgctgtctttaagaaaacaatttagattcaagagaattcagtctgagtcccagttgtcatcaagctcaatctgtttatgagattttagtttactcatcatttactgagggcattggctgttatactgattcctccagctttaacttcccacattccacatttctatgtaaatagaagggaaaaatcacttcccatttaactaactaaagcccatgcatatttattttaataaaataggtgttacttagggatgaacatctttacagaaacttttaacacaggtttctaagaagtctgtgtaatagctccctgaagaccttttaaagttcatagagagatctaacgtgagtgcattgtaaatatcttgaagggatggatagactgaaatacacacacacacacatatgcacacacacacacatacacacacatacacatacacactgcttgccggattttgaagactaataatgcaacctctaaagccaaattaggattcagatttgtagattcccattaaaatgaaagcaatcatcagttatacttacttcattccattctgaaaattggaaaatattttatagcataaaatagctctggcattagtattacaaaaagtaacacagaagttctggcatatcccagaactctaattataaaactaatgaattcagggagcacctgttgtttaatttgaactcttttataggtaccatgtatattctgtgccagcattttgatgaactgatttttaaaaatctcaataactagctcatttttctaatcaatcactgtattttcctggcaacctactttcttcctagtaaattccatatatactaagtcacattaatattgttaatcaagcttcagaggaagtgtctgagttgaatttggaagtcctgaggttggctatacataaaggtaggaaggtgaagatcagggagttagcctcttaactgactggcggaggggggcaggggggcagggagccatcattttcatgaacgggagctagcgtgtgactctaactggagtcccttactgtatcgtggcaagaaacctgactctccagtggctactagccgaggacgcataaggaagccacagctatgttaggacagcagcttcaacgtggaaatcaggtttctaccatctacttttaggaagtgaaatagccaggacctgaatgcttgtcttagcaccattttgaatgtgatctgccagtcagctttataaaatcagggtctaaacatcttgttttctttttttattaactgctatatcactcacccccagcacagtactttaataactatttttaaatgaaaaagtaaatctcatctactccatggtggctgatatggactatattatgtcctcccaaaaatcatagcatcataacccccagtacctcagaatatgacttatttggaaacagaggcatcgcagatgtgattaagatgaggtcatactggagtaggataggcttctagtccaatatgactagtgtccttaagaaaaggagcaccacatgaagatgaaaacagagcttggagtgaagacacaaaagcaaagaaacagaaaaggttgctagggaactaccagaaacctggaagaacagactctccctcacagccttttaaagagacaccttggtctttgacttccatctccaaaactatgtttttattaattaatccactcagtttgcgatgctttgttacagaagggctagcacactaatacaatcgtcaagacgatctatggcttgaaattacacacaagtcatggaaagtttaaatctgaataaaatcagtaagatatcaaggctaagaaaggattttttcaagggatgtgtagcactatacttaatgtttgagtctgtgataaattgtgactagtctatatttagaaaagcataaatgcctaaaataaatcaagacatctaaaatgtaacccccgtgagaaagagaaactttgatttgtactttgacacatccctggaacataaatcacagcctagcacattatggccacaaaccataatgatttctaaatgaatgaatggctaatagagaataattattccaaatataggagcgaattggtgaacttgcttaatgaaacattaaaaactcaaaatccaaaccagaaataggtataaaaagaaattttcttacctatttctatttggacaattttgtcattgttttattaagtgaatgtcagtcaataaaaacagaaatattaatggaaaaattagaaatatggcatatgggctgtcagtttgagaaaaatgcaagtacaataaaattttcaaatttcaacaaactatcaatctttgacttcatactgtacagatggcaaaggtgctgtgtttttaagcatcaattagaagtaactgtatatccacatatagaagaatgaaaccagacccctatctctcaccatatacaaaaatcaactctaaatagatgaaagacttaaatgtaagacccaaaactatgcaattagttgaagaaatcatagtggatcaatgcttcatgaatttcaactggacaataactttttgtaataagatctccaaagcagagacaataaaagcaaaaatagactaatgggattacatcaaactcaaaagcttctgaacagcaaagtaaacaataaagtgaagagacaccctacagaacaggagaaagtatctgcaaaatatgcatctgacaaggggctgatagccagaacttataaggaactcaaacaattcaatagcaaaaataagcaaataatctgattttaaaacgggcaaaagacccaaatagacatttctcaaaagaagatatgaaaatggttaatagacatccaaaaaaaatcaacatcactaatcaacagataaatgcaaatcaaaatcacaatgaggtatcacctaaccccagttagaatggctattatcagaaagacaaaaaataaatgctgggaagaatgcagagaaagcaaactcagtacattgttggtaggaatgtaaattagttcagctattacagaaaacagtatgaaggttcctcaaaaaattaaaaatataactacggtttgatctagcaatctcattactgggtgtatatccaaaggaaataaaatcagtatgtcaaagattttatatatatatatatatatatatatatatatatatatatatatatatgcacacccatgtttactacagcagtattcacaatagccaagatatagaaatcgatctaaaagtcatctacaaatgagtggataaagaaaatgtgatatacacatatacacataatggaatactattcggccataaaactgaatgaaatcctgttatttgcagcaacacagatgaggacattatgttaagtgaactaatctaggtacaataaaacaaatatggcgtcatctcactcatttgtacaatctaaataagtaggcttcatagaagtagagagtagaatagtggttaccagaggctgggaaggaggaggaggaggcaggtaataggacagtttggtcagtagttataaaattacagttaggaagaataagtgttgtgttctgttgcacagtagggtgaccacagcaagtaacaatgtagtatatatttcgaaatagctagaagattttgaatgttgtcaccataaagaagtgataaatgtaaaagtgttgaatgcgataattaccctgctttgttcattatactatgtaaacatgcattgagacatcacattataccccatgaatatgtataattacatgtcaattataaattttaaaaaactaaatttaaaaagaaattaactatgtgaaacaatgtggaaatagatactgaaatttttaaataagcataattatgacaacatatctacagatattttcattaatgaattacttgtgaattacattgtcaagtgtcaaatagaaaaatctttcaataacaatggcaattatgttaaaaactggacggcgtttagaattatgttaaaaagttatttaatgcttattttaatatattttaaaatatcaatgagaatcctaaattcctatagtaacaattttctatacttctacacataattttcatagatttttctcccttgcaaggcaaaagtttgccctctattctttacactttaatttcttttattcaacaatattaaaatatttaccaaattacttccttgtgtttaaacattgctacattttatggggaaaaaattataacctggtctaaaaaagtacgtctttcaagaaaaataatgataaagacatacagtttcaaattatttttattatagttaggcatggacaaatacaactaggctagaagtccttaagtttgcagaaactacacacttataaaatgtcaaattataaaataaatgtaaaaagtataaaataaataaaattcaaaataacaacattaatatagtgcgtttgatgttgtagcatgggaaaattaattactacccataacgtgaatttgggactgactggtaatggtgtagatcttttgaaatttggtgtgtcacagaatgactaaattttccccctaccttatttacacaatggcaatgtttacttcctaaggacatgttgcccttcactttgcacaaacccttcatgaatgtcctaagcctgtatcatgccatgcttcacactgttagttcaggctatgtcttccacacccagagcttctcgtagagagcttctatacacatagctctgagggaggcatatggtatatgtggattgtgtatcatgtgagtcaaatcctgacccaaacctcctaggtcagaatatttctttctcttgtccaggatgattcccatgagatccaggctagatcaggcagagtgaatccttaacagtctcttggaaccatcaggaaaaagtacattcttcctatggttgctcaacaactagcatataaacttggagctcccattgacatattgacactacttataaaaagcctgctaaagatgaaggtagtaaagaagaaagcagaactaatagacagtgtattggtccattttcagggtactaataaagacatacccgagactaggtcatttataaagaaaaaaaggtttaatggactcacagttccacatggctagggagggctcacaatcatggcagatgacaaaaggcacatcttacaacgcagcaggcaagagagagaaagaaccaagtgaaaggggtttctccttataaaaccatcagatctcatgagacttactaccatgagaacagtataggggaaactgcccccatgattcaattatctcccaccaggtccctcccacaacatgtgggaattatgggagctacaattcaagatgagatttgggtagggacacagccatatcagacagaaagagaaaaaaatgagccatgatcagtagaacgtggggacggagcaaacctctagcatttttacttatgagagtctgtaaattccacatttcctagtactccaggttaagttcattttccatggtttgcaaagggagtcccaactaatcaggaaacttccactggctgtcagtgatatgcccagaataaagaactggtccatctggtggtacggtttaggtagtgagcacactgcccttaactggaaaggtaggtattcactatctgttaacaaagtggctgttaaacacctctctatgtatctcaaaccacaagttggagggttggagaacttgatgaagtgtcccggatgattctcatggccttttgtaaatttctccaaagaacaggcagtcttacacttagactggcacagtgagaaacagagaaaagaaaatatctgaccacagtggcacattctgcccatggccaggaacccagaatggctgagtaggaaaatcacgagccttgtagggttgaaagccaaatctagtccaaggctcagacctccttttccagcaatctggccataagataggaggtttaaaatacacccagcactccactgatgggtgcagcaaacgaccattgcatgtgtatacctatgtaacaaacctgcacgttctgcacatgtatcccaaaacttaaagtataataaaaaaacagaataataataaataaaattacaataaaaaagtacacccagaggctgaggggtagggatataggtgatagatgagctgagatgctaatacagagctctcatgtattctctaagtccaaaggcacatgaacaccatcatggaaagacgtttcactccactccacccaaaactccatggaaatgagaaatataagtgaaaaaagtagcctacaattttgtgacaaattaaaaatgatgaacatattttgtttcgtaaagacaaatatattccctagatatgaaattccaaggtaataggtaataaagtagctactaacaatcaacttctcattgatatagaaagtatggacttatctgcatttataccaaatatatagctttatttcctttgtgaatactagtagtaattctactatacatttgtaataaattattaaattggcaggagacattgtatcggggaatgagaaaaaaggcaattatgattaataaaaaatatttcttaaaaaataatgggagttcttttcttcatttactttcaaatccattctgctactgagccacaaaagataataacacccagagtgccaatccaaaatcacagcattcgctcacacatatttccatctcattaatgaaaaacaaaagtttctatttgaagtacattttgtactatccaatataaacttccctgtagctcgaacatactattaatttatacagtaaataaatatctgaagcttccacatttgctgtgataggaaactttatgtgtctacttggctaaggtatcatgcccagctgtttggtcaagcacatgtttagatattgctgtgaaggtgtttgtgaatttgattaatagttacaatcagctaactttaagtaaagcagatcaccagccatcatgttgtgggcctcatccaatcagctaaagaacttaagagaaaagacggaggtcccccaaaatcagaattctcctcaagactacaacataaataccctgtttgcgttcccggcctactggcctgtcccacagatttcagactttatactgcagcatcacccctccttgaatttcctgcctgtcagctcaccccacaggttttggattttccagtccccatagctatatgagccaattccttaaaataatattcatattatctctctaatacatgcgtgtgtgtgcgtatgtgggtgtgagtgtatatgtgttctgtttccctagaatgaatttctcttattagaataacatttaaatgcccccaaaaagatcttggctgaaactctacctttcaggagaagaaaggtctttactctgcatgattgaaagaaatggtacagagcctgttttctcagccctagttatttcctagaggaatttgctgacttcactctgtggcctgaggggaactggtctcacccatgtccagtccacaggagcagctggctttatgcagctttgttcattaacacagggcctgtttggaaatcctacttttagtcattaaaccacgcctacccaggacttcttcacagaagtgctggattccgcctgtagtactgagtcacaggcaatcatgtttgtattttggggagtttgcttggcctgtgtgctgctgccaagtctccacattggcaatggccaattccatttgtgattttggtaaacacagtatgtttcataaggtactgatggtaaaagtaaatccaaaattctaagctttgattttcaaaatcctggccagaaccagctatttatattttaatcagcagttagggcagagggtagctaaatgcagtcgatgctttctagaaaaggcaaataaaagattttgaatataatttccagtcattcagtcatggtatacattctcctcctacctcaagtcagctacaagcttcccttcaccttctatctcctgtttcctgttacacatttacaattaacttacgtctcttaaccacgccacctctttagtggcacccaacggcattcattgttccttcccccttgttcctacctttcagactctacagcttccatctgatatttcccagcacccactgtaggccatggtatcacactcagccccaagaatgccacaggaatgtcacccagagactgacctcaaaatgctcaaagtaaagccattcattataaccaaaggtgattattcaaagtctgaaagagatttttttaagtgcgttcttaaatttagaaaaaaaaatccacaatccttgcttaattaattatagatgaaactcagtcagcacaatgccaaatcactatattcctaccttgaccctaagtgatggtctaatggcagtaaggaacaaatggcaagaatcaagagagaactgagaaaaatactgtgagaaaactggagtaaacataacatttgggggcacttgtatgtgcacagcatgatgtgaaggaaatgccaactgtgacagtatcactgaccaaagaaacaggtaccagtcagggtgatccaaacagtatccagttcagaaatacacatctcatgaaaagatactgtatacttacattgaaaacctctaagtttctgtttacatgcagtgggaaacagtctcctagatcctggaattacactgactgaccctttagaaacagaagtaagcagagaagaaatgtaatagagcaacaaaatatatgtatttgaattacttgttcatagaagacccaattaattattcagcaaaaagaaaagaggcagctggaaatgaacaataggaaaccaatttgataatgggtttgcccttatgtgtgcactttaccagctgaaaggtccaagtaatcactctttctctctcctttgactgtcttttacttgcctgtttctctgtgtctctcttttgatgtttttctctctttcttttcaaacctcttccaaataaaagaatcacattcaaacctcgggagattaatcaaagcctgtcaaaattggaaaacacataaatctctgggaagaatctacttagttggagattgctccccaacttctcaccaggtctcttgtgctagggaaaactcactctttttccctcatcactccaccaaaactgctttggtcaggctccccaaggaccatcctctttctaaagctgtggacaatttttaggccttctttcctttaccttcctgcagcatttgacaggtgcaggcacagccaagctcttcctgggtctttgtgtttggcttcatgaacagcattctctgcatgttttcttcctacttcactggccacttctccctcttctgttgtctccccctctccctggcatcccaatcatgctcacaccagggctcagtggtcttaccacctcctctttatttacattcactttcttggagatctcatccagtctggtgactttaaatatcacacctacattgatgaatctcaagtcactgcccacacctggaccttgactcctagatccacctgcctactgatccactgccacttagatccactgacagctgggtgccccataggccttggtgaacttgaaactcatctcaagttgatccacctctcagacctgccccactcactttcttctccttctcatttggtgccaattgcatccctacagtttctgaggccaaaaatcttggcagtcactcttaactcagccttttctctcccattgtacacctaatccaccaggtaactccgttgattctaccttctggataggtacagcgtttagtcactcttgccacctccattgttctctcctcctcgtctgagccgccatcatgagtcatttggattgacaacatcatctctgaactggtctctccgtgtccaccactgctgtcctgcagtctgttctctacaggttcatcagactgatccaagtctatgtcagatcacatcacttcttggctcaaaagcatctatgataaacaaggccctggaaaacctggctgagcattcgttctcctaagtatcctccctctattctccttccagccacaccgtcctccttgttgttcccaaagcacgttcagcacactgccacgggtggcccgttgtgctcactgctctctgggcctggacccgtcttttcaaagccagggtcatggctaactccctcacctcctttacttgtcagttctatataagtatccaacataaaagttcaactgcattacttttgcctggaatcctttctccccaccatttctccacttttattttgttttccatggcacttatcaacatctaacatacaatttactcatttctgtttgctgtttattgtcaccctcccaaacagctgggcaccgaatcctagccaagcagacacttaaaattacctaacacagtaaatgtggaagcttctgatatttatttactttataaattaatagtatgtttgaactacagggaagtttatatttgttctgtgatatattccaagaatctagaagagtgcctggctcaaagaaagagcacagtaaacacttgttgagtaagtgaatactcaaaactctaatttgaaaactgtatccaatatgtgcaaaatccttcctaaagcttacagaaggtatatattccatcttaacacaagtatcgaacgtacagtaaaatcaacactgaactaggaattcaaaccctggatctgaacctggatctcgttctaacgatttggccacgaagtagttcttcaaccttcctgagactcagttctttacctgtaaaatcaggataacgtttcacagtttttgttgttgttttggtttttaaaaccaaatatgatgatgcctgtaaaactataaattcagaaaagcaagatcatctgataagaggccccactattctcttctaaactgggccatttgtggtgcgctgtcatttttcataaagcaagtgataaaaatattctgtaactataatgtgcagctgcactcacagaccaaaataaatctgattaagacacagttccttaaagagcgacggttacttgggtttttgcaatcaagcataaaaaacctgtaatgccggagggcagccttaaaccagggattagctggagatgccaaaaggatttgtggaaaaggcttcaacccacaggttgaaacagggacagcagcatcttatgttacctagagataccaaaggtcggtggtgaggtgtgtgggctcctgagccagactccccaggtatgaatcctagttcccctacctttcctgtgtgtataaccttggaccagtgaactaacctcacctcactggaaaaacagagaccaattgtaggattagcatgaggattaactgagctaccagctaggatgcactatgatacgtgctcaacagaaattcctttgggcaaacaagggagtttagtgtgtacatccaacaggtaaaagcatttttccttccaattaaataaagaccagtggagaggagatctgtaagcaccttattaggtgaaaaacaaaatctaaagataaaaaggtatatgaaatacacacaactaaaagccacttttaactcatcttgagattattcagagattaagtgttcttgaactcagtcactttagaatagagacttctggtcaccctgcatagaggttccctaaatgaggttctgatgcagaggcattcacatcacctggcaacctctcagatatgtgcattcttaggcctcaccatagacctaataaatcagaaactctgggccccagacctagaattttaacaagctttctagatgatggggatggaggtcatagtctgcaaaccactgccctaagccatcaactccaagagagaataaaggatattgccggataattgaacttgactcttcactgctttatctaagctactcatttataaagtgtggttgcaagaaaaggctttgagaaagcactgaatgaatactatgtgcattaagaaattgtggttagtttggcaggacacaaaatcttcaactcacaaatatctattcagcattaattatctataagccaccatgccataaactgggagagacaaaaagaacaaaacatggaccttgccccctgggagtttataatattataaggtattcagatacagaaagaatgaacaaaaatacaaagcaaaatatattttctgctttcacaactaagaaactgagcaaagttctggaatattgactacacaaggcaagatcagaacaggagttcattcggcatggccagagggaacgaggtaagaagggatgctgtggaaggggaggctgatggaaagttgggagtgagtgtcatctgaaggagtgtggtctttatcactttttcagcacaaagttgctgaagccttttgcaaaaagctgtgtttctctgtatttgacaaactcggctcaggatgatagtttagtatcaatctgagtgtcgaaggtagaaagaggctagaaacaggaagaaaaggtaactgtccagaaaagagaggtgggagggaagaagcggaagtaaaaagtgcaaaacagaggatagaatatgaaagggcatcaggaactacagcggcagaatgaattaccagataagtcaaatagcaccccaggtttaaaactaaaaagaacaccagaaaatacatctcccttcgacatatatgtggtttgtgatatgattcacttactggtaacatggctgaatctgagctatctataatatttttaaaatatgtacttggaccagaataaatttgaaccttatgtgatgaattcctggcacaagaaataaaaacaaaatcacagcattttagagtgtgaaagcaatatgggtggttttggaaatccctttaataattatataagattatttattttcaaaattatcaaattcccaaacaacccacttaaatagttgaaattagtgcatgcagacatatgaatgtccaataagctgatataagaccatgcatttaaaaaatttcacgtacttcacattaaatatttgaacttaaaaaccattcttatactactgacatcaggattagattcctaaattatatagtccatactaaataatataaacattggttttcacagttcaatttcccctactcttacatggttaatttgaacccaatacaagatgagatagaggaatggtcctccctatggagcaaacgttggaaaagagtccgggatgatgaggatgtgccagccatatcaaggtacaaagctctggcagggggaatgtttgcagggggcatgtgtggcgatacaaaggcaccgaggcaggaacaagccttgtttgtacaagaaacaaaaatgacaatgaggctggagcacagcagtcaatgagggtgtgtcagcaggccgtggtaaagatgagctccctcctgcacgagagccggacagggtgcgagcaagaggacaatacgatctgatgaccctttgctgatgagtttatacctgtgtcctaatgaggcctgcaaatcttgtcatttggagccagaataatgcacaaggctcttgactcataagggttatctatgatctttggggtcaataagcagaagagctgatatatattaagtacgggttaacctagttagtgtcatatttaataaatttgagctgagctacaaatgtgcatattggatcagggactacctatgctattaacgaaaaaatatcttctctataagggaaatgatgcctctctgctctacaatgtgttttgtgatcgtgcatgagcatataagaaaaggaagaatacataacatgatatattatgatttcaacacgaaccttccagccaggatccacaagaggctgacaaggtctgcccatgatcaggatggctgtgaaatggaaaagagaacttttcagataggaagcacagaaactgtgggttccttaggggcctgtagctaatctggtactccttatggcatatgtttggaggttggacttactccctcaaaatgactgcaatcaaatgaaatcacaggtaatgtggcttcaacccagccatggaccattttttaaagtaactttatatggggattgcttgtgcttatttttcactcttgtttccctccagttttaatttgatgtttcttcttatcaatccctagacaccttcttaaagactttccacaacattggattccatttagttaataacaaaaataggtggcaaagttggttttatataatattgccttataaatgatgtcagtatacatgcacacaaagaaactcccagaattttacaggcaaatatccagttgataggaatggggtgagggggtggaaggtcagatgacagaaagaacttggaagtgttcataaggtaactaaacccaaaattgctgctgcaaatgtaaggttataatacaatcaatacaataccaatatctgtcctattccttgtacttttaccaactatattgctctacacgaaccctgcagataacttattgatatatgtatcatggatgcatattcttagctatgaagcattaatttttctgttactatccacgtttaatcaaataataaaacaacaataagaataagtaagaacaggctgggcacggtggctcacgcctgttaatcccagcactttgggagctgaggtgggtggatcacgaggtcaggagatggagaccatcctggctaacacggtgaaactccgtctctactaaaaatacaaaaaattagctgggcatggtggcgggtgcctgtagccccagctattcgggaggctgaggcaggagaatggcgtgaacctgggaggcggagcttgcagtgagctgagatcccaccactgcactccagcctgggcgacagagtgagactacgtctcaaaaaaagagtaagtaagaataaaacaacaataaaactagctaatatgtcacaaacttatatacgctgtccccaagttaaatgctttacatgtattatcttgttaattggaaaaacccaatgaagtagattctatgatggtcaagtcacaaggctaatggctggaatcaagcctgaactcagacacacactgaaccactgcaagagcatctccttcacgactgtctgctaagacacagctcatgctcctttcctgtatggagtcttcactctcctttaacactgacatctccttcctatgaatgactgaagcagttcatttctgtgccattatgtgttatgcttaacacatggtgccttgtttcataatttgcactatcaccacaggtgttaaattccacatgcagactttcatatggtcacagatctagaagaacaaaacaaaatacagtaaatgacaacgaaaatagaaattaaagtatcttcccatcaatcaccaaccctaatgattataaaattattgtaggaagaataaatatccagttcttgaacgaaaacaagttcatgtatcatctggaccccctatatgtctacacggctctgggggacctcttatcagtcattttcctgctgcccactacttgctttcaatacaggaaaggccctagagaccttgcacatgatttccacagaacaatctcctattcttacccttaataactgctgttcatctatgagagccacctacatgcctgtaactcacacaaacctcacacaacattagcctttgtctcaatactctctcttccagatcctgctttcttctcacttaacctttttctcagtagcaaaattcattcattaatggggtgaaatcagagtccccataaaactctgagcaccacaagggcaggtaccatacctattttgtattcagcactctttccttaacacctatacttaccacagtataagcacactctagggactaccagatatagactgaaagatccctccccatccctttatttgccatttatttaaggaactggcaaaataagggagaaaaaataatacagttgaattgttactgtactttttacaactgtcaatcatattcattcatcataacaactgtgatcaatcggattaaatatctaaaatatttaaggttcaattggtttatgctacaattaaacatgtgaaaacttgacaattttatcagattggccataaaatattttaatctcatgatgaattcatctattgagagttattacatcttttaagcaaaatagcacccacatttcccatacacaatgctttttacagatttactaatgtttcaaccactggacaattctgtaatcacatttgctggacaactccgttcttagtaaattgtagagctctgttgtaaatgctgttgttttaataatattttgtagcattttaaaagatacataatccctaatgtttaacacagaggtttataaccaattctctatgagagctaagtactgttaagctcatctgtaaatttcaccgttttagtatcttaattggatttcaggtaattatagctaagattctataatgcacataagaattgtttcagctacaaaaataggaaaaatttaaaatatacacatgcctttactgcttataaaaattacaagccagcggctatttgtttttataaaagtgctataatttaccttacaacagatatgtaaagaaactaaaccaggtaatttaggtaccaattagaacttttactttacttttattcaagcagtgacataatctaccacagttgtagcatttaaatacaataggtttttgaagaaggttggcacatctccgttactccagggtcttgcataaaacatgtcaaccccctaaatattgcaaatatagggcattgtaccaagtctgcctaaattgccatctacacattactataacagtagaggttttctctcaataaaacataattttcttttgttgctaaaaggtaaataatgttttcagaaatctttctatggtaagtattttgaagtgatcttgttctaaaaggtactggaatgctcttcctgttactgccctctaagatgtaaactatagaaaatgacttgaacagaaaacaacctctcccacatacatgttctgacatacataagtccattttttacgtctgtactgcatgatcaccagtgtatgtgatggtttcgagtctttgagttttatgtttcaaaaagtcttagagtcccattcagccttctctgctcaactctagactcgtatcatctactgcctattggacccctccactcagacatctgataaacctctgccacatgacacagcataataccacataacagaaccgcaaaataaaaacataacaaacatgatctactgaacctctcccacccaaacttcattttctcctctatcagtgaatagaatgccatccttccagttgctatgccaaaaactgggagtcatcttttatccagctatttcttatactccatccaatctgtcagcaaattctttgaccttcagaacataaccagaagatgatcacctctctcgccatctctcctctgaatgccattgtccaaaccgatgtcatcttttgttcaggccctctgcaagggcctgctatctgagctaccatccccaccccacaattgagcagagcagtcagaagaatccttgcaaaacatgaactcgatcacgtcccttctctgctcaaaactctgcagtgtgaaagccaaagggccctcacagtggcctacagagtccacttgatgtgttctcccatcatctctctgaagtgatgactacatttcctatgatttgtctttgtgcctgtgtgccagccatgattggactccttggcatttcttgagtatactcggcattctcacaccttagggacccaatttactgtatctacaaggctcccatccctatcttgttgaaatattagctcaaatgatgtcttctcaatgtaacctaccctgactaccctatttattaatagaacttccaacaatgcccctatcattttgtgcccaatccctctaaacttgctctgtggttttctatagcacttgttgcctcattagataatctatactcaaattgggtgaaatggaattaaatgggaaatagaaattaagacttctttcaactactgatttaaacaaatttccacatttatattatctaaatatggaccaattgttaggaaacttttctcaaagattgtcctgttttaaccaacttactactagaaattttccatttaaaatattccatttaaaatgaataatttatggaaaatagaaattttccattaaaatgaaggcacttgttatagtaattcatgtttactatagtattttcaggacagctggtcaaattttgggacggttccctctcaaatcttggaatttgttcaagtatgcactaacaacatgacattttcttactttgaaggcaccatggttttgaaaaaatttattccatctattcaaagacttcttcccaaaagtacattcatggagtatggttttaggaaactagaaaacttgatgcatttcttaccattagttctaaaacagacatttccatgccttgccctataatcctaaaaggttgatatttttgaagagttactcaaaaaataacaatcatattactaccatttcacctgctttctcattccctagcccttatttcaaaaaggagtcttcattttgccataattattagaacattgtttcttggctatacgacaatttatctcctttgagacattggccagctcttctgttttcagcctcctgagagttctcaaactgctttatatttgctgtcagtgcacagaagatgagaaaaacaagcactatattaaactgaatatgaataaaatagagtgaatatcatttgaatacacaagataaacagttttctgtatcccattcaagagaaaaattcgggctaacatgaaatataaagactagttagacttcaaaattcaacgtatacagctcagagttagatttggagtctctgtactgcttggctgtccctagtttagcaatgcaacctgagtacatctattttctcgtatttcatttaacctttgaacttacacgaaaatgtccacgtgtttaaattgtgttttcctaagaaagttaaaagctttttctttatgaaaagaaattatgtgttgatattcatctgtattctccacagtacagagcacactgttatgcaaatagatgttcaataataaaactgttgattgccaaacaattgttgtttcttagtgtaaatggtatatcccgaaaatattctctctcaggacttgagggctgtagttctcaaaggattttgctcaatgggaataaatcaaattatggggccagatatatcacaccaggacctcatgcacaatagcttccttagcttaggaaccaattatttttgattggtgtaagcattacatggacagctgctaccaggacaataaaaattattaataacttccggcagtaaattcaattattgtgattatagatgcttggatatgtgttacatgggcaaaccaggaagtgaaagaacctcctttttaatgctgattttcataaaaataatcaaatctgagcactggaaggccaacttaacaattgcttggcaaactcatgtgctacagtcagcataaaatgataatcaccatccacactttgcctcttctatcaaagtaccacttctgtccaaaccaaatttgagaataataaaatcgcatattggaagcaacatatttaacacaagataataggcaatttaacagtctgatgcagtgttgtctgacacaaagagatggttttacacctccaaattctacaattatcttcaacgttctctacaaaatagatataatagataactgaaatcagcagaagtacacctaggactaagagctcctgatgtcaggttttatttagggtacatctaaagcagaactccacgttcttttagcagttcgggcctgctctgctgattcaccactgctgcatcatgaattgatcaggatcacgaacgtcatgtttcactgctctgctcaggtcagtgtgtccacgtcctaattactgcttgacttgctttgtcttcctcagtcacaggaagccactccccacaacgaaaggcaggcttccaagaggtcactcgagggacgccaccagcaaaggccttgaccaacctccgctgcctgaaaaaaagggtcaggtcccagagacaaatcgttcttcaattttaacagcagacaaatgatgctgttcttcctagaaagttctattgccagtatttagtagaaatcattattgtactacttagaaatgtggatgccacaataagcagatgcgaaatgtgacattttgattatttacaaatcctctgaccatgattcttgcaaaacaaatatgatcatcttacaaccaaagggagttaaaattgtatctcaaagcctcacctttctcctctagaaaggccactcagcttactggtcccagcacctggctgactctccagcagacctaggattagcactcccgctgcctttcctggatccaccatctacctgtctggtgtaaggcaggctttctcagccacaggactgctaacatcacaggacagataactgtgttgtaggggggctctcctttgtattgtaagatgtgagtggcatccctggactttacagcctaacttaagagcagccctgccatgcctcctccaccagttgtgatgtgcaaaatgcctcccgtcagtgctcagtgtccctcaggtggcaaaactgtctccacttgagagctactagtctacagtgaatcacaaacctgtctgcctgtctgatctcaactgttcttcttcttccttttttttttttttttttttttttttttgcgatggagtttcactcttgttgcccaggctacagtgcaatggcacgatctcagctcactgcaacctctgcctcccgggttcaggcaatcctcctgccttcagcctctcaagtagctgggattacaggcatgtgccaccacgcctggctaattttgtatttttagtagagacaaggtgtctctatgttggtcaggctggtctcaaactcccgacctcaggtgatccgcgtgcctcggcctcccaaagtgttgggattacaggcatgagccaccgtgccagcctgttcttgtttttgaatgtgtaaaatgggctgatttaagaatatgagatggagaagagcatatttacaagcatattcacaaaagttcctttcagaactaggactatattgcttggaagttctctttttttgtttggcagcctatctgtcactgaaaggaagaaatttcaaagagcctgatatgggaagaactatgtgttttgagaaagggagagaatttatcaataacttcaaaaagaagggaaaagagaaaaaggaattactaaaggagaataactgtcaacctctttcggtgtcaattaactaaataaactcttgatataattcatttttattaatagagaccagcaaaggagacagattttcacttctaagttggatcagtgtgggaagcagaaaatacccgccaaatgcatacatgttctaattcctagaaccagtgaatatgttatgttcaacacaaaagagaactaaggttgcagatagaattaaggtctctaatcagctgaatttaaaattgggagattaccctggattattgaggtgggcttacaataatcataagggtcttgagaagtggacaaaggaagaagaggagaactatagacgtaatgtggaaagtactcagcctgttgacacggtctttgaacatggaggaaggagccacaagccaaggaatgtgggggcaacctttagaagctggaagagacaaaaaaaaaaaaacgagttctcctctagagcctccagaaaggaacacagccctagtgacaccttgattttagccaactgacacccacatagagcttcaaacataaagaacttcaagaggaacaggtgtagtggctcacacctgtaatcccaacactatgggaggccaaagtgggaggatctcttgaagccattagtttgagaccagcctgggcaacatagaaagacctcgtctctacaaaaaatttaaaagttagccaggtgcagtggcatatgcctataaacctagctactcgggaggctgaggtgggaggattgcttgagcccaggagtttaaagctgtagtgagctatgattttgccactgcactccagccaggatgataacgccagacgttgtctctaaaaaaacctttaagaaaatgcatttgtgatgttttaggccatgaaatttatggtgatttgttatagcagcatcagaaaatgaatgcagtcaggtataaccaatgcatcatgtgaggacacaggacttggttaagaggaagcctgagcaggatgttcaaatctcagttgccctataaatggaagtatgggccaaggttaaccatctacaaaaattaggaggtccccactgacagctctgacacaggaaatttaaaaacaaatacatttcagagactgggagaactgaaggagattttgtacctaaagtgtgcagcacagtgcctggcacatcctacgtgctaaatgtttttcgtggatctcctactgcatttttcctacaaacagaaaagcttttgccacaatgtaatcacctttcccatgttgtcctaataacaaactacactactgctcatgcaaaataacgcacagggagaaagagaaatcacatgccattaggcttctcttggaattcttcgcgtgatcaataatggcattctcttctgtgtggtcccaatcaatacatgattctagttatcatgaactcactccaagacactgcctccctgacaccttatcacgagcagtagataagctgtaacaatttttctagatatctgcaagcacatctatcactgtgacaaatgcatgatgtggcattatatcttctcttcttagccttgttttaatatcacaagtctgtatttaataccacaaggttctgatccaagctcacattttaacgctttctggactgccaatgcataatgacctttcttgactatccagctggttggctggtacaaaatactgtgaagccagggacagtttcaacaagccgagttattccagagaaggatgaacttgctagaggctgtggtactaattttattgcatgttaattctagccaggaaaattgccctttgctcagactttgcactgatttcagagaaaagtccaataattatttgaggcaagaaataatggctgtttttgtttttacttgggggaagaaaatacaaaatcacagaaaacattacaggcaaggaataacatctcagattattataatcagccaatcagaactttaacgagctgtttaagattttctctctcttccacatggagatgtcagttctgtttcattaacaggatactcagtcacattggcagaaaatcctgtggctactgtttgagaatgagtgatcattatttttagaattattgtgtattagaccagaaagtaactcaaaagacccaccagttttgccattagttatagatactgagaccattcattcattcattcattcattcaataatatctatgctctataaagcctgtgctggtctcaactagtcaaagacactgaccctaaatcacccagcaaatcagtgataaagctgtgattccaagccaagaactttggcagatcactgtaatcaatacacctagtaaaacaccaacttacactgtgacttcattaaaataatgtactatttataaattgtaagaatttatgaaaaacagaaacagtgtaagcagcgctggacatctagaatgcctcactgttttatgatctaaggcacatcagattgtttttcccaattatcatggagctagttccctacacttcacctcagtgctcttttgtcaaccaagataaacccctgatggcgaagcaggggcaggatagacagagtccccaggtggagtactagaactaacacttaccattatgtgtgacctctgacaggtcacttcacctgcaggcacagctagagcaagcagtgacgcatgcgcaggggtgtcccttgcctccaatgcagccaccatcccagctgtggtgctgaggatcacactagccccaactaagacctgcggctggactcctgcctctgctctgtcaggacagtctttgggtgctccagggtggtgattggggtgtgaattccaccatagggcagtctgatgtgggaaacactaatgacagacccaagctaccagtttgaacatcatcttaccttcaaaagaggtatgaaacccactgaaagtaaattaatcaaactaatgatctttggtgttaaatgactgaatattcagaatcaaggggatcatggagtttgcctgctctttaaaagtatccaactcaacaagaagaagaaaatgcaaaaggagcaaatgacttgaatagacattactcctaagaagattgctatcgtttcaatatttgtcccctccaaaatgcacgttgaaacttaatcctcaatgtggcagtactgagagatagggcctttaagaggtaattggatcatgagggatctaagttcatgaataaatttattcattaatagattaatgagttaccatgggagtgggactgatggctttgtaagaagaggaaaaaagacctgagctagcgtgctcagccctcttgccatgtgaggccctccacagccttgggaccatgcagagtctccagcagcaagaaggtattcacaagatacggcccctggaccttagacttctcagcctcaataaatgtaagaaatacattccctttatttataaattagccagttttacatttttggttataagcaaccgaacacagacaagacaaagacacccaaatggccaatatgcacaagaaaaaacacccaacatcaacagtcattagggaagcacaaatcaaaattagagtataccacttcatatccattagaatggccatactttaaaacatggaaaatacgtgttggtgaaaatgtggacaaactggaaccctcatgcattgctaacaggcatgtgaaatggtacagtctattcactcaaaacaggtaaacacagaattgccatatgatgcaccaaccccactcttaggtatatacccaaaagaactgaaaacaaagactcagatacttgcacaccaatgttcacagcagcattattcacaattgccaaaaggtgaaagcaactcgaatgtcaattgatggatgaatgggcaaacaacatgtggtttattcatacaatggaatattattctgacataagaaggtgccaacttctgacacatgccacaacatggattaaccttgaaagtatcatgctgagtgaaataagcctgatacaaaaggtcaaataatatgtgattccacctatatgaagtaccaagaatagccaaattcataaagacaggaagtagactgatgttggctatgggctgcaagaatggaaagatggagaattactgtttaattggtacagagctgctattcgaaataatgcaaaagttctggaaatgataatgacggttgcacagcatcatcagtgtatataatgccacttacttctatacttaaaaacggctaaggtggtaaattttatgtatgctttaatgcaataaaaacagatctatttttcaaaagtattttgtccaagaggtacactagaaggtgaggagacaagtcaatttagtccaaatatgtgtatttccttttcctgtgccagaagggggtcactaaggtgttaggaacaaaatgcaaaaaaataaggaagcaagaaatattctaattcccctgacacaaccgtaattggtagcaggatgaaaatctcaaaatgtctgcaccttgagaatattagagaggccttgaagaagcatgaaaccacccggcaaatacttacacatagactgatttagagtggaaaaatggtcatattgcatccactaccacaatgcctagcaaaagagcccaatggagaaaatcaaaagggagaatatagcactgcgataggggttgggtccacggaaagcctctgcaaatctacatcagtggttctcattcataggcaattctgtcccctaggaggcatttggcaatccctagagacattattggttgttacagctgggtggtggagttctgcaggcgtctagcagaggcttgcgatgctgctcaatagcctgtaatgcaaaggacagcccacaacaacagttatccagtccataatgccaatagtgctgaaatggagagctgtcagctacatgaaagctgagccttctatgtagttggtcaatcagttaagatggaatgacaggtacactcatgagcgagctgtacagtcagcaaacttggagatgaatttgcttacaaagaatatgcttctgcagaattccctgacttaagtaagctcgaggataaacagactctcccttggctcaattccctataaaaggaagtgaaaaaatgcatcaagtgcctagtcggcttttacagagcaaagcaagaaaacctgtcctttccacatctcctgaagagcagagaatggtttggtccttgctgttgctaccattctgctcactcagttcaggcatgaagaggtggccccagcatgtgctagtgcaagaactggcaggaaaatggaagttaatgcctggagggaaacttccacaaattcaaacagtcaggtgcagaggacaaacttattacctactgataagacataactctgtaatctcaatttatggaaaactaacctttggtggagacacaggggtaaggtttctgcaacagaatgaaggtttgtgtcccccaaaaattcaaatgttgaaatcctaattcccagtgtaatggtatttggagacaggggtctttggcaggtaattaggtttaggtaaggtcatgagggtagagcttccatgaatgggatttgccctcttgcaagaagaggccagagagttatctaggtctttccaccatataagaatataaccagaagtcagctaacccctgctcagaaggggggccctcattctcagactaccagccctcagaactatgtgaagtaaatttctgccatttgtaaatttccaagtctatggtaacttgttctagcaggcacaaactgacttaagacagcgttcctctaagccatctctcatgtttacatggcttagtctgtagatgataccacatagagacagagaagtctgttaatttccctatgccatagtttcctcatctgtaaaacaaggataaaaacagtccctgtctaacaggattattagggggattcagggagttaatattcgtaaaggacttggaataataaaaaagtgctacatatgtatttataaaataaagactgtaaagagctatcatattagaggcagcctatctgattagcatcatttctttaagaacgatcagacttaaaagaatttgtattttaaagaagaaaagataataaaatctttaggaatttaactgagagtttaccaagatttcatcagtataccaaagaaagactttctggcaccctctagagattttatttttgtctctaaataatcttcataatgttgttcatattttagtattttcaaatgaaacaactcttcacaacttattgtgagacttgagattggacaagcccgagacacaattatactagtaagagttttcactgtcaaatttcttattctaatattgggaagcagaaatgattacatagttttagggggaggcgtaaagatgtaggatatttcctacagaaaaatctattcattcttttttattattatcacaagttctgggacacatgtgcagaatacacgtgccatggtggtttgctgcatccatcaacctgtcatctacattaggtatttctcctaatgctatccctcccctagccccccacccctcaacatgccctggtgtgtgatgttcccctccctgtgtccatgtgttctcatggttcaactcccacttatgagtgagaacatggggtgtttggttttctgttcctgtgttagttttctgagaatgatggtttacggcttcatccgtgtccctgcaaaggacatgaattcatccttttttatggctgtatagtattccatggtgtatacgtgccacattttatttatccagtctatcactgatgggcatttgggttggttccaagtctttgttattgtgaatagcgctgcaataaacacatgtgtgcatgtgtctttatagtagtatgatttacaatcctttgaatagatacccagtaatgggatggctgcatcaaatggtatttctgcttctagatccttgaggaatcgccatactgtcttccacaatggttgaactaattgacactcctattaacagtgtaaaagcattcctatttctccacatcctctccagcatctgttgtttcctgactttttaatgattgccattttaactggcatgagatggtatgtcattatggttttgatttgcatttctcaaatgaccagtgatgatgagctttttttcatgtttgttggctgcataaatgtcttcttttgagaagtgtctgttcatatcctttgtccactttttgatggggttgttttttttcttgtaaatttgtttaagttccttgcagattctggatagttgttgggaaaactggctagccatatgcagaaaactgaaactggaccccttccttataccttatacaaaaattaagacagattaaagacttcaacataaatactaaaaccataaaaaccctagaagaaaacctaggcaataccattcaggacataggcattgacaaagacttcatgactaaaacaccaaaagcaatgccaacaaaagccaaaatcgacaaatgggatctaattaaactaaagagcttctgcgcagcaaaagaaactattgtcagagcgaacaggcaacctacagaatgggagaaaatttttgcaatctatccaacaaagggctattccttctaaaatctgtagaaaactaacatttgttggagacacagggattcaatagtgttatgcttatctgtccaaaacccgtatatagtaacaaaaaaagcaaaaggtagttccaagatgtttacagtgtttatggcagagcacatttatgcacaagaatttaaaatttaatataatgatatgactcaaaatgactcaaattgatactaaaagatgaaacagttatcccaaaacatagctgcattttgcacatcaaataaggcagcatgcagaggttaaagtacagcagatctgctcccaaacctagttagtggatatacagagacacattctggcagggctgaggttacttgccaccagcccctttatatttatctttcaaggtgaactggatcacaaagagattttattgaccgtctgtgagtttaccactttatcataatgttaaaatcaataaaaacatgttgtgtataagtcacctctccgttctgaaccaattaagaaatatcagatggaattataaagatagcatccactttactgctagtggagctgaattatcaccttgggctagataccaaagcagctaccctgctacttcactttctgcgtgggaatttcccaactggacaaggggctggaatggagtccacccctttgacacctgcccaaggtggaggcgacaaggaggaaatgtgcagcttcacagtagccttgcatcatgcactgaccttcaacacatccattccatcccaaagcgggaccagctggtgacacaagcccccactggtgacaaggaagtaaaagtaatacagagggagcctagaaaaggcaatctaatattactacctgcaggggaatggcagtgatggggaaatcaagtgccctcacaacacagacatccaagccctactattcagcagtgaatgaaatggtaggcatatttacagccttagtttgagagcaaagaaaaacaaacagaaacgctggaattgattaaacatgcattgaagtcccatcctagttttaagttaaaatagcaacttttaatgataaaattctctcactcttatgacctctttgtgagaaaaaattgtgagaaattttaaataacctctgcactgcaaaaaaccacagcagtaatatcaaatatcattgaactagtaaacataagatagcagtctgaggggaatatgtgccagaatccccaaaaccgcagaaagtaccaaatcctctatatacactaggttttttcctacacacacatacctatgataaagtgaaatttatagttaggcacagtgggagattaacaataactaataatacaataggacaagtatgatataccagcatcgctactcttgtgcactggagccattattaagtaaaataagggtgatgtgaacacaagcactgccatatcccaacaggggaccccatcaccaagacagttcataagtgactacagggttgcagggagcagagacagcatgcattccctggagaaaggggtaatttacatcctaggtgggaaggaatgggacagcgagatttcagcatactactcagaatgtcacctaagttaaaacttatgaattgcttatttgtgtaattttctatttaatagttttagaccacagttgactgtggataactgaaacctgaaaattgaggataagaggggactactgtaatgtttaactcacgaaattgataccacaatcccttacccagatagcctgtactattcccaggtaaacaccatcattaattttcaaaggaaaatataacccagacatcttttaagttacatatgaaagaatggaaatgtaccagtgatgaggtgattctttcaaacaattgtgaaaaaaatacataaataatctaatcacaaattggtttgcccatgtagaaaacaaagaagaattctgacctcatatagtaatcatgactacatcctttcacttaagtggataacttaaaaataattttcctatggaatcacaaaacctctgtcccttcagaagcaaaggtttctaaattgttcaatcattctggtagaaacctttgttgttcagggtttcaaactctaagtacaagctagctgttagacgattatacgtagttcttcaacttcaaaactacctccctcttcctacaacctcaatctttgcttcctaacccctaattcactattgaatttttgtaagaacactgctatttatggttgcttctctgaaaatacataattcaatttgaaatattcataccctgggaaagaaaactgctgcccaaagcattttacacatttgggattaatgaatataatggactgaatctttgtgcttctctcccacaaccaaatccatatgttgaagccctaactcccaatgtaacagtatttaaagccaggggcctttgagagaaaattatattcagatgaggtcgtgagggttgggccctcatgatgggattttaccgtccgtatagcaggggaagagatgtcacaactctgccatgtgagggcacagcaagaaagcaactgtctgcaagccatcaagaacccaaccctgctggcagtctgattttggacttcccggctttcagaactgtggggaataaatactgctgtttataagtcacccagactacggtattttgttatagcagcaccagcaaactaataaagtaatcttgaatagactcaagactatactaggaagattcaataactcatggagtttcccctccataaatcaagaccagaaagtaatcaaggttatcaagaccaaatgttggttcaccagcaagtttgcttttgcttccacacaatctcacaaggaatatccttgataaggaataaaacagatgaaattgtgaagaaagtgtataaattctctaattttgtaacagctatagcatgactaagtaacattactaaatgactcccatttataagatcttcaacctggtgctattcatacaaagaagtggaagacacgatcattccctatccatggtcccttagaatatgggcagaatctgtaatggtatgatttcagatagataggtagaaaaagaggagaggagggaggaggcaggagggaggaggcgggaggcagcagggaggaggtgggaggcaggagagggcaggaaaggcggggagaggggagagtggaaaggggagaggcgagaggggaggagaagagaagagaggagaagagaaaagaaaagagaaaagaacgaaaaaggaaaaaagattttatatataatctttcaacttgggtcaaaggtgacttgggtcaaaacacaattcacagagaagaattccatctaagagtcagcaagtctaacatttaatcatagggttaaaatcaatataatcatattcgcaacaaattgactgtgtatgtatacacatgcacatataattaaaaagcacataaatatttaaacaaaagagaaggattactttgcaagggaaataaagctgggagaaatagtccagtagcctgatctgggtaaaagactgcttttaaaacacaccacattattaaatgctcttaaaagcatttaataatgatgtagattgaaaaggtgttcaaagctagcattgtttaagtttatacattaggcgctttaattggcattgagttataaacaatttctaaatttcgttatctcaatgttaacttttaaaagtaattttaaattattattataaatcaaacatgaaagaaataagccacatttaacatcatgacatttagtccagcaaacttgctgaattcccttgttaattatgacagttaagaccttagagtcccttgaaatttgtaagtaaatattatctgcacatagttttaagcttttcttcttgttcctgcccatgcttcttatgtctattcttattttatagcaatgactgaggttaaagaagtgctgttagcagatattcttttatttttgtgtcagaaatgggattataagccttagatttcagtattatttagcctaagaatgttttaattcctggttcactaagagatactaattaagtctgatattgaaatgtatcgtttttaaatgtgaaatatgcatatttgtaataactgattttcatctttctttcattttactccattgccattattttcctaatttcttgagatgagtacttagttcactaattagcagttattcttttctaataaatttccctctgtgtactaaactagctatattctttgagttttgctatttgctgttttaattggcatccagttataaacagtttctgaaattcattatgatgtctcaaagttaacttttaagagtaaacttcttagaatcatcattataaatcaagcctataagaaataagcatatgtaatttttaaaagaaccatattttgaaatataagcacataatttttaagctgtgttaccaatatttgaatacgcttgaagattaactctgatatttaaagtatctaatattgagaagctttcatttcatattactgcctaattcacagcaagaaaatcaaggtttgcaaaaaaaatttcccaccttcaataatgatagttgtcgacagcaccatcaccatcatcatcatcatcatcatcatattctaccaagaggtatcatttctctttaagacaaaatataagactatcaaaatctgaaggacaaaaagacttttctttcatttgggaagaagtgctatagaacaaagagaggaaaaatacaatttcaaattattaacatcaagtttcattaaactatatataaatccatctaatatataaaaatatttaagtaccaaagagcagcatgcaaaattctgagactttgtatatggcagaaacaaataaatatatcttgtgtataagaaaagaaatgtagaaggcaattatcttctactcaagctttcttcttttgaaagtgtggtacagaatagcttaacaattttgtacacacacacagacacacaaaggaacagaaattgtaaaagcaatcagaaacactcaaaaatgtgattatatcctttctagtttttcattttatatttgaaaaactatagcggtatatattaacaaatgtggtatacaattttatatataaataactccattataaatattacacattttctggctctgatccctaaagaatttcttctacctcttctttactctctctcctcaccaagatgtgttatttcttacaaaagtttgctggcttgtctctgggatgagctcccaagagacaaggtcaggcccaagtaaggtagggttcacaggagcccaagaaacaatagcatttgtaccttcagtttacttcaaatcttcaggatagatcaatacatagagaaaacagatgcaaatgtttggcagtgttctataccccagatctcaaactgaatacaactgcaccagaaacctgttctaaggcttgaacagctgggaaagtgactagatgttatttccggaatcctgagctgaagtttgcagtgtaagatccactgaccgtgaaattcggtgtctacaccttttcaggttattatttgctaagagtccttgctgcttcatgcacgttagcagtcactcactgtggagactcactctagtccagcctcaaaccttcccacaccatatttcctgagacaccaacaaagaaaaagcatccaaagagagaaggaagcatgtggacattggggcaccatcatttgcaaggtggggaagggagatggggcctcatgggagtttcgctgctagcctggatgtctcaaattaataacatttttcatttctgtgtctgcaattgcactggaagcttttacagggttcttcaaggcctcctcgctctttgattgcctctgccagctccagccgccccacatggcagagctgcctgcagtgcagcctgtggttaccatggagacagtaccccacggaagagaaagggtgaggcagatgccaagtggcaccgcagaacatgattgcagcaccacggagccccaagtactcgggacagatgtgtctatgaaaggagaggaaggtggagggatgacagagcagcagagctgtggggcagacaggctacgggagacagagggagatacagttaaaattgtcaagtgtttctggatatgattcactgtttctaccaaaatgaaatataaaaatcagaatttcaagtgtattaaaaaattaaatgtgtgtatatatatatatatacatatacacacacacacaaacatatacatacatacacatatgcctgtgcatgggcatatacaaaatacaagaaaagtttgatttgccttttcttaacatctgggaacagcatttatagaaaggttagtttccatggaaatctcaaaaaccagcaagatggctctggagcatgctaccattttatttgagcacattattgtaataatatttccaatcacaattcacatcctattctgtaccattgataagcttttgacattctttttctcttatacaaaaatctcgtttctattttatgtacaagaattatgaaacaagacttttttactaataaaaactataggttcgcaaagagtagctctcaaaatgaaagtatatatatgctatccaattctcaaagtacacaaattctcaaaagtacacaaaatgctttttctatgatgtgggtagggctgttctccagtatttcatttcttcatcctctgggcatatggaaggactggacttccctctcccttcagagctgggcatggtcacatggcccactcggcctgacgaaatagggacatacgactcaattttccaggttatttccctatctccatggctatggaagattgtgctgagatggaggatccactgtcctgggttctggagtcaccacaactgtcaaactctccattcaactcttgccaatccatgccaaaaatgtaccaacttttactcttgtgggctgctgaaaccgggaattatttgttaaagcaacctaacttaattcatcctgatacacaaccccccttattcaattataaaatattttcatgaagacattatgctcatgtgtaagaggggcccagaaatttataacatattctcttttcagggtctgccaagttaggaaatgattactataaaaggtaatatgtgaaatattccataataaacggaaaacaaaagttctgtaagagttcactttgggcagaggttaagactagaatgattaacacaacaaagtgcatttaagatggtaattttaaagagttaataagtcaagaagaaggccttctatcacaagtcaggtgtgggggtctatgacatggaataaaggctcaactactactacaaccactactactgctactagtactactactactaccactactactactaccaccaccactactactaccactactactgctactagtactactactactaccactactcctactatcagcactactactaccactactactgctactagtactactactactaccactactactatcaccactactactactctaccactactactgctactagtactaccactactaccactactactaccaccactactactaccactactactgctactagtactactactactaccactactactatcaccactactactactctaccactactactgctactagtactaccactactaccactactactaccaccactactactaccactactactgctactagtactactactactaccattactactactaccaccactactactaccactactactgctactaatactactactactaccactactactactaccactaccactactactgctactagtactactaccaccactactactaccactactactgctactagtactactactactaccactactactactactattatcattattattaaagggaatgaattgtagatgcccttgtgcccaagaaactctgcatggataaattaacttgattttttcatttaatttttaattgccacctaagaattatacatatttatggcatacacgtgctatttcaatacatgtatacaatgtgtagtgatcaaattagagtaactggcatgtccatcacttcaaacatttattacttctttgtgttgtgaacattcaaaatcctctcatctagctattattgctaactatagtcaccctactgtgttacagaacactagaacttatccctcatagctaaatgtaatgttgtactcattaaccaacttctcagtatccctccctccccactatccttctcatcctctggtaaccactattctactctctacttccatgagatgaaattttttagctcccacatatgagtaagaacatgcggtgtttgtatttctatgcctggcttatttcatttaacataatgtcctctaggcttttccaccttgctgcaaaacacaagatttcattctttttttatttattcattcatccatcaatagacatttaggctgatatcatatattgtttattgtgaatagtgctgcaataaacatgagaacatagatacctcttgaacatactgatttcctttcctttgtatagatactcaaaagattgctggaccatatggtatttttatctgtagttttttgaagaactgccctactttcataatggctgtactaatttacatttccaccgacagtgtaaaagagtttcattgtctccacattcttgccagcatttgttatattttttctttttgattatatccattttaactgggttgaaacgataactcattgtggtttcaacttgaatttccctgatgattagagctgtagatcattttttcatgtacctgttagatatctctatgtctttttgattatttgcccatttttacttggattattattattatcattataactgctgttgagattcttatatattctggatatttactccttgccagatggatagtttgcaaatattttcttccattctgtatactgtctcttcactctattgattgtttcctttactatacagaagtttcttagtttaatattgatatgatcccatttatgtatttttgcttttatttcctatgcttttgaaatcctatccaaaaaatctttgcccagaccaaaatcatacagcatttcaccaatgttttcttttagtagtttcttagcttcaggtattacagttaagtctttaatcagtttttgagttgattcttctatatgctgagagacagggttctagttttattcttctgcagaataaaggataataaataataagggtctagtttataccgaagaatctctctcaacatatacaaatatatatatatagttttcccagcagcatttattaaaaagcatgtattaaaaagattgtcttttcccccactgtgtgtattcttggaacctttgtcaaaaatcggttaaccagaagtacatggatttattttggtgttctgtttcattggcctatgtgtctgtttttataacagtactatagcttactacagtactggttactatagatttatagtatattttagagtcaggtagtgtgatgcctccagctctgttcttcttgctcaggattgctttggctacttagagtcttttgtggttccataaaaatgatataattgttgtttctatttctgtgaagaatgttattggcattttcagcatgattgaattgaatctatagatttctttagtagtatggacatattaattttaacatattaattattccaatccatgaacatgggatatttttctatttttgtgtcctcttcagtttctttcatcaatattttatagttttaattgctgaactatttcacctgctttgtcaaatgtattcctaagattggggggtttggtagctattgcaaatgggattactttcttcatttctttttctgactgctcactgttgggcatataaaaatgctacgatttttttattggtcattttgtatcttgaaactttactgcatttatcacttattttattatacttcaagttctgggatacatgtgcagaatgtgcaggttagttacataggtatacacgtgacatggtggtttgctgcactcatcaacctgtcacctacattaggtatttctcctaatgctatccctcccctaccgccccacaccctgacaggcctcagcatgtaatgttcctctccttgtgtccacgtgttctccttattcagctctcacctatgaatgagaacatgtggtgtttggttttctgtttctgtgtcagtttgctgagaatgatggtttccagtttcatccatgtccctgcaaaggacatgaactcatcttttttatggctgcatagtattccacggtgtatatgtgccatattttatttatccagtctatcactgatgggcatttgggttggttccaagtctttgctgttgcaaacagtgctgcaataaacatacgtgtgcaagtgtctttatagtagaatgatttacaatccttcggttatatacccagtaatgggattgctggatcaaatggtatttctggttctagatccttgaggaatcgccacactgtcttccacaatggttgaactaatttacactcccaacaacagtgtaaaagcattcctatttctccacatcctctccagcatctgttgtttcctgactttttaatgatcgccatgctaactggcatgagatggtatctcattgtggttttgatttgcttttatctaatgaacagtgatgttgagcttttttcatatgtttgttggccacataaatgtcttcttttgagaagtgtctgttcatatccttcacacactttttgatggggttgtttttttcttgtacatttgtttaagttccctgtagattctggatattagccctttgtcagatgggtagattgcaaaaattttctcccattctgtaggatgcctgttcactctgatgatcgtttcttttgttgtacagaagctctttagtttaattagatcccatttgtcaattttggcttttgttggcattgcttttggtgttttagtcatgaagtctttgcccatgcctatctcctcaatggtattgcctaggttttcttctagggtttttatggttttaggtcctacgtttcagtctttaatccatcttgagttaatttttgtatgaggtacaaggaaggggtccagtttcagtttcctacatatggctggccagttttcccaacaccatttattaaatagggaatcctttcccctttgcttgtttttgtcaggtttgtcgaagatcagatggttgtagatttgtggcgttatttctgaggccactgttctgttccattgctctatatatctgttttggtacctttttggtggtgtctttaaatttttctaaatgtaagatcatgtcatctgccaacagtggataatacgacttcctcctttccaatttggatgcactttatttttttctcttgtctattcactctgggtagaagtatcagtactatcttgaaaaaaagtagaaaaagtgggtatccttctcttactccagatattaaataaagccttttaactttaacccattcactatgatgttagctgtgggtttgtcacatactgcctttattgttttgaggcacgttccttctataactaatttgttgaaagttttttatcatgaagtatgttgagttttatcaaaatgtttttcttcatctattgagataatcatatagtgttttgtccattccgttgatgtgatgtaccataattaatgatttgcatatgttaacccatctttgcattttgggataaatctcacttgatcatggcgtataaaagcacttttggatgtgcttctgaattcagtatgctagtattctgttgaggatttttacatctatgttcatcagagataatggcctgtagttttactttttgttgctgtttccttgtctggttttggtatccaagtaatgctgacttcatagaatgagattggaaaaattccttccccttcaattttttggactagcttaaaaagaattgatatttgttttttaaaagtttgaattcagccatgaagtcatccaatcctgaactcttctgttttgggagactttctattactgatttaatctcattatttgttattggtctgttcacgttttccatgcaaatagaaaccacaaaagagcagaagtagctacatttatatcaaagagaatacactttgagtcaaaaactataaaaaagagactaacaagatccttatataatgatctttgggtccattcagcaagaggatataataactgtaaatatatatgcactcaacaccaaagtgcccacttatataaagcaaatattaatagatctaaaaggagatataggctgcagtataattcaacagtctactttcagcaacggacagacagaaattcaacaaacaaacactggagttaaactaccctctgaaccaaacagacctaactgacatttattgaacatttcatccaacagcttcagaatacacattttttttcatcagcacatggaacattcttcagaacagaccgtatgttaggccacaaagcaggtatcaacaaatttttaaaaataaaatcatatcaagtacattttctgaccacaatggaataaagctagaaatcaataaaagaggaactttgaaaactacaaatatcatggaaattaagcaacacggttctgaacaaccaacgggtcgatacagattttaagaagaaaattttaaaatttattgaaacaaataaaaatggaaacacaacacaacataccaaaacctatggaatacaaaaaagcagtacagagaggaagtttacagcaataaatgcctacatcaaaaaagtagaaagatttcaaataacctaaaaatgcacctcaaggaaccagaaaagcaggaataaaccaacccaaaattagtagcagaaaaaaatgtcggagcagaaataaatgaaactgagacaaaaatataaaatatcaatgaaacaaaaagttgagttattttcaaaagataaataaaatgacaaatattttgctagactaaacaagataaaaagagagaagaaccaaatagtactttgtttatctggttatttaataaccaaataaaaccagaaatgaaaaaggagacattacaactgataccacagaaatacaaagggtcattcaagactactatgaataactgtatgccaaaaaaattggaaaacgtaaaagaaataaattcctagatgcatttaatctaccaagattgaaccatgaagaaatcaagttcaatttggttttctgaaaaacaacaaataattgtttagtataagtgtgtcccatgcaatatttggaacatacttagactgaaaaaaaaagtatggtttatataaaattcaaagtaaagtaggcatcttgtatttacatttgctaaatctagcaaccctaactatgtgtactttctaagaattacacgggttgtgtaaaagggctggtgagggggcattaaaagtttatcttcagattatcagtaagatgattcataaaataaagagtaattacacatttttggccttgtaaatggaaagaagatagcattcccactcatttgttaaaataatttccaaacatgatgaaaatgctctttgcttctataaaaagccattctctaaacaaaatacctgagcaattttacaaatttcaagttatgtttcttttgattccaagccactatcaaataagatgttttctatcctactgcttttttttttttttttttttttttttgagacagagtctcgctctgtcacccaggctggagtgcggtggcgcgatctcggctcactgcaagctctgcctcccgggttcactccattcttctgcctcagcctccccggcagctgggactacaggcgcataccgccacgcccagctaattttttgtatttttagaagagatggggtttaaccatgttagccagaatggtcttgatcttctgaccttgtgatccgcccgcctcagcctcccaaagtgctgggattacaggcaggagccaccacatccggcctattctactgctttttaaaaataattttgagtacttattctccttcccctcacctttgccaaaaatccatgacataactgataaaaatattttaggctgatttgctatttaattagaaatcaatttgaataataattctaaaatattaggacatagtctaaccccactaaaatcaaacaaaaacatcgttccctttacagagatctttaaaaactttgagcaagcaaaaaaaaaaacttctagtgttaaaaattaggttgtaaaaaataaataaattttatcttttaggacctaatttctcctattataagcatcttagattagtatggcacatttgttataattaatgaccagtattgatacattattattaactaaagttcatacttaattcagatttatgtaattttccctaaagttcttttactattccagggccccatccaaaatgccacaccacatttagtcctcatgtctccttggactcctcttggttcttagtttctcagactttccttgtttttgatgcctttgacagttctgaggcatactggtcaggcattctgcagaataaatgtcttccacatgattagactgaggttatgggctttggggaagaagccacaaaagtaaagtactattttcaacacattgtatcaagctatatataaagtagatttttttaattgacactttttatgaattgcttactcatatccttggatgctaaattatattttaatgctttcaacctggtattaccagcatattcaatctgaagtaaacatttggacaagacttgagggcttcaattttataaatgaatggcattcttaaattaattctaacctcatttagaataatcatatgacatttcaaagtgcaaaaacaaaatgttgttgaaacttagaaaatggaatattgtaaacattagaacattacatctgtcctttaattaagcctagtgtagcttaaaggccaaagttacaaccttacgactaggctaaaagacccaggaaaggtagaatggttgacgaagataagagtatttccctgtggcagagagtgactgcgtgcaccccattccccagggccaacgtactagcctgtgggctcagggacttaagctaattctttccagccttgccaaccttaatccaatcaatggtttcccccatgacctaagagttggcacatctcccttagtatttgaaaacacaagagaattccaatctcttatttgtcaagccaccaaatgaagaatttcagggggaagaaaggaatacatgttatttttcacttattaatcagctcctccattgaggagagtgaaaataattagaatagttatttttatagatcaaacatggttacctgttagaaatttcacatgatcctcctacctactacttgcaacacagcaatgtcggcctggttgtgtatttttcaagttctcagaatgactctttttttttttttttttagatggaatctcactctgtcacccaggctggagtgaggtggcacaatctcagctcactgcaacctccgcctcccagtcccagttcaagcaattctcctgcctcaatctcctgagtaactgggattacaggcacgtaccaccatgcccagctaatttttctatttttagtagagacagggtttcaccatgttggccaggctggtcctgaactcctgatctcatgatctgtccacctcagcttctcaaagtgctgtgattatagatgtgagtcaccacgcccagcccctagaatgactcttaaatagaaaccttttcacggcatgtaccaaccttggtaaataatcagatgaaggccccttttccttctttctgtaagactcaaagccaaaagctggagtaactagacagcatgcagaatgtcaaccatgcagctgaagatagggagaaggggccagaatgccaccttccactgagctctgagattatctacacccagacacaccacaggtaacacattttcagttacaaaccttcaaatgtctctctaagactaaactgagttaatgattttaagatacaatttagagcagattcaaacactaaagatgcacaactatgtagccaattcaatgctccaagagagaaacaactcattctaaattagtgtttgagtgggtagccacaattaaacaccaaagggcaactaccttaaaatactcgttaggccaaaggaacctccccagtctaatgacacatttgataacttcaagcatttctgtgtgcaggtttatatttcaaagacataattcactaaaggcacagctaatttaaataagcaggggatttcatgatagtggagtccaaacaggaaatattaaagtttataaaagcaatacttcattttatattaatataaattctcagatacagacatttcttatatgagatgaaataaaagtaaacacagaattactaaaatatcactcttgaagtcacaagaattcacttctaacattttattacattgcaacttttaaaactccatatcccaaacacattaaactttcttctttataaaggacatcacaatgttttcaacctttatcactcaaggtcttatgccaaaattagcatctgaatattttatagtcttttaaaatattctacttttcttttagttgacaatattccaagtcatagacagtaccttcaatttaaagataatgaaaaatataaattcactttgagaaaataaatctactttcataattatatatgttgtgtacttccaattttgccattattcatctatactttctcattataatatcttgaaaaagtagcctgaaaattcccatcagaatcaactttttcctgcagttcacagtccactactttttctgagatgctgattactggtccctgaaaacttaaacttggtacagttctatttcttggttctatattggttcatattaaatcatgaaccaaaagtatagtctcatatatttaacatatcctcctgccacaaaaacctgtcacagctgtatttatcatgagataacctgcctttgaaagacaacctgctctctctgaggatgccaggacatccatggcagctgaccagagaggcaaaaagcactatattacacctgtacatggaaaggcaggcagctcttacaaactcatcttcatattgatctctcacatcccttcagatagactatccgtcttctgtcttgtcttctcatttcaacatctatctatgatatgacttgatgaattaaaattttatccttcataaggcagctacttagatgccaggtatgcattaatgcttgtcagttcctatgtgtactatatcagtaaatgatcaattttaaagtcattttaatgatcaaccttcgaggaggttgcagtctaatggaaggagacatggaaacaaacctgtaaaccaacaaataaatgagatgatttctatcactcatatgttatgaaaaagataaaacagggtaactgttaggacagaaacacttgctttcgcaggatgatcagcagagacaggcggccaaagtggctagagcctaataaacccagggacagagaggggagataagataaaatagaaagaaactggaccttttgctggttgtcaccactagggttataagctaaggcaagatgtgggtgaactagaaggagccctaggacggctgtaggaatgatgagctcacagtgggttggccagccaggagcctgctgcagaaaccctggtgagcaatgagacagctggatcagcctcttaacactgaaggtgacaagaagtgggaggttcaaccaagatgaaaagcatccatgcaattttgaaaaatacacttaaaaaggaactctggaatgccatatgttaataaatacagacatgtgggtctaggtactctatataccatattgttctatgtatcacattctgaattttataaatcaaagcaaaacatttaaactgagctgaataatcacttattaataaaatagctcaaagagcttcatattatccatcaggaattatcattcatttagggagtaattcaataccaaagttccaaaatctgccaccagagattggccttccttgacactgggtaacttgctggtttcatcctgtggtctctgttatagattgaatgtttgcgtcttctcctcacccaccaacaaagtaatatgatgaagtcctagcccccgatgtgatggcatttggaaatgggacccccggaaggtaattagtgttagattaggtgatggggatggggccctcaagaagggatcagcagctttctaagaagacagatgagagatctacaaaaggccatgtgaggaaagagcaggaaggcggccatctgcaagtcaggaggagagccctcacctggaatcaaatctgccagcatcttcattttagacattccagcctctaaaactgtgagaaataaacgttgtttaagccacacaatttagggcagcctgagccaactatgacagtcttggaaaaaatttggtggaatccttccaaagccaggatgcactatcacttgacattggacaagtttttctgaacttctgagatgacagggaatatagtatgttattaaatttggaaatatttatgcccttaggaaatatttatgcccttcagtgtggtactcaattatccactcagtgctacagcacagtctgtgaatctgttgtcaaaacgtcctaccatcttctcttggtgattcatgaacagcttcacaaattcttctgacatcataatattctctataacatcacacatctgcacatcacaaaacctgacaccttacattgtgtctatatttttaagcccagaatgcacatgcagcttagcttgtcgatgatggtgaacttttccacatgcagcttagcttgttgatgatggtgaacttttccacatgccaatgatttcatgcaaagagtacatatagcaccagtgctgatactgggatgaatagcctaccttatttgtcttctcgatgccttctaatcaatgtacgaacagtcctacatttctccaaatgaccataaatatctatcttcaaagctatgctgacagtaaacatgaaagtaacaatgctctactaatatgaaaaccattcagcagacaaactgaaattacttctgtagtagaactaactatttaacataagtcctgggtacacatattgaaaattaataagctatagcaaagaagaaatattttccctcataatccacaaagcaatttgctctaaagaataaaaagaaaaaggaaaggcaatggacagttgtgtaagcatcaaagatcttgagagaaactgccaaaaaaaagacaaaatctcttcggagttagacagcaccttctttgggccagagctaaaaaaaaaaacctcacatagccaccaaatcccagcccaccacatctcaattagctaaaatgataaataactgtaaggaacagcatgtatatttaaaatcagatgaatatcacctaaggatattccaagaatcagtgaacacgacgaaatctactactggtccaaaaatctgttacattgctttcaaaattcttatcctccctttcaagagataaaatatgagaaagcacttgtaaagactaacatgctataaaattctacggaataactttgcttatatttcctcccacactctgttcaacttaagacagcactttacccagccctgtcaccagctctcccacttgcggctctgcaccgcctgccattctgtaggtctaactgcactactgtaaaatgcatgatttatcaggccacaaggaagccatataaactcatattattactctgtaaacatacagtatttatgtttactactgaaagatcttaaatcctagtagcaattaatgcattttaagagaatcggcacatggagaaagggaaggatttcagagatgtgatggaattaaggctgcacagccatctcagttggaaatccatgtttgaaaaggatagaaatagctacccttcaactagaaaaataaatgactaaaccattcagagggggacagattatctagcgctggaggtatatacatccagagcttgctgctaactactagttataacttcttgcctcatttaaaattaaatttgtccagtttgttgaatgaatgcataaatcaataaacagtggactcgcccattataatagttctgtttctaaaactagtttaagctaccttgcacctttccacttcttgaaattcctgcatttaccaggtattaccaaactcccagctcctagctcatgaaaacatcctcagcttccacatccatcgcctatatttgcaaaggaagaaggatgctttctgaacgttaatttcctccagccatcatcttggctctatcctctcacactccgcttctgtcctaggtccacaggctaagtacaagctaagtacaccccatggatcccctcaactgctgcaacaggaaatatggtgtcactatacaatttatcacacaacccatgctaaactgctgaaagaagacttttgatttataagatcatatctgaaattgctataggcagtcagcaaaacgaagattagcatcccctctcaagtacctaaaactttgtaactcactaagtaacatactcattgaggaatgtttaacttgacttctttacttccttcaaaagttttgggaatcgagaataaattagatttctgtaacttacacatgatttcttcctattggcagactacagttagagcgataagaattctgtgcaatttgttcaaagtatttaaggaaatatctcaaaaaatggaagccaactatggttcacacttctaaaactgttctgataaagcctcacaggtgccagacgcggcagcccaccaagagagaaaataatattctggagacatttctacagacttcactcttgaaggacaatagggcttcattccactcccatctttaagcagcaaatatctgcaccacaaggaaaaaatacaagaaactttttgggccaattttgtataacttacaatatttgaagtggtatgaagaaacaacaagaattacttctacggatggataaaggagaattcttcctttaggcaatagccaatagcatgaaatgtagcaatatctttacaaccactatggaagtgggcattttataaacacattagtaacaaaattcagagatttagttttataggcaagaaaatcttttgactctaactcttaccccccaccattactgtatttttgaagtgcatcaaaagttccagagaatatattttatacttaaatgtttattatgattaagcttcccaaagcattttcacctaaattatcacagcacattcaacaaagccctgtgagtttttatcccaaggaacaaatgacaaaataggcaaagatgcaaagtcacaagagaaggcaagtgccaagcacgatttagatcccagaacttggcatcctaaggcagtggtccctccagggtgctgcagtgtctgtacccaaaaccaacccaaagcaagcaaagaaaccttggttcagaaaccatttttgccccaaatgatgaactaagtgtttgttacatgcctactactatcctatgatttgtggatcaattattttaaaagatagattaccagtatggggtggggctggggagaagcatggtcctatgtgaccagagagaaggagtgtgtgcctgagagcagggggagaaggtagaaaatcatgtgtttgcctaaaaacagtgtcctggctcttcccaacgaacttgaacttgagaaatgagacatccctgaagaacacacagtcaagtgccagaaccacacacaaagcactgcacctgtgagccccggactgccacaaacaccttgccttttcacacagtgatcctggagtctgtgcaggtgcgtttatgcttcatgtgggaaaagcaaacgccagaattacagaaaagcatctggcatctgtattatttcgcagtagaaacagctaatgtgtgttgtaatagtgaatataccacatactctgctatgtattttaagtccatggtctcttaattcaccgtcgcaacaacctgaagacacaggaattattgtttcccctgtgttatgacacttagtagtaaaataaccgttcacttagaaaatgatgaagttgggatatgaactcagtcagttggggtacaactttgaagctattttctcaaccatttgctccactgctgtatttactactgggacacacgaaatcagcaagcagtaaaatgtttccttaaagaagaactcctgtaggacaagtgagtaagtttaacttcaagctttagaattatgctcccaaaataggaaccaataaaatgatatataaactgttaagacatgacagagtgacataattactatagacaaacaatataaatcaattttaaaaaaggaaaatagataaattgagaaatgtgtataagatataaaaagataattcacaaaaaaattagacgtagacaccaacaaattagaaaatatttaacctcaggaatattaatagagaagcaaatgaattagagaaaaacacaatatttctcctatgtaattagaagttttatttttctcattacaacacccagtgttgttgaaatcatgggaaaatttgtacactcctgccttgctgagagaaatataaattatataatcttcctggaagacaaatgaacaacatatatcaacaaccttgaaaacatccagttctaggaagtaatctagagtaaataacctgatgacaactatttagttattaggatcttaattacagcattaaatataactaccaaaaatgaaaatgtcatcaatctccaataacagagtgatgtaagtaaataatgttatataaaggtatggaaaacagacactaaaaataaatactaattacatgagatgttaataggtaactaaacagaatatgagcaatgttttctaaatttaaaaatgtgtatcgcttgatatctctgctaaaaatatggtcatttctggggcttgcaaccatgcatgaattttaacttcttttaatcatttctgtatttttgaattttcaatgagcatgcactacttttgaaaacaaacaaatctcaaatttaaaggcgagaaaatgtaagtatggctgatcaaaatctgtgtaatctacattccatgatgaatgacctttgttaactttaagtcatgcattcagctaattaatgaacttcaccccaaaataaatatatactattcttttcaagaatggaaaggcatgcttttcttctgcataatgtaatatatatattaaactatgatatatttagtggaaaagtaatatataaagaacaaaactcttgaaaccctgacataaacactgtgttctcagtgttctcacatttgggagtgggtatgtgtgctgggtatcacattcaatatagttatttgccttgattatcttcttagctttagtattatgaatagttctcatataattagctactctgaaactataattcataattgcatatttctttggctagaggtgccataatatatctatgcacctgctatgaatttaacattactctttttcaacctgagttaagcaacacaaataatctgatccagatgctacaagccccagccttcctgcatcaaccttccatgtcctgggttaatgagacaatttgtactatctctgagactttttatataacacctgtctgtctttctggaggattcttcttccttatttggtttccccatgaccccaagaacaatgctccacaccagtgaagactgtgttagagatgagagattgaactgtggctcttttacatttggagctaccaaagaggttgctctttctggaaattacattattgtatactgttgaaggtaatgactgctatattagtctaatatttgaaagtccaaataaaatatgtgacagaggataaaatttgttttaaaaagtgagcatttttagattgagtagtcatgcttagacttaaatacaacatcgtatctatttagaaaagcaatgtttatcttctttctttactgtgtccatgatttctcctattaattgcaaaacatcaaacagccaccaaaatctaattatttatactgaggcagaaaaagctgtggaaaatagctagcctagatcacttatatatggtttgggaagtcagattttaacatcatcttttttatgtctaattctcaccacttacaaagcgatccaattattggcagttaaagaataacatgaaaaataggggaagaacgccaagggtaagttattttaaagttggctatacataaatctgctgaatttcatggaccatagttgctacaaatcaaccagggcattagacgctaccttgataactcttgatgtagtgtcaaaataccatgaaatatttaaagagctcaactaccaagcaaagtactgtgaaagctactatatccagaattctatcaactagaattcttcataaaccatgccaatggggaacacttcttctctattctgatatttcctttcaggcaaagggaacttaattaatgtaacactgctggcctctctccagcttttcactttctctgcctctgaagaataaagaagcagcttgccttgctgcttctctcttcctctggagatcatcctccctgcagagagcaaggcttggctctgccagctcagaaaaagctctgtccctgtggggagggaggagggaaagaaggcagaggacctgggatgtaattcaactgccacaccaagctatgtctaatcaaaactgatatttttgcccatggcagccaattatttatctttttcccttccaatatcccaacatgctgagatggggagtggggaggaggagagcttgatatttatttgattccttaaagacaccaacaacccacattcctgcacattttgtaattcttaaagtaactatatacctttctgtggtttatgtaattgcatatttaaatgcaaagagataatacaataaagcatttgtacattataaggaggtttctaaaccaaaagaaagaactgcataaaacatgcacaaaatgcagttttcttaaaatttctaatgacagttgtgataatcacatctgttaaaccaaaaatgttactaatacacttctctggcctttacctaggcaagagaagtgtattttctaatatcaatgatccaattaattgttcccccatcatctagtgttataaagtaaacatcctatttagtaacatttctgtatcattcaaaacttgtagaaatgttacatatatttatttaaccaaatataattggctcacctgcttactttgatccaaaaaaacaaaaaaacccagtaaggccttttatcataacatgtattttgctctggtaacttataattggcagttcccacaacaacacataaatttgaatacaaataaccacatttattgtaaaaatgtttttctgactgaagataaatttgtcccccattatacagctcacattctgaaacaaattccaagatacatcgaatcgtaattatcctaaaaattatgttgctgaagatcacagttctaaatgaagcccctctgggtttgatcatcccaaggagctggacatcttccaacctggaagagctgggcacttttttgtcttcactgaagctcttaagagtgaaacaaagcaaaaatgaccatctattttcaaagaggtaccaattcacacactttttagttctcttcaaggacttgattttaattggggagggggtcttccctttatgtaatacatttagctgtttaaggtttcttttttctctatcataatgacatgatgatgagattcatgctcggtggttctaaacagagcggatgtgtaatatctgacctcacagagagtgatgcttattaaactgtctatgatagtctttgtacaacattaatctttgtagaaaatttgatcttaatcaggtgactaatataacactaataaagaatatcaaagttttgtaatttctactgggttagaatcttttataataatggtgttgggagatataatttacttctcctttagcttaactgctatatactttaatatataaagggctggtatgtttcagaatagaaagtttagcatattttataagcaaatctgcataatgaagcaatattacaataggggttggggtagggaaattacagccatttaatatcctttgttagagaggatggtaacctagataacctatttaattagatatgtataaaacattagtacctgtcttaatatgtatatattgatttcttgtgttcacataaattttgtaatttacaagccacttatccatgctcttactcactttatcctcaaagaaatcttttaagatattgtgtcttattctacccattttacagctgaagaaactgagttaacaactgaggatcacataaatggtgagggatacacagctaagaagagacagggctggaatccaccaaaagccagtgctctctccacatctctgtacccaccagaagcagaatgcaaaacagcattacactagggaaacttatttttccaataattgtcatttcagatcacaaacatatttctagagaaatagttgggctctgacatataacgtgtttgtgtgtgtgtgtatgtgtaactttattacaaaatattgtaatatataatatataagaacccaataaaatgtttcaatatatgtaattcattttgcacgtaatgtgccaagagagacaggtgaatatttatctaagatagaaaggttctaggaagcattgtttcacttatttagtcattatttccaatttgtcaaaaactaattgatacaggtacttcaatatcctgacatagctaagacacttcctacaaatcaattaaccatgattcagagcttggaattgcacttaactgctatgtgatcaaaagataaacaactggaggtgtcataactgcagatttttgttatgagtcttaatatttaatggactaaaaagcacagtatgataaaatatttctgtgagttccctgtgttggaggtactgtttgtgactataactgagtttattaaacccaaccaggcagtttgttaatcagtaggctggattggcagacaatgtgatagaaactatttattgatgacatgtttaatattttatattaatataaaaagctgttgctttggcatataatcagataacttgaagctagcaacaagtatcatgaactgttcctactcaaattaacttttcacacaccagaaggctatcaaagtactgtggacaggagaacaccttcagaagatgaatgaggaaaaccatcatggaagccaacaatgaatttggcttggcagtgtatttccaacttgcaaatcagccagcaaagaaccacaccttcagctgaagtactggacttgaaaatgactagcagtccatgcttagtttttgttcattgtctgaattatgacatccaagtttaagtactcccaactatgttaagtcttttaaaaataaaaactctgttaggaaaagtgagactagcatcaaggatttccctctaagaagtgaaaataatgttcgcacagagaaaaaacaaaaatgggtgttcccattttctgtggctaatcataaagaagaaaacattggaagttcaaaatgtaacagtttctattttaattcaattggcttgttacagctgtatacactggtccatacatagtgtactgaccctatggacaaattacaataaattatttcaaatgtaatgttaatgttttcttaaagacaacctgatgaaattactctgaaaaccccttcgacaagtccacacaaattcataccacacaagaaagaagtctgataaggcaaaacagaaaagagcaagttctgtaacattttctgcaaatacactgcatattcaactaaatgccaaagtaatattatatttgagattataacttcatttttaattttagaaactattatgaaagcaatattatccttagaaattatttaacaaaactataaattgcatttgcaaactagtatttgaatttcatttttgtctctgatgaacaatttcactgggagaaagaattggcttatattctattgtgaaagatgtaaagtggatagaaatactgtaatttgacagtgtatgacttttattacgaacaatgaaaacattagtgacatctataatgactgggttatacaactacacaaacgtacaccaaattaaataactcctttccgcaagactatgacaattttattagggcaacaacctcacgtacttaccacaattgccattcaatcagataatatcattttcaatccacaatataacataaaacccacatatacagtatatgtagtttttcacatgcccatcggccgctctgggtacacacacaggcacagagcagtatcaactagtcctttaaaaatcatgtttaagaatgaaacactaggctcaaaaggaaaaaagaaaaggaaacgagacatgtatgctacttcatctattgcttttgaaagaaattttatattaaaacaatgcagtgggcataacggtgtgttcaaagtgctctcggaaagttccctgaatgtgaataaggtgaaactaaagcaatattgctaaagactaatcacagtattcaatcaacttgagccgtatagaccttgccagtcctcctgcaacactgacttgtgattagtgtaatcaaaggcctcccaaatttcaacacttaactccgaatgtaatcgtcttccttcaagccctgagcccttggaacccacagatcagtaatgatgccacttaacatttttccccaacaacagtaggaacattctccgtatggcaaccatatgctaataaaagacatttgagggcagtttaaagcatctagttcgtatttgaggatactcgcccctatatatcacacgtctcgtagcagaaatccccaaaataatgacaggttcaccgccataacttgatatgagtcacagcaaacacttctccatgggattttagaagtggtgcagccccgaagccttgtcattatgtaggtgaatgaccagcagcagagaccagctggactgccctcggtagcttcagcccctgatgaagtatgcacaatgagataactcctagggagtttcagcacctccttgttttcatggaagtcactgcagaaaatcccaagactcttaaatattggtcacatagttcttaaaagtgaaaatttacacctgtcaggcctaatactatgctgacaacattctctgttttctaaatcaacatatttgcttgagcacagtaaaaatacatcttaataacacctgccagagctaaggcgaatcagatcagctcaaatgaggcacacaagaaaagaaaagaaaaaaaaacaccttggaaacacaacctgcccctctatctctcatctcccacacccttcatacccccacggttacagcaaaatacaactttgggcattttggaagtaactgttatttgtgacacacacacacacaccccaaaaattcccaagtctgttttcctaccacaaacaccagggaggctgcatcacctttctagtgacttaattctgaaagcagaggctcaacctgccgagtggcaatcgaagaaaacacactacacaccagaataagatgagggtcgggaaaaaaagaaaaaagcagcttcgctttcagccattaattacggatcaccccaattttgcatcgctcatctcccatacacacgcacagccttccaaacctggctttcaggcggcgctttctggagcctggctgtctattgtcagcacgcagaagcccccgaaacctgtgaagccggctgcaaaggcttgctgggaagccgctaaatatagaccaagggggctcagggtctggcaagccgcgggagcctgaagacacggccatggacgcatatgactaagtctttccattttgttctagccaaacatcgtaatgacattgaacataagggcaaaagactggagggaagtcctccccacccccaccccgtctcctcccgtatattagggacgtcatgaatgcaccgagtatgttctcagggtggcggggagcagcattgtcggtgttgccctaaatacgcttcctcccggggagatgggtggcagggagggggagcacgcagggcagccacttggtaaccgctccaagaaaggcactaaccccggacccccttccaggcacagcggcttccgagggggacctggcgcgatcgcggtcctccccgaggcaggcagaaaccccgcagcagccgccgccgccgcctgccggccgggagcccaggaccacccccaccagcggcaagaggaggaggacggcgccgggaggaggctgcgcccggccccggccgcccagccccgcaactcacccaaaggcgcggcgcccggcggcttcctcgcaaacatgcaccctccgccggcgacagctcctcagtccgggaagaggcgtgcgcggcgccgcccggcttcagggcaaggtcctgaccttgcccaactgcagcatcttccgcttttgttgtctgagcgcggccgcgggacaagggatgctggc
